US009850493B2

(12) United States Patent
Beardslee et al.

(10) Patent No.: US 9,850,493 B2
(45) Date of Patent: Dec. 26, 2017

(54) BIOLOGICAL METHODS FOR PREPARING A FATTY DICARBOXYLIC ACID

(71) Applicant: VERDEZYNE, INC., Carlsbad, CA (US)

(72) Inventors: Tom Beardslee, Carlsbad, CA (US); Alex Hutagalung, Carlsbad, CA (US); Stephen Picataggio, Carlsbad, CA (US)

(73) Assignee: Verdezyne, Inc., Carlsbad, CA (US)

( * ) Notice: Subject to any disclaimer, the term of this patent is extended or adjusted under 35 U.S.C. 154(b) by 0 days.

(21) Appl. No.: 14/654,458

(22) PCT Filed: Dec. 19, 2013

(86) PCT No.: PCT/US2013/076739
§ 371 (c)(1),
(2) Date: Jun. 19, 2015

(87) PCT Pub. No.: WO2014/100504
PCT Pub. Date: Jun. 26, 2014

(65) Prior Publication Data
US 2015/0353966 A1 Dec. 10, 2015

Related U.S. Application Data

(60) Provisional application No. 61/739,661, filed on Dec. 19, 2012.

(51) Int. Cl.
C12N 1/14 (2006.01)
C12N 15/52 (2006.01)
C12N 15/81 (2006.01)
C12N 9/02 (2006.01)
C12N 9/90 (2006.01)
C12P 7/44 (2006.01)

(52) U.S. Cl.
CPC ............ C12N 15/52 (2013.01); C12N 9/001 (2013.01); C12N 9/90 (2013.01); C12N 15/81 (2013.01); C12N 15/815 (2013.01); C12P 7/44 (2013.01); C12Y 103/01034 (2013.01); C12Y 503/03008 (2013.01); C12Y 103/03006 (2013.01)

(58) Field of Classification Search
CPC .................................. C12N 1/16; C12N 1/28
USPC ...................... 435/121, 134, 254.2
See application file for complete search history.

(56) References Cited

U.S. PATENT DOCUMENTS

| 4,683,195 A | 7/1987 | Mullis et al. |
| 4,683,202 A | 7/1987 | Mullis |
| 4,965,188 A | 10/1990 | Mullis et al. |
| 5,232,841 A | 8/1993 | Hashimoto et al. |
| 5,268,273 A | 12/1993 | Buckholz |
| 5,389,529 A | 2/1995 | Panayotatos et al. |
| 5,470,719 A | 11/1995 | Meng et al. |
| 5,595,899 A | 1/1997 | Sato et al. |
| 5,648,247 A | 7/1997 | Picataggio et al. |
| 5,656,493 A | 8/1997 | Mullis et al. |
| 5,712,114 A | 1/1998 | Mankovich et al. |
| 5,766,891 A | 6/1998 | Shuman |
| 5,846,818 A | 12/1998 | Robinson et al. |
| 5,888,732 A | 3/1999 | Hartley et al. |
| 5,932,474 A | 8/1999 | Tsien et al. |
| 6,008,378 A | 12/1999 | Tsien et al. |
| 6,054,271 A | 4/2000 | Tsien et al. |
| 6,143,557 A | 11/2000 | Hartley et al. |
| 6,171,861 B1 | 1/2001 | Hartley et al. |
| 6,270,969 B1 | 8/2001 | Hartley et al. |
| 6,277,608 B1 | 8/2001 | Hartley et al. |
| 6,288,302 B1 | 9/2001 | Yu et al. |
| 6,451,569 B1 | 9/2002 | Tsien et al. |
| 6,720,140 B1 | 4/2004 | Hartley et al. |
| 2002/0007051 A1 | 1/2002 | Cheo et al. |
| 2003/0083373 A1 | 5/2003 | Tsien et al. |
| 2005/0112590 A1 | 5/2005 | Boom et al. |
| 2005/0287592 A1 | 12/2005 | Kless |
| 2010/0041115 A1 | 2/2010 | Nicaud et al. |
| 2010/0285545 A1 | 11/2010 | Gross et al. |
| 2011/0118433 A1 | 5/2011 | Poetter et al. |
| 2011/0129885 A1 | 6/2011 | Lang et al. |
| 2012/0077252 A1 | 3/2012 | Picataggio et al. |
| 2014/0228587 A1* | 8/2014 | Beardslee ............... C12N 1/16 554/121 |

FOREIGN PATENT DOCUMENTS

CN 101228282 A 7/2008
WO WO-9106660 A1 5/1991
(Continued)

OTHER PUBLICATIONS

Akbergenov; et al., "ARC-1, a sequence element complementary to an internal 18S rRNA segment, enhances translation efficiency in plants when present in the leader or intercistronic region of mRNAs. Nucleic Acids Res. Jan. 12, 2004;32(1):239-47. Print 2004.".
Alani; et al., "A method for gene disruption that allows repeated use of URA3 selection in the construction of multiply disrupted yeast strains. Genetics. Aug. 1987;116(4):541-5.".
Amberg; et al., "Methods in yeast genetics. A Cold Spring Harbor Laboratory Course Manual. New York: Cold Spring Harbor Laboratory (2005).".
Arent; et al., "Structure and function of plant acyl-CoA oxidases. Plant Physiol Biochem. Mar. 2008;46(3):292-301. doi: 10.1016/j.plaphy.2007.12.014. Epub Jan. 3, 2008.".
Arnold et al. The Swiss-Model workspace: a web-based environment for protein structure homology modelling. Bioinformatics22(2):195-201 (2006/Epub Nov. 13, 2005).
(Continued)

Primary Examiner — Tekchand Saidha
(74) Attorney, Agent, or Firm — Wilson Sonsini Goodrich & Rosati

(57) ABSTRACT

The technology relates in part to biological methods for producing a fatty dicarboxylic acid and engineered microorganisms capable of such production. Provided are engineered microorganisms capable of producing fatty dicarboxylic acids and products expressed by such microorganisms. Also provided are biological methods for producing fatty dicarboxylic acids.

15 Claims, 46 Drawing Sheets

(56) References Cited

FOREIGN PATENT DOCUMENTS

| WO | WO-9114781 A1 | 10/1991 |
| --- | --- | --- |
| WO | WO-9619497 A1 | 6/1996 |
| WO | WO-9826079 A1 | 6/1998 |
| WO | WO-9856943 A1 | 12/1998 |
| WO | WO-9921013 A1 | 4/1999 |
| WO | WO-03100013 A2 | 12/2003 |
| WO | WO-2009037329 A2 | 3/2009 |
| WO | WO-2011003034 A2 | 1/2011 |
| WO | WO-2012094425 A2 | 7/2012 |
| WO | WO-2013006730 A2 | 1/2013 |
| WO | WO-2013006733 A2 | 1/2013 |

OTHER PUBLICATIONS

Athanasios; et al., "Control of lipid accumulation in the yeast Yarrowia lipolytica. Applied and Environmental Microbiology, American Society for Microbiology, US, vol. 74, No. 24, Dec. 1, 2008, pp. 7779-7789.".

Ausubel; et al., "Current Protocols in Molecular Biology. John Wiley & Sons, N.Y., 6.3.1-6.3.6 (1989).".

Brock; T., "Biotechnology: A Textbook of Industrial Microbiology, 1989.".

Butler; et al., "Evolution of pathogenicity and sexual reproduction in eight Candida genomes. Nature, vol. 459, No. 7247, Jun. 4, 2009, pp. 657-662.".

Chen; et al., "Biosynthesis of phytosterol esters: identification of a sterol o-acyltransferase in *Arabidopsis*. Plant Physiol. Nov. 2007;145(3):974-84. Epub Sep. 20, 2007.".

Craft; et al., "Identification and characterization of the CYP52 family of Candida tropicalis ATCC 20336, important for the conversion of fatty acids and alkanes to alpha,omega-dicarboxylic acids. Appl Environ Microbiol. Oct. 2013;69(10):5983-91.".

Dahlqvist; et al., "Phospholipid:diacylglycerol acyltransferase: an enzyme that catalyzes the acyl-CoA-independent formation of triacylglycerol in yeast and plants. Proc Natl Acad Sci U S A. Jun. 6, 2000;97(12):6487-92.".

Demant; et al., "Continuous recording of long-chain acyl-coenzyme a synthetase activity using fluorescently labeled bovine serum albumin. Anal Biochem. Aug. 1, 2001;295(1):38-44.".

Dommes; et al., "The Journal of Biological Chemistry. Oxidation in Candida tropicalis partial purification and biological function of an inducible 2,4-Dienoyl Coenzyme A. J. Biol. Chem. at European Patent Office dated Sep. 25, 1983. pp. 10846-10852.".

Eggertsson; et al., "Transfer ribonucleic acid-mediated suppression of termination codons in *Escherichia coli*. Microbiol Rev. Sep. 1988;52(3):354-74.".

Engleerg-Kukla et al., "(1996) In *Escherichia coli* and *Salmonella* Cellular and Molecular Biology, Chapter 60, pp. 909-921.".

Gallie Dr., "The 5'-leader of tobacco mosaic virus promotes translation through enhanced recruitment of eIF4F. Nucleic Acids Res. Aug. 1, 2002;30(15):3401-11.".

Gallie; et al., "The 5'-leader sequence of tobacco mosaic virus RNA enhances the expression of foreign gene transcripts in vitro and in vivo. Nucleic Acids Res. Apr. 24, 1987;15(8):3257-73.".

Geelen; Mj., "Measurement of diacylglycerol acyltransferase activity in isolated hepatocytes. Anal Biochem. Nov. 15, 2003;322(2):264-8.".

Gurvitz; et al., "Alternatives to the isomerase-dependent pathway for the beta-oxidation of oleic acid are dispensable in *Saccharomyces cerevisiae*. Identification of YOR180c/DCI1 encoding peroxisomal delta(3,5)-delta(2,4)-dienoyl-CoA isomerase. J Biol Chem. Aug. 27, 1999;274(35):24514-21.".

Gurvitz; et al., "The *Saccharomyces cerevisiae* peroxisomal 2,4-dienoyl-CoA reductase is encoded by the oleate-inducible gene SPS19. J Biol Chem. Aug. 29, 1997;272(35):22140-7.".

"International preliminary report on patentability dated Jun. 23, 2015 for PCT Application No. US2013/076739.".

"International search report and written opinion dated Jul. 28, 2014 for PCT Application No. US2013/076739.".

Jackson; et al., "Comparative genomics of the fungal pathogens Candida dubliniensis and Candida albicans. Genome Research, vol. 19, No. 12, Sep. 10, 2009, pp. 2231-2244.".

Jin; et al., "Optimal growth and ethanol production from xylose by recombinant *Saccharomyces cerevisiae* require moderate D-xylulokinase activity. Appl Environ Microbiol. Jan. 2003;69(1):495-503.".

Kawasaki; et al., "PCR protocols: a guide to methods and applications. Academic, San Diego (1990).".

Kiefer et al. The Swiss-Model Repository and associated resources. Nucleic Acids Res. 37(Database issue):D387-392 (2008).

Kim; et al., "Acyl-CoA dehydrogenases and acyl-CoA oxidases. Structural basis for mechanistic similarities and differences. Eur J Biochem. Feb. 2004;271(3):483-93.".

Kumar; et al., "Facile and restricted pathways for the dissociation of octenoyl-CoA from the medium-chain fatty acyl-CoA dehydrogenase (MCAD)-FADH2-octenoyl-CoA charge-transfer complex: energetics and mechanism of suppression of the enzyme's oxidase activity. Biochemistry. Jul. 25, 1995;34(29):9434-43.".

Lageweg; et al., "A fluorimetric assay for acyl-CoA synthetase activities. Anal Biochem. Sep. 2, 1991;197(2):384-8.".

Landy; A., "Mechanistic and structural complexity in the site-specific recombination pathways of Int and FLP. Curr Opin Genet Dev. Oct. 1993;3(5):699-707.".

Lee; et al., "Crystal structures of the wild type and the Glu376Gly/Thr255Glu mutant of human medium-chain acyl-CoA dehydrogenase: influence of the location of the catalytic base on substrate specificity. Biochemistry. Sep. 24, 1996;35(38):12412-20.".

Masters; et al., "The preparation and properties of microsomal TPNH-cytochrome c reductase from pig liver. Methods in enzymology 10 (1967): 565-573.".

McAndrew; et al., "Structural basis for substrate fatty acyl chain specificity: crystal structure of human very-long-chain acyl-CoA dehydrogenase. J Biol Chem. Apr. 4, 2008;283(14):9435-43. doi: 10.1074/jbc.M709135200. Epub Jan. 28, 2008.".

Mignone; et al., "Untranslated regions of mRNAs. Genome Biol. 2002;3(3):REVIEWS0004. Epub Feb. 28, 2002.".

Mignone; et al., "UTRdb and UTRsite: a collection of sequences and regulatory motifs of the untranslated regions of eukaryotic mRNAs. Nucleic Acids Res. Jan. 1, 2005;33(Database issue):D141-6.".

Miyazawa; et al., "Complete nucleotide sequence of cDNA and predicted amino acid sequence of rat acyl-CoA oxidase. J Biol Chem. Jun. 15, 1987;262(17):8131-7.".

Nandy; et al., "Medium-long-chain chimeric human Acyl-CoA dehydrogenase: medium-chain enzyme with the active center base arrangement of long-chain Acyl-CoA dehydrogenase. Biochemistry. Sep. 24, 1996;35(38):12402-11.".

Needleman; et al., "A general method applicable to the search for similarities in the amino acid sequence of two proteins. Journal of molecular biology 48.3 (1970): 443-453.".

Nelson; et al., "Simultaneous detection of multiple nucleic acid targets in a homogeneous format. Biochemistry. Jun. 25, 1996;35(25):8429-38.".

Niu; et al., "Benzene-free synthesis of adipic acid. Biotechnol Prog. Mar.-Apr. 2002;18(2):201-11.".

Ntamack; et al., "Oleate beta-oxidation in yeast involves thioesterase but not Yor180c protein that is not a dienoyl-CoA isomerase. Biochim Biophys Acta. May 2009;1791(5):371-8. doi: 10.1016/j.bbalip.2009.01.026.".

Okazaki; et al., "Two acyl-coenzyme A oxidases in peroxisomes of the yeast Candida tropicalis; primpary structures deduced from genomic DNA sequence. Proceedings of the National Academy of Sciences, National Academy of Sciences, vol. 83, No. 5, Mar. 1, 1986, pp. 1232-1236.".

Osumi; et al., "Isolation and structural characterization of the rat acyl-CoA oxidase gene. J Biol Chem. Jun. 15, 1987;262(17):8138-43.".

(56) References Cited

OTHER PUBLICATIONS

Papanikolaou; et al., "Lipid production by Yarrowia lipolytica growing on industrial glycerol in a single-stage continuous culture. Bioresour Technol. Mar. 2002;82(1):43-9.".
Paulous; et al., "Comparison of the capacity of different viral internal ribosome entry segments to direct translation initiation in poly(A)-dependent reticulocyte lysates. Nucleic Acids Res. Jan. 15, 2003;31(2):722-33.".
Pavelka; et al., "HotSpot Wizard: a web server for identification of hot spots in protein engineering. Nucleic Acids Res. Jul. 2009;37(Web Server issue):W376-83. doi: 10.1093/nar/gkp410. Epub May 21, 2009.".
"PCR Cloning with TOPO Technology: Minimize planning, guarantee success PDF. http://tools.thermofisher.com/downloads/f-13512_topo_flyer.pdf.".
Peitsch; M.C., "(1995) Protein Modeling. Biotechnology 13:658-660.".
Sambrook; et al., "Molecular Cloning: A Laboratory Manual, Cold Spring Harbor Laboratory, N.Y., 1982.".
Sauer; B., "Site-specific recombination: developments and applications. Curr Opin Biotechnol. Oct. 1994;5(5):521-7.".
Sekiguchi; et al., "Requirements for noncovalent binding of vaccinia topoisomerase I to duplex DNA. Nucleic Acids Res. Dec. 11, 1994;22(24):5360-5.".
Setoyama; et al., "Functional expression of two forms of rat acyl-CoA oxidase and their substrate specificities. Biochem Biophys Res Commun. Dec. 14, 1995;217(2):482-7.".
Shaloiko; et al., "Effective non-viral leader for cap-independent translation in a eukaryotic cell-free system. Biotechnology and bioengineering 88.6 (2004): 730-739.".
Shuman; S., "Site-specific interaction of vaccinia virus topoisomerase I with duplex DNA. Minimal DNA substrate for strand cleavage in vitro. J Biol Chem. Jun. 15, 1991;266(17):11372-9.".
"Tag-On-Demand Gateway Vector Instruction Manual. Version B, Jun. 20, 2003. http://tools.thermofisher.com/content/sfs/manuals/tagondemand_vectors_man.pdf.".
"Tag-On-Demand Suppressor Supernatant Instruction Manual, Version B, Jun. 6, 2003. www.invitrogen.com/content/sfs/manuals/tagondemand_supernatant_man.pdf.".
Tjalsma; et al., "Signal peptide-dependent protein transport in Bacillus subtilis: a genome-based survey of the secretome. Microbiol Mol Biol Rev. Sep. 2000;64(3):515-47.".
Vincent; et al., "Helicase-dependent isothermal DNA amplification. EMBO Rep. Aug. 2004;5(8):795-800. Epub Jul. 9, 2004.".
Welch; et al., "Reversible, metal-free hydrogen activation. Science. Nov. 17, 2006;314(5802):1124-6.".
Yamada; et al., "Assay of fatty acid omega-hydroxylation using high-performance liquid chromatography with fluorescence labeling reagent, 3-bromomethyl-7-methoxy-1,4-benzoxazin-2-one (BrMB). Anal Biochem. Nov. 15, 1991;199(1):132-6.".
Zeng; et al., "Mutation of Tyr375 to Lys375 allows medium-chain acyl-CoA dehydrogenase to acquire acyl-CoA oxidase activity. Biochim Biophys Acta. Dec. 2007;1774(12):1628-34. Epub Aug. 30, 2007.".
Cao, et al. Engineering the acetyl-CoA transportation system of candida tropicalis enhances the production of dicarboxylic acid. Biotechnol J. Jan. 2006;1(1):68-74.
Theodoulou, et al. Peroxisomal ABC transporters. FEBS Lett. Feb. 13, 2006;580(4):1139-55. Epub Jan. 9, 2006.
Ostergaard, et al. Metabolic engineering of *Saccharomyces cerevisiae*. Microbiol Mol Biol Rev. Mar. 2000;64(1):34-50. Review.
Rolland, et al. Glucose-sensing and -signalling mechanisms in yeast. FEMS Yeast Res. May 2002;2(2):183-201.

\* cited by examiner

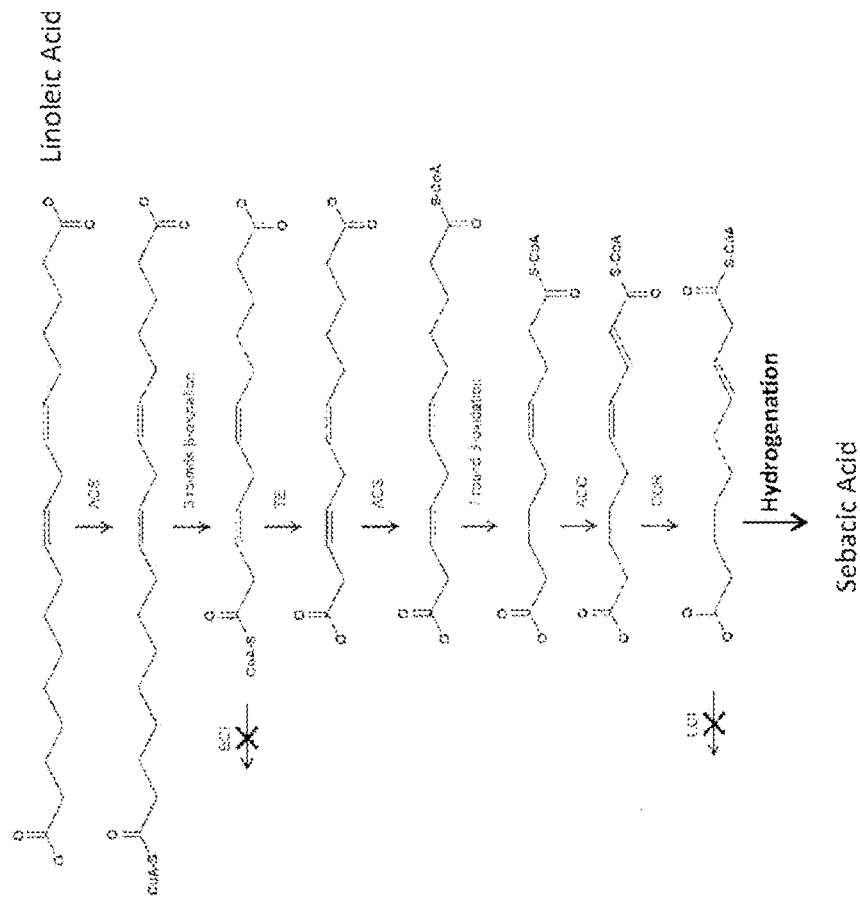
FIG. 31 Sebacic (C10:2) from Linoleic acid

|         | CtEci1p | CvEci1p | CtEci2p | CvEci2p | ScEci1p | YlEci1p |
|---------|---------|---------|---------|---------|---------|---------|
| CtEci1p | 100     | 92      | 58      | 57      | 39      | 19      |
| CvEci1p |         | 100     | 57      | 57      | 40      | 20      |
| CtEci2p |         |         | 100     | 84      | 36      | 18      |
| CvEci2p |         |         |         | 100     | 37      | 19      |
| ScEci1p |         |         |         |         | 100     | 18      |
| YlEci1p |         |         |         |         |         | 100     |

FIG. 35

| Fatty acid | Carbons | Diacids produced in Pox4+, Pox5+ background |  |  |
|------------|---------|---------------|---------------|------------------|
|            |         | Eci- product  | Dcr- product  | Eci-, Dcr- product |
| Oleic      | C18:1   | C6:1          | none          | C6:1             |
| Linoleic   | C18:2   | C10:2         | C8:3          | C10:3            |
| Linolenic  | C18:3   | C12:3         | C8:3          | C12:3            |
| Eicosenoic | C20:1   | C6:1          | none          | C6:1             |
| Erucic     | C22:1   | C6:1          | none          | C6:1             |

FIG. 36

|                  | Ct XP_002545283 | CvDcr1p | Ct XP_002550344 | CvDcr2p | ScSps19p | Yl XP_501382 | Yl XP_503937 | Yl XP_502296 |
|------------------|-----------------|---------|-----------------|---------|----------|--------------|--------------|--------------|
| Ct XP_002545283  | 100             | 91      | 78              | 76      | 59       | 66           | 64           | 61           |
| CvDcr1p          |                 | 100     | 75              | 75      | 59       | 67           | 65           | 61           |
| Ct XP_002550344  |                 |         | 100             | 92      | 62       | 65           | 63           | 58           |
| CvDcr2p          |                 |         |                 | 100     | 62       | 66           | 64           | 58           |
| ScSps19p         |                 |         |                 |         | 100      | 60           | 56           | 54           |
| Yl XP_501382     |                 |         |                 |         |          | 100          | 77           | 63           |
| Yl XP_503937     |                 |         |                 |         |          |              | 100          | 60           |
| Yl XP_502296     |                 |         |                 |         |          |              |              | 100          |

FIG. 37

|         | CtDcr1p | CvDcr1p | CtDcr2p | CvDcr2p | ScSps19p | YlDcr1p | YlDcr2p | YlDcr3p |
|---------|---------|---------|---------|---------|----------|---------|---------|---------|
| CtDcr1p | 100     | 91      | 78      | 76      | 59       | 66      | 64      | 61      |
| CvDcr1p |         | 100     | 75      | 75      | 59       | 67      | 65      | 61      |
| CtDcr2p |         |         | 100     | 92      | 62       | 65      | 63      | 58      |
| CvDcr2p |         |         |         | 100     | 62       | 66      | 64      | 58      |
| ScSps19p|         |         |         |         | 100      | 60      | 56      | 54      |
| YlDcr1p |         |         |         |         |          | 100     | 77      | 63      |
| YlDcr2p |         |         |         |         |          |         | 100     | 60      |
| YlDcr3p |         |         |         |         |          |         |         | 100     |

|         | CtDci1p | CvDci1p | MmDci1p | RnDci1p | ScDci1p |
|---------|---------|---------|---------|---------|---------|
| CtDci1p |         | 83      | 27      | 27      | 13      |
| CvDci1p |         |         | 28      | 28      | 13      |
| MmDci1p |         |         |         | 94      | 14      |
| RnDci1p |         |         |         |         | 14      |
| ScDci1p |         |         |         |         |         |

FIG. 41– Activity of Heterologous Acyl CoA Oxidases

| E. coli Strain number | Description | C6 | C8 | C10 | C12 | C14 | C16 | C18:1 |
|---|---|---|---|---|---|---|---|---|
| 1570 | *Aspergillus nidulans* (An)AOXa in pET26b | | | | | | | |
| 1557 | AnAOXa (N-term. GST fusion) in pET26b | | | | | | | |
| 1573 | *Arabidopsis thaliana* (At)ACX2L (N-term. GST fusion) in pET26b | | | | | | | |
| 1514 | AtACX2L in pGEX | | | | | | | |
| 1503 | AtACX2L in pET26b | | | | | | | |
| 1508 | AtACX2L (N-term. GST fusion) in pET26b | | | | | | | |
| 1510 | AtACX1 in pET26b | | | | | | | |
| 1511 | AtACX3 in pET26b | | | | | | | |
| 1366 | AtACX2S in pET26b | | | | | | | |
| 1507 | AtACX2S (N-term. GST fusion) in pET26b | | | | | | | |
| 1525 | AtACX2S (N-term. GST fusion) in pET26b | | | | | | | |
| 1663 | AtACX2 N terminus-Pox5 C-terminus fusion in pET26b | | | | | | | |
| 1369 | AtACX5 in pET26b | | | | | | | |
| 1362 | Candida strain ATCC20336 Pox5 in pET26b | | | | | | | |
| 1888 | Candida strain ATCC20336 Pox4 in pET26b | | | | | | | |

FIG. 41 (CONT.)

| E. coli Strain number | Description | C6 | C8 | C10 | C12 | C14 | C16 | C18:1 |
|---|---|---|---|---|---|---|---|---|
| 1365 | *Debaryomyces hansenii* (Dh)7248p in pET26b | | | | | | | |
| 1572 | *Glycine max* (Gm)Aco2 pET26b | | | | | | | |
| 1558 | GmAco2 (N-term. GST fusion) in pET26b | | | | | | | |
| 1515 | GmAco2 in pGEX | | | | | | | |
| 1367 | *Pichia stipitis* (Ps)Acox2 in pET26b | | | | | | | |
| 1504 | *Rattus norvegicus* (Rn)Aco1 in pET26b | | | | | | | |
| 1505 | RnAco1b in pET26b | | | | | | | |
| 1574 | RnAco1 (N-term. GST fusion) in pET26b | | | | | | | |
| 1575 | RnAco1b (N-term. GST fusion) in pET26b | | | | | | | |
| 1501 | *Yarrowia lipolytica* (Yl)Aco1 in pET26b | | | | | | | |
| 1361 | YlAco2 in pET26b | | | | | | | |
| 1502 | YlAco3 in pET26b | | | | | | | |
| 1499 | YlAco4 in pET26b | | | | | | | |
| 1509 | YlAco4 (N-term. GST fusion) in pET26b | | | | | | | |
| 1500 | YlAco5 in pET26b | | | | | | | |
| 1368 | YlAco6 in pET26b | | | | | | | |
| 1363 | *Zea mays* (Zm)Aco1 in pET26b | | | | | | | |
| 1552 | ZmAco2 in pET26b | | | | | | | |
| 1555 | ZmAco2 (N-term. GST fusion) in | | | | | | | |

FIG. 41 (CONT.)

| E. coli Strain number | Description | C6 | C8 | C10 | C12 | C14 | C16 | C18:1 |
|---|---|---|---|---|---|---|---|---|
| | pET26b | | | | | | | |
| 1364 | ZmAco4 pET26b | | | | | | | |
| 1506 | ZmAco4 (N-term. GST fusion) in pET26b | | | | | | | |
| 1795 | *Cucumis sativus* Aco in pET26b | | | | | | | |
| 1775 | *Arthrobacter ureafaciens* Aco in pET26b | | | | | | | |
| 1776 | *Salinobacter ruber* Aco in pET26b | | | | | | | |
| 1777 | *Thermobifida fusca* Aco in pET26b | | | | | | | |

FIG. 42A

Pox5

| MUTANT | POSITION | AMINO ACID(S) | MUTATION |
|---|---|---|---|
| A | 81, 82 | DQ | AA |
| B | 86, 88 | RLS | ALA |
| C | 93, 94 | FD | AA |
| D | 291, 292 | DS | AA |
| E | 95, 96 | PQ | AA |
| F | 294, 295 | RM | AA |
| G | 287 | T | A |
| H | 290, 291 | MD | AA |
| I | 284/436 | GE | EG |
| J | 291 | D | G |
| K | 292 | S | A |
| L | 93 | F | A |
| M | 94 | D | G |
| CT1 | 102 | G | D |
| N | 86 | R | A |
| O | 88 | S | A |
| P | 98 | F | G |
| Q | 83, 85 | QAQ | AAA |
| CT2 | 453-463 | DLLKEPEQKGL (SEQ ID NO: 3891) | QVISIEDAGKTVRGSTAFLNQLKDYTGSNSSKV (SEQ ID NO: 3890) |

FIG. 42B

Pox4

| MUTANT | POSITION | AMINO ACID(S) | MUTATION |
|---|---|---|---|
| A | 98, 99, 100 | FNK | AAA |
| B | 102, 103 | LS | AA |
| C | 96 | D | A |
| D | 90 | R | A |
| E | 88 | R | A |
| F | 302 | M | A |
| G | 309, 310 | RM | A |
| H | 98 | F | A |
| I | 99 | N | A |
| J | 100 | K | A |
| K | 102 | L | A |
| L | 103 | S | A |
| CT3 | 473-505 | QVISIEDAGKTVRGSTAFLNQLKDYTGSNSSKV (SEQ ID NO: 3890) | DLLKEPEQKGL (SEQ ID NO: 3891) |

FIG. 43

*Pox5 (Candida strain ATCC20336)*

| Mutant Name | Position | Native Amino Acid(s) | Introduced Mutation | Primer | Primer Sequence (5'-3') (SEQ ID NOS 3945-3952, respectively, in order of appearance) | Restriction Sites |
|---|---|---|---|---|---|---|
| M | | | | PRIMER A | GTTCACTGCCATATGCCTACCGA ACTTCAAAAAGAAAGAGAACTC | NdeI |
| M | 94 | D | G | PRIMER B | GGTGAAGACTTGTGGGCCAAAG ACACCGAGGATC | |
| M | 94 | D | G | PRIMER C | GATCCTCGGTGTCTTTGGCCCAC AAGTCTTCACC | |
| M | | | | PRIMER D | CTTCGAGATGCGGCCGCTTAACT GGACAAGATTTCAGCAGCTTCTT CG | NotI |
| CT1* | | | | PRIMER A | CACACAAGGGGAATTGTGAGCG GATAAC | XbaI |
| CT1* | 102 | G | D | PRIMER B | AACCCAAGTTGACGTCGATTCTG G | |
| CT1* | 102 | G | D | PRIMER C | CCAGAATCGACGTCAACTTGGGT T | |
| CT1* | | | | PRIMER D | CACACAAACTGGATCCAACCGTT ATCG | BamHI |

* Mutant CT1 produces a smaller fragment that is used to replace the sequence in between the XbaI and BamHI sites of wild type Pox5 cloned into pET26b.

FIG. 44

*In vitro Activity Assay for Pox4 Mutants*

| Mutant Name | SDM Candida strain ATCC20336 Pox4 Mutants (all in pET26b) | C6 | C8 | C10 | C12 | C14 | C16 | C18:1 |
|---|---|---|---|---|---|---|---|---|
| WT | Pox4 WT | | | | | | | |
| B | Pox4 with L102A, S103A | | | | | | | |
| A | Pox4 with F98A, N99A, K100A | | | | | | | |
| C | Pox4 with D96A | | | | | | | |
| C* | Pox4 with D96A, L692S | | | | | | | |
| D | Pox4 with R90A | | | | | | | |
| E | Pox4 with R88A | | | | | | | |
| F | Pox4 with M302A | | | | | | | |
| G | Pox4 with R309A, M310A | | | | | | | |

* Indicates a secondary mutation (I692S) that occurred during PCR for cloning Candida strain ATCC20336 POX5

*In vitro Activity Assay for Pox5 Mutants*

| Mutant Name | SDM Candida strain ATCC20336 Pox5 Mutants (all in pET26b) | C6 | C8 | C10 | C12 | C14 | C16 | C18:1 |
|---|---|---|---|---|---|---|---|---|
| WT | Pox5 WT | | | | | | | |
| A | Pox5 with D81A, Q82A | | | | | | | |
| B | Pox5 with R86A, S88A | | | | | | | | 
| C | Pox5 with F93A, D94A | | | | | | | |
| D | Pox5 with D291A, S292A | | | | | | | |
| G | Pox5 with T287A | | | | | | | |
| H | Pox5 with M290A, D291A | | | | | | | |
| E | Pox5 with PQ95AA | | | | | | | |
| F | Pox5 with R294A, M295A | | | | | | | |
| J | Pox5 with D291G | | | | | | | |
| K | Pox5 with S292A | | | | | | | |
| L | Pox5 with F93A | | | | | | | |
| M | Pox5 with D94G | | | | | | | |

*Acyl-CoA dehydrogenase-based mutagenesis*

US 9,850,493 B2

BIOLOGICAL METHODS FOR PREPARING A FATTY DICARBOXYLIC ACID

CROSS REFERENCE TO RELATED APPLICATIONS

The application is a U.S. National Stage Entry of PCT/US2013/076739, filed Dec. 19, 2013, which claims priority to U.S. Provisional Patent Application No. 61/739,661, filed Dec. 19, 2012; all of which are herein incorporated by reference in their entireties.

SEQUENCE LISTING

The instant application contains a Sequence Listing which has been submitted electronically in ASCII format and is hereby incorporated by reference in its entirety. Said ASCII copy, created on Mar. 24, 2017, is named 32188-708_831_SL.TXT and is 19,898,273 bytes in size.

FIELD

The technology relates in part to biological methods for producing a fatty dicarboxylic acid and engineered microorganisms capable of such production.

BACKGROUND

Microorganisms employ various enzyme-driven biological pathways to support their own metabolism and growth. A cell synthesizes native proteins, including enzymes, in vivo from deoxyribonucleic acid (DNA). DNA first is transcribed into a complementary ribonucleic acid (RNA) that comprises a ribonucleotide sequence encoding the protein. RNA then directs translation of the encoded protein by interaction with various cellular components, such as ribosomes. The resulting enzymes participate as biological catalysts in pathways involved in production of molecules by the organism.

These pathways can be exploited for the harvesting of the naturally produced products. The pathways also can be altered to increase production or to produce different products that may be commercially valuable. Advances in recombinant molecular biology methodology allow researchers to isolate DNA from one organism and insert it into another organism, thus altering the cellular synthesis of enzymes or other proteins. Advances in recombinant molecular biology methodology also allow endogenous genes, carried in the genomic DNA of a microorganism, to be increased in copy number, thus altering the cellular synthesis of enzymes or other proteins. Such genetic engineering can change the biological pathways within the host organism, causing it to produce a desired product. Micro-organic industrial production can minimize the use of caustic chemicals and the production of toxic byproducts, thus providing a "clean" source for certain compounds. The use of appropriate plant derived feedstocks allows production of "green" compounds while further minimizing the need for and use of petroleum derived compounds.

SUMMARY

Provided in certain aspects is a genetically modified yeast comprising (i) an active, modified endogenous acyl-coA oxidase polypeptide or an active, modified endogenous acyl-coA dehydrogenase polypeptide; (ii) a genetic modification that alters an enoyl co-A isomerase activity; and (iii) a genetic modification that alters a dienoyl CoA reductase (DCR) activity, wherein the yeast is capable of producing a diacid from a feedstock comprising one or more components from a vegetable oil. Also provided in some aspects is a method for using such a genetically modified yeast to produce a diacid from a feedstock comprising one or more components from a vegetable oil.

Also provided in certain aspects is a method for producing a diacid, comprising: (a) contacting a genetically modified yeast of any of embodiments A1 to A44, B1 to B33, C1 to C15 and G1 to G65 with a feedstock comprising an unsaturated vegetable fatty acid capable of being converted by the yeast to a diacid; (b) culturing the yeast under conditions in which diacid containing one or more unsaturations is produced from the feedstock; and (c) hydrogenating and removing one or more of the unsaturations.

Certain embodiments are described further in the following description, examples, claims and drawings.

BRIEF DESCRIPTION OF THE DRAWINGS

The drawings illustrate embodiments of the technology and are not limiting. For clarity and ease of illustration, the drawings are not made to scale and, in some instances, various aspects may be shown exaggerated or enlarged to facilitate an understanding of particular embodiments.

FIG. 23—shows a sequence alignment of the N-terminal 180 amino acids of AcoI (SEQ ID NO: 4076) and AcoII (SEQ ID NO: 4075). The amino acids highlighted in grey are located within alpha helices and those in bold are located within beta sheets. The center sequence represents the consensus sequence showing conserved residues.

FIG. 24—illustrates a HotSpot Wizard analysis of Pox4 (FIG. 24A) (SEQ ID NO: 4077) and Pox5 (FIG. 24B) (SEQ ID NO: 4078) from *Candida* strain ATCC20336. Residues highlighted in dark grey or light grey are mutagenic "hot spots". Dark grey residues show greater variability at that position than light grey residues. Residues in bold are found within or close to the substrate binding pocket.

Figure 30A:
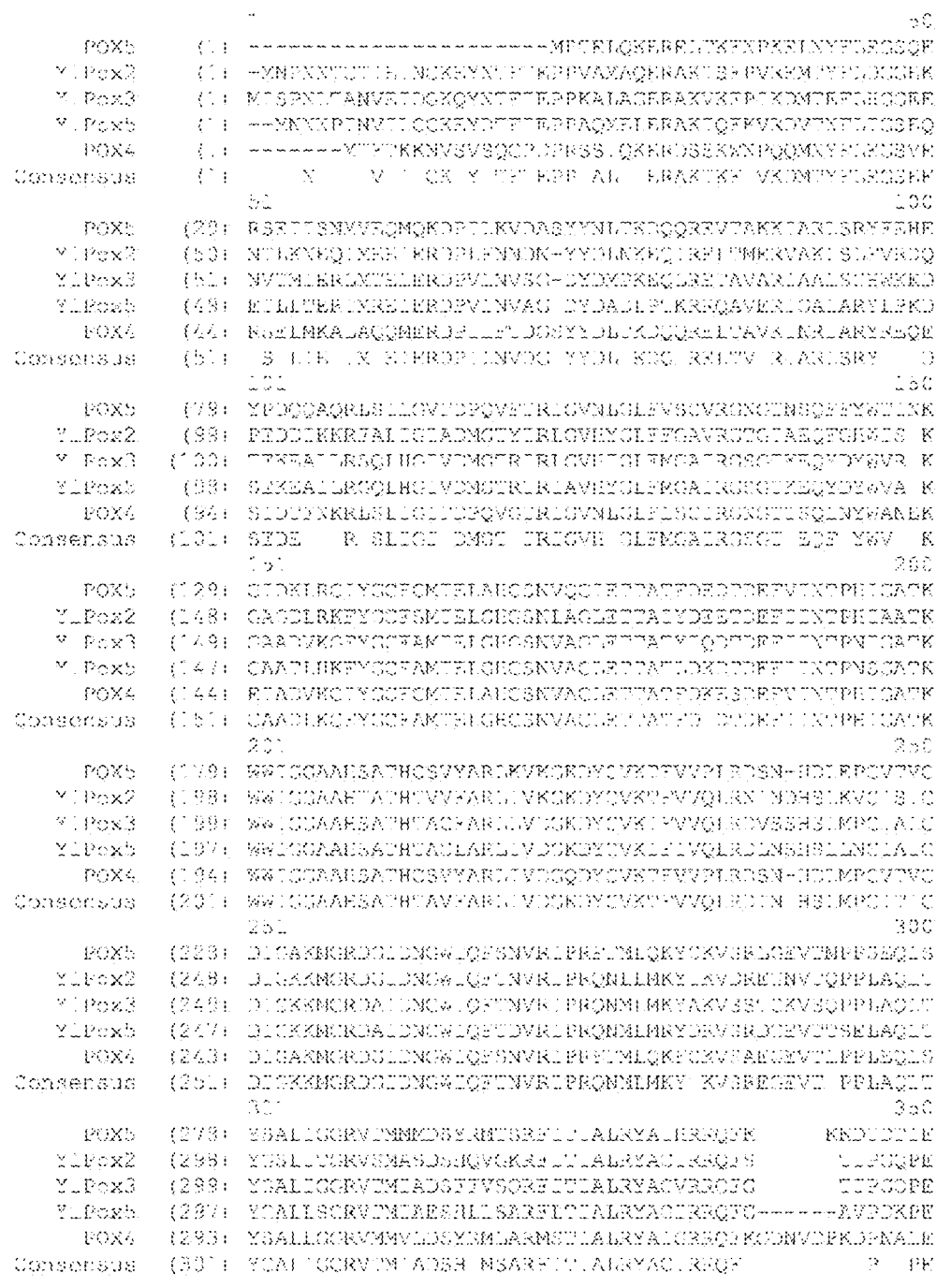
Figure 30B:
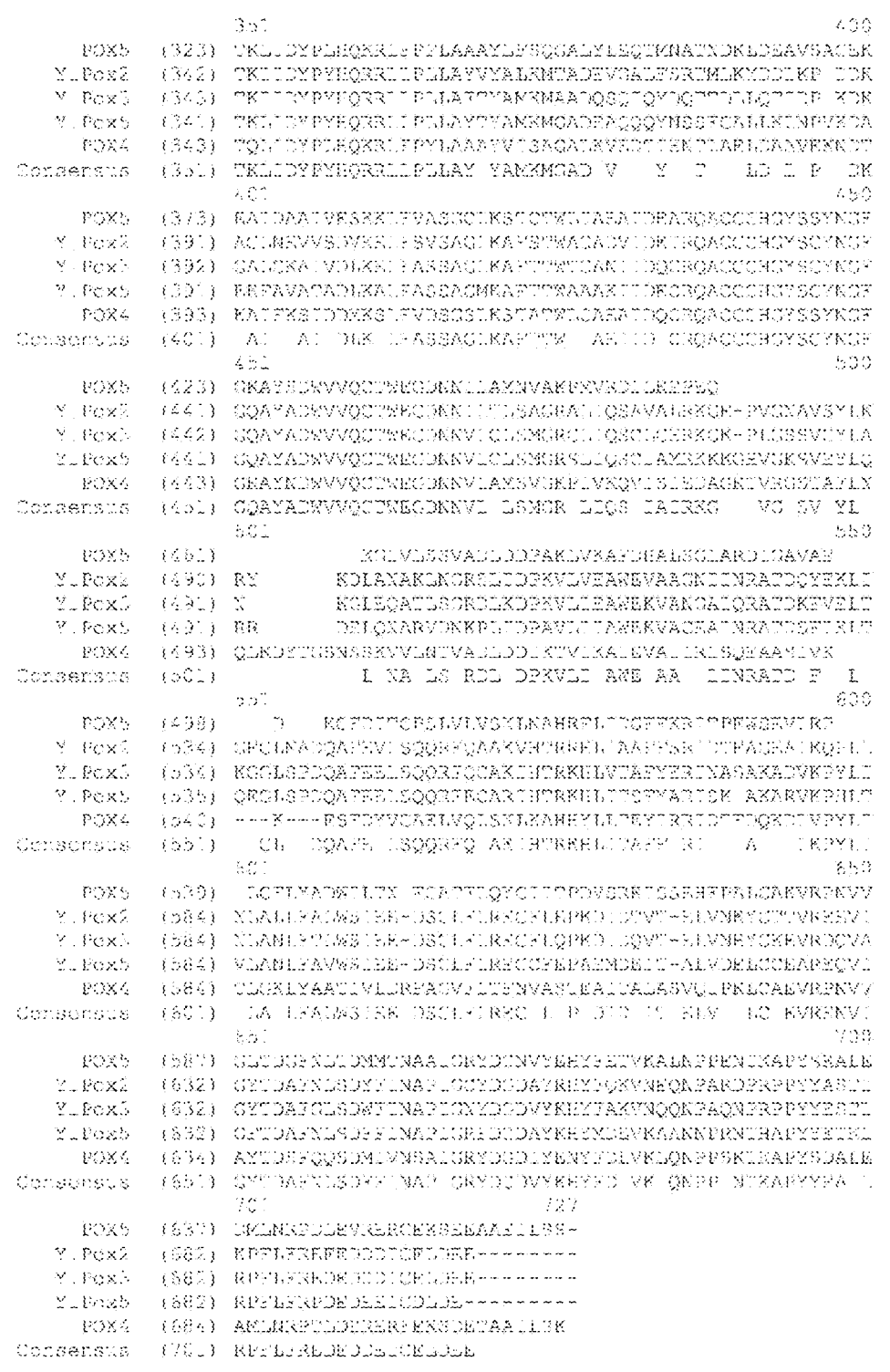

FIG. 30A and FIG. 30B show an amino acid alignment of selected Acyl Co-A enzymes from *Candida viswanathii* (POX4 (SEQ ID NO: 4078) and POX5 (SEQ ID NO: 4077)) and *Yarrowia lipolytica* (Yl POX2 (SEQ ID NO: 4080), Yl POX3 (SEQ ID NO: 4081) and Yl POX5 (SEQ ID NO: 4082)). Also shown is a consensus sequence alignment.

FIG. 31 shows the synthesis of sebacic acid from linoleic acid.

FIG. 35 is a table showing the percent amino acid sequence identities of two ECI enzymes from *Candida viswanathii* (Cv), two ECI enzymes from *Candida tropicalis* (Ct), one ECI enzyme from *Yarrowia lipolytica* (Yl), and one ECI enzyme from *Saccharomyces cerevisiae* (Sc).

FIG. 36 is a table of diacid products that may be produced from unsaturated fatty acids using a strain comprising a deletion in ECI and/or DCR FIG. 37 is a table of the percent identities of some DCR enzymes.

FIG. 41 shows the functionality of several enzymes when expressed in *E. coli*.

FIG. 42A and FIG. 42B show a summary of *Candida* strain ATCC20336 Pox5 and Pox4 mutations.

FIG. 43 shows primers used for site directed mutagenesis for Pox5 (*Candida* strain ATCC20336).

FIG. 44 shows the acyl CoA oxidase activity profile associated with Pox4 mutants.

DETAILED DESCRIPTION

Figure 1:
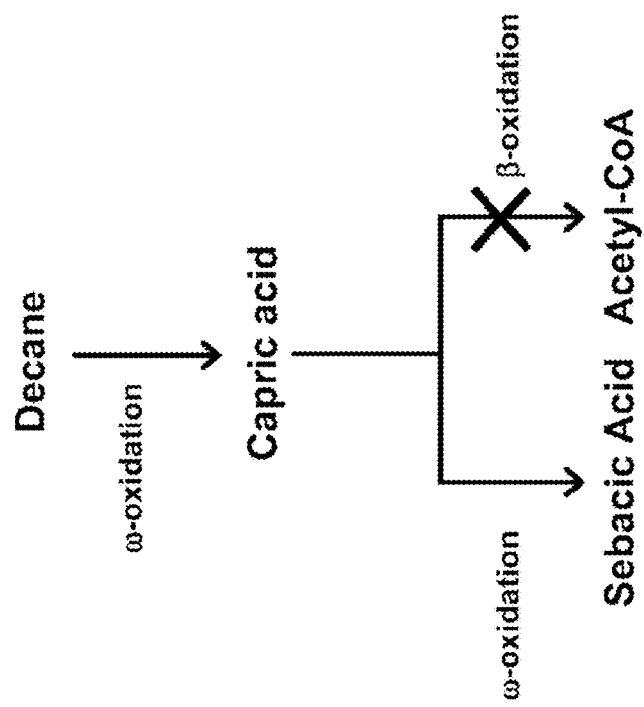
FIG. 1 is a schematic representation of the conversion of decane to sebacic acid in a beta-oxidation blocked microorganism. Capric acid is formed as an intermediate during omega oxidation.

Certain fatty dicarboxylic acids (i.e., diacids, e.g., dodecanedioic acid or sebacic acid) are chemical intermediates in manufacturing processes used to make certain polyamides, polyurethanes and plasticizers, all of which have wide applications in producing items such as antiseptics, top-grade coatings, hot-melt coating and adhesives, painting materials, corrosion inhibitor, surfactant, engineering plastics and can also be used as a starting material in the manufacture of fragrances, for example. For example dodecanedioic acid, also known as 1,12 dodecanedioic acid, and DDDA, is a 12 carbon organic molecule that is a fatty dicarboxylic acid. In another example, sebacic acid, also known as 1,10 decanedioic acid, and 1,8 octanedicarboxylic acid, is a 10 carbon organic molecule that is a fatty dicarboxylic acid.

Provided herein are methods for producing a fatty dicarboxylic acid (also referred to herein as a diacid). Any suitable diacid can be produced, and a diacid produced often includes acid moieties at each terminus of the molecule (e.g., alpha omega diacids). A diacid sometimes is a C4 to a C24 diacid (i.e., a diacid containing 4 carbons to 24 carbons) and sometimes is a C8, C10, C12, C14, C16, C18, or C20 diacid. Yeast and processes herein are capable of producing a diacid containing an odd number of carbons, and sometimes a product contains one or more diacids chosen from a C5, C7, C9, C11, C13, C15, C17, C19, C21 and C23 diacid. A hydrocarbon portion of a diacid sometimes is fully saturated and sometimes a diacid includes one or more unsaturations (e.g., double bonds).

Non-limiting examples of diacids include octadecanedioic acid, decanedioic acid, dodecanedioic acid, tetradecanedioic acid, hexadecanedioic acid, octadecanedioic acid, eicosanedioic acid) and other organic intermediates using biological systems. Non-limiting examples of fatty dicarboxylic acids include suberic acid (i.e., octanedioic acid, 1,8-octanedioic acid, octanedioic acid, octane-1,8-dioic acid, 1,6-hexanedicarboxylic acid, capryllic diacids), sebacic acid (i.e., 1,10-decanedioic acid, decanedioic acid, decane-1,10-dioic acid, 1,8-octanedicarboxylic acid, capric diacid), dodecanedioic acid (i.e., DDDA, 1,12-dodecanedioic acid, dodecanedioic acid, dodecane-1,12-dioic acid, 1,10-decanedicarboxylic acid, decamethylenedicaboxylic acid, 1,10-dicarboxydecane, lauric diacid), tetradecanedioic acid (i.e., TDDA, 1,14-tetradecanedioic acid, tetradecanedioic acid, tetradecane-1,14-dioic acid, 1,12-dodecanedicarboxylic acid, myristic diacid), thapsic acid (i.e., hexadecanedioic acid, 1,16-hexadecanedioic acid, hexadecanedioic acid, hexadecane-1,16-dioic acid, 1,14-tetradecanedicarboxylic acid, palmitic diacid), cis-9-hexadecenedioic acid (i.e., palmitoleic diacids), octanedioic acid (i.e., 1,18-octadecanedioic acid, octadecanedioic acid, octadecane-1,18-dioic acid, 1,16-hexadecanedicarboxylic acid, stearic diacid), cis-9-octadecenedioic acid (i.e., oleic diacids), cis-9,12-octadecenedioic acid (i.e., linoleic diacids), cis-9,12,15-octadecenedioic acid (i.e., linolenic diacids), arachidic diacid (i.e., eicosanoic diacid, icosanoic diacid), 11-eicosenoic diacid (i.e., cis-11-eicosenedioic acid), 13-eicosenoic diacids (i.e., cis-13-eicosenedioic acid), arachidonic diacid (i.e., cis-5,8,11,14-eicosatetraenedioic acid).

A genetically modified yeast can be provided with a feedstock to produce a diacid, and the feedstock sometimes includes a substantially pure aliphatic molecule from which the diacid is produced. In certain embodiments, the feedstock contains a mixed set of aliphatic molecules from which diacids may be produced. In some embodiments, an aliphatic molecule in the feedstock is the predominant aliphatic species and sometimes a particular diacid produced from that aliphatic molecule is the predominant diacid species produced. A predominant species generally is 51% or more by weight of aliphatic molecule species in a feedstock or 51% or more by weight of diacid species in a product (e.g., about 55% or more, 60% or more, 65% or more, 70% or more, 75% or more, 80% or more, 85% or more, 90% or more or 95% or more).

Such production systems may have significantly less environmental impact and could be economically competitive with current manufacturing systems. Thus, provided in part herein are methods for manufacturing a fatty dicarboxylic acid (e.g., octanedioic acid, decanedioic acid, dodecanedioic acid, tetradecanedioic acid, hexadecanedioic acid, octadecanedioic acid, eicosanedioic acid) by engineered microorganisms. In some embodiments microorganisms are engineered to contain at least one heterologous gene encoding an enzyme, where the enzyme is a member of a novel and/or altered pathway engineered into the microorganism. In certain embodiments, an organism may be selected for elevated activity of a native enzyme.

Microorganisms

A microorganism selected often is suitable for genetic manipulation and often can be cultured at cell densities useful for industrial production of a target fatty dicarboxylic acid product. A microorganism selected often can be maintained in a fermentation device.

The term "engineered microorganism" as used herein refers to a modified microorganism that includes one or more activities distinct from an activity present in a microorganism utilized as a starting point (hereafter a "host microorganism"). An engineered microorganism includes a heterologous polynucleotide in some embodiments, and in certain embodiments, an engineered organism has been subjected to selective conditions that alter an activity, or introduce an activity, relative to the host microorganism. Thus, an engineered microorganism has been altered directly or indirectly by a human being. A host microorganism sometimes is a native microorganism, and at times is a microorganism that has been engineered to a certain point.

In some embodiments an engineered microorganism is a single cell organism, often capable of dividing and proliferating. A microorganism can include one or more of the following features: aerobe, anaerobe, filamentous, non-filamentous, monoploid, dipoid, auxotrophic and/or non-auxotrophic. In certain embodiments, an engineered microorganism is a prokaryotic microorganism (e.g., bacterium), and in certain embodiments, an engineered microorganism is a non-prokaryotic microorganism. In some embodiments, an engineered microorganism is a eukaryotic microorganism (e.g., yeast, fungi, amoeba). In some embodiments, an engineered microorganism is a fungus. In some embodiments, an engineered organism is a yeast.

Any suitable yeast may be selected as a host microorganism, engineered microorganism, genetically modified organism or source for a heterologous or modified polynucleotide. Yeast include, but are not limited to, *Yarrowia* yeast (e.g., *Y. lipolytica* (formerly classified as *Candida lipolytica*)), *Candida* yeast (e.g., *C. revkaufi, C. viswanathii, C. pulcherrima, C. tropicalis, C. utilis*), *Rhodotorula* yeast (e.g., *R. glutinus, R. graminis*), *Rhodosporidium* yeast (e.g., *R. toruloides*), *Saccharomyces* yeast (e.g., *S. cerevisiae, S. bayanus, S. pastorianus, S. carlsbergensis*), *Cryptococcus* yeast, *Trichosporon* yeast (e.g., *T. pullans, T. cutaneum*), *Pichia* yeast (e.g., *P. pastoris*) and *Lipomyces* yeast (e.g., *L. starkeyii, L. lipoferus*). In some embodiments, a suitable yeast is of the genus *Arachniotus, Aspergillus, Aureobasidium, Auxarthron, Blastomyces, Candida, Chrysosporuim, Chrysosporuim Debaryomyces, Coccidiodes, Cryptococcus, Gymnoascus, Hansenula, Histoplasma, Issatchenkia, Kluyveromyces, Lipomyces, Lssatchenkia, Microsporum, Myxotrichum, Myxozyma, Oidiodendron, Pachysolen, Penicillium, Pichia, Rhodosporidium, Rhodotorula, Rhodotorula, Saccharomyces, Schizosaccharomyces, Scopulariopsis, Sepedonium, Trichosporon*, or *Yarrowia*. In some embodiments, a suitable yeast is of the species *Arachniotus flavoluteus, Aspergillus flavus, Aspergillus fumigatus, Aspergillus niger, Aureobasidium pullulans, Auxarthron thaxteri, Blastomyces dermatitidis, Candida albicans, Candida dubliniensis, Candida famata, Candida glabrata, Candida guilliermondii, Candida kefyr, Candida krusei, Candida lambica, Candida lipolytica, Candida lustitaniae, Candida parapsilosis, Candida pulcherrima, Candida revkaufi, Candida rugosa, Candida tropicalis, Candida utilis, Candida viswanathii, Candida xestobii, Chrysosporuim keratinophilum, Coccidiodes immitis, Cryptococcus albidus* var. *diffluens, Cryptococcus laurentii, Cryptococcus neofomans, Debaryomyces hansenii, Gymnoascus dugwayensis, Hansenula anomala, Histoplasma capsulatum, Issatchenkia occidentalis, Isstachenkia orientalis, Kluyveromyces lactis, Kluyveromyces marxianus, Kluyveromyces thermotolerans, Kluyveromyces waltii, Lipomyces lipoferus, Lipomyces starkeyii, Microsporum gypseum, Myxotrichum deflexum, Oidiodendron echinulatum, Pachysolen tannophilis, Penicillium notatum, Pichia anomala, Pichia pastoris, Pichia stipitis, Rhodosporidium toruloides, Rhodotorula glutinus, Rhodotorula graminis, Saccharomyces cerevisiae, Saccharomyces kluyveri, Schizosaccharomyces pombe, Scopulariopsis acremonium, Sepedonium chrysospermum, Trichosporon cutaneum, Trichosporon pullans, Yarrowia lipolytica*, or *Yarrowia lipolytica* (formerly classified as *Candida lipolytica*). In some embodiments, a yeast is a *Y. lipolytica* strain that includes, but is not limited to, ATCC20362, ATCC8862, ATCC18944, ATCC20228, ATCC76982 and LGAM S(7)1 strains (Papanikolaou S., and Aggelis G., Bioresour. Technol. 82(1):43-9 (2002)). In certain embodiments, a yeast is a *Candida* species (i.e., *Candida* spp.) yeast. Any suitable *Candida* species can be used and/or genetically modified for production of a fatty dicarboxylic acid (e.g., octanedioic acid, decanedioic acid, dodecanedioic acid, tetradecanedioic acid, hexadecanedioic acid, octadecanedioic acid, eicosanedioic acid). In some embodiments, suitable *Candida* species include, but are not limited to *Candida albicans, Candida dubliniensis, Candida famata, Candida glabrata, Candida guilliermondii, Candida kefyr, Candida krusei, Candida lambica, Candida lipolytica, Candida lustitaniae, Candida parapsilosis, Candida pulcherrima, Candida revkaufi, Candida rugosa, Candida tropicalis, Candida utilis, Candida viswanathii, Candida xestobii* and any other *Candida* spp. yeast described herein. Non-limiting examples of *Candida* spp. strains include, but are not limited to, sAA001 (ATCC20336), sAA002 (ATCC20913), sAA003 (ATCC20962), sAA496 (US2012/0077252), sAA106 (US2012/0077252), SU-2 (ura3-/ura3-), H5343 (beta oxidation blocked; U.S. Pat. No. 5,648,247) strains. Any suitable strains from *Candida* spp. yeast may be utilized as parental strains for genetic modification.

Yeast genera, species and strains are often so closely related in genetic content that they can be difficult to distinguish, classify and/or name. In some cases strains of *C. lipolytica* and *Y. lipolytica* can be difficult to distinguish, classify and/or name and can be, in some cases, considered the same organism. In some cases, various strains of *C. tropicalis* and *C. viswanathii* can be difficult to distinguish, classify and/or name (for example see Arie et. al., J. Gen. Appl. Microbiol., 46, 257-262 (2000). Some *C. tropicalis* and *C. viswanathii* strains obtained from ATCC as well as from other commercial or academic sources can be considered equivalent and equally suitable for the embodiments described herein. In some embodiments, some parental strains of *C. tropicalis* and *C. viswanathii* are considered to differ in name only.

Any suitable fungus may be selected as a host microorganism, engineered microorganism or source for a heterologous polynucleotide. Non-limiting examples of fungi include, but are not limited to, *Aspergillus* fungi (e.g., *A. parasiticus, A. nidulans*), Thraustochytrium fungi, Schizochytrium fungi and *Rhizopus* fungi (e.g., *R. arrhizus, R. oryzae, R. nigricans*). In some embodiments, a fungus is an *A. parasiticus* strain that includes, but is not limited to, strain ATCC24690, and in certain embodiments, a fungus is an *A. nidulans* strain that includes, but is not limited to, strain ATCC38163.

My suitable prokaryote may be selected as a host microorganism, engineered microorganism or source for a heterologous polynucleotide. A Gram negative or Gram positive bacteria may be selected. Examples of bacteria include, but are not limited to, *Bacillus* bacteria (e.g., *B. subtilis, B. megaterium*), *Acinetobacter* bacteria, Norcardia baceteria, Xanthobacter bacteria, *Escherichia* bacteria (e.g., *E. coli* (e.g., strains DH10B, Stbl2, DH5-alpha, DB3, DB3.1), DB4, DB5, JDP682 and ccdA-over (e.g., U.S. application Ser. No. 09/518,188))), *Streptomyces* bacteria, *Erwinia* bacteria, *Klebsiella* bacteria, *Serratia* bacteria (e.g., *S. marcessans*), *Pseudomonas* bacteria (e.g., *P. aeruginosa*), *Salmonella* bacteria (e.g., *S. typhimurium, S. typhi*), *Megasphaera* bacteria (e.g., *Megasphaera elsdenii*). Bacteria also include, but are not limited to, photosynthetic bacteria (e.g., green non-sulfur bacteria (e.g., Choroflexus bacteria (e.g., *C. aurantiacus*), Chloronema bacteria (e.g., *C. gigateum*)), green sulfur bacteria (e.g., *Chlorobium* bacteria (e.g., *C. limicola*), Pelodictyon bacteria (e.g., *P. luteolum*), purple sulfur bacteria (e.g., *Chromatium* bacteria (e.g., *C. okenii*)), and purple non-sulfur bacteria (e.g., *Rhodospirillum* bacteria (e.g., *R. rubrum*), *Rhodobacter* bacteria (e.g., *R. sphaeroides, R. capsulatus*), and Rhodomicrobium bacteria (e.g., *R. vanellii*)).

Cells from non-microbial organisms can be utilized as a host microorganism, engineered microorganism or source for a heterologous polynucleotide. Examples of such cells, include, but are not limited to, insect cells (e.g., *Drosophila* (e.g., *D. melanogaster*), *Spodoptera* (e.g., *S. frugiperda* Sf9 or Sf21 cells) and Trichoplusa (e.g., High-Five cells); nematode cells (e.g., *C. elegans* cells); avian cells; amphibian cells (e.g., *Xenopus laevis* cells); reptilian cells; mammalian cells (e.g., NIH3T3, 293, CHO, COS, VERO, C127, BHK, Per-C6, Bowes melanoma and HeLa cells); and plant cells (e.g., *Arabidopsis thaliana, Nicotania tabacum, Cuphea acinifolia, Cuphea aequipetala, Cuphea angustifolia, Cuphea appendiculata, Cuphea avigera, Cuphea avigera* var. *pulcherrima, Cuphea axilliflora, Cuphea bahiensis, Cuphea baillonis, Cuphea brachypoda, Cuphea bustamanta, Cuphea calcarata, Cuphea calophylla, Cuphea calophylla* subsp. *mesostemon, Cuphea carthagenensis, Cuphea circaeoides, Cuphea confertiflora, Cuphea cordata, Cuphea crassiflora, Cuphea cyanea, Cuphea decandra, Cuphea denticulata, Cuphea disperma, Cuphea epilobiifolia, Cuphea ericoides, Cuphea flava, Cuphea flavisetula, Cuphea fuchsiifolia, Cuphea gaumeri, Cuphea glutinosa, Cuphea heterophylla, Cuphea hookeriana, Cuphea hyssopifolia* (Mexican-heather), *Cuphea hyssopoides, Cuphea ignea, Cuphea ingrata, Cuphea jorullensis, Cuphea lanceolata, Cuphea linarioides, Cuphea Ilavea, Cuphea lophostoma, Cuphea lutea, Cuphea lutescens, Cuphea melanium, Cuphea melvilla, Cuphea micrantha, Cuphea micropetala, Cuphea mimuloides, Cuphea nitidula, Cuphea palustris, Cuphea parsonsia, Cuphea pascuorum, Cuphea paucipetala, Cuphea procumbens, Cuphea pseudosilene, Cuphea pseudovaccinium, Cuphea pulchra, Cuphea racemosa, Cuphea repens, Cuphea salicifolia, Cuphea salvadorensis, Cuphea schumannii, Cuphea sessiliflora, Cuphea sessilifolia, Cuphea setosa, Cuphea spectabilis, Cuphea spermacoce, Cuphea splendida, Cuphea splendida* var. *viridiflava, Cuphea strigulosa, Cuphea subuligera, Cuphea teleandra, Cuphea thymoides, Cuphea tolucana, Cuphea urens, Cuphea utriculosa, Cuphea viscosissima, Cuphea watsoniana, Cuphea wrightii, Cuphea lanceolata*)

Microorganisms or cells used as host organisms or source for a heterologous polynucleotide are commercially available. Microorganisms and cells described herein, and other suitable microorganisms and cells are available, for example, from Invitrogen Corporation, (Carlsbad, Calif.), American Type Culture Collection (Manassas, Va.), and Agricultural Research Culture Collection (NRRL; Peoria, Ill.).

Host microorganisms and engineered microorganisms may be provided in any suitable form. For example, such microorganisms may be provided in liquid culture or solid culture (e.g., agar-based medium), which may be a primary culture or may have been passaged (e.g., diluted and cultured) one or more times. Microorganisms also may be provided in frozen form or dry form (e.g., lyophilized). Microorganisms may be provided at any suitable concentration.

Carbon Processing Pathways and Activities

Figure 2:
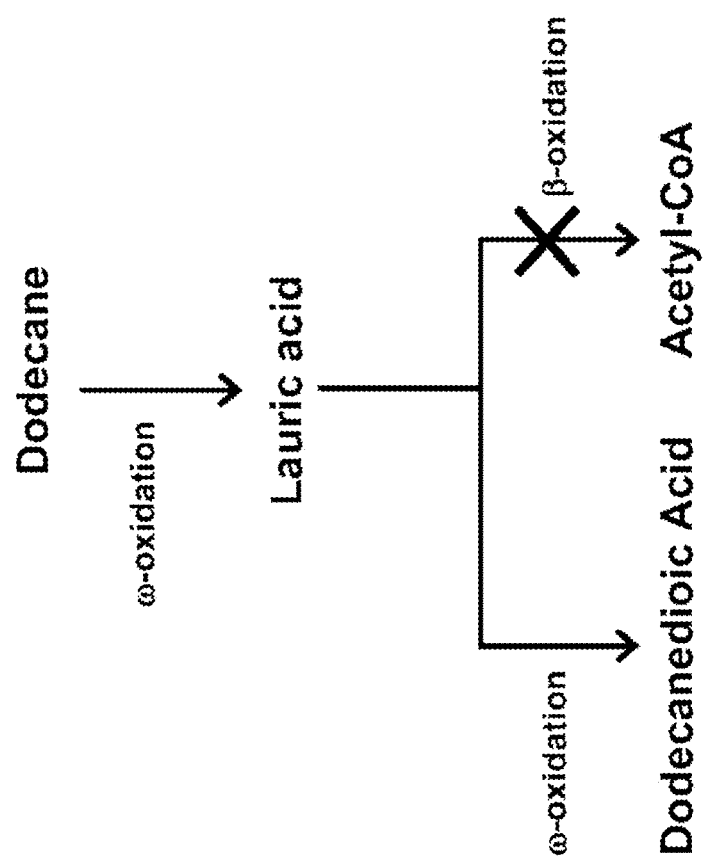
FIG. 2 is a schematic representation of the conversion of dodecane to dodecanedioic acid in a beta-oxidation blocked microorganism. Lauric acid is formed as an intermediate during omega oxidation.
Figure 3:
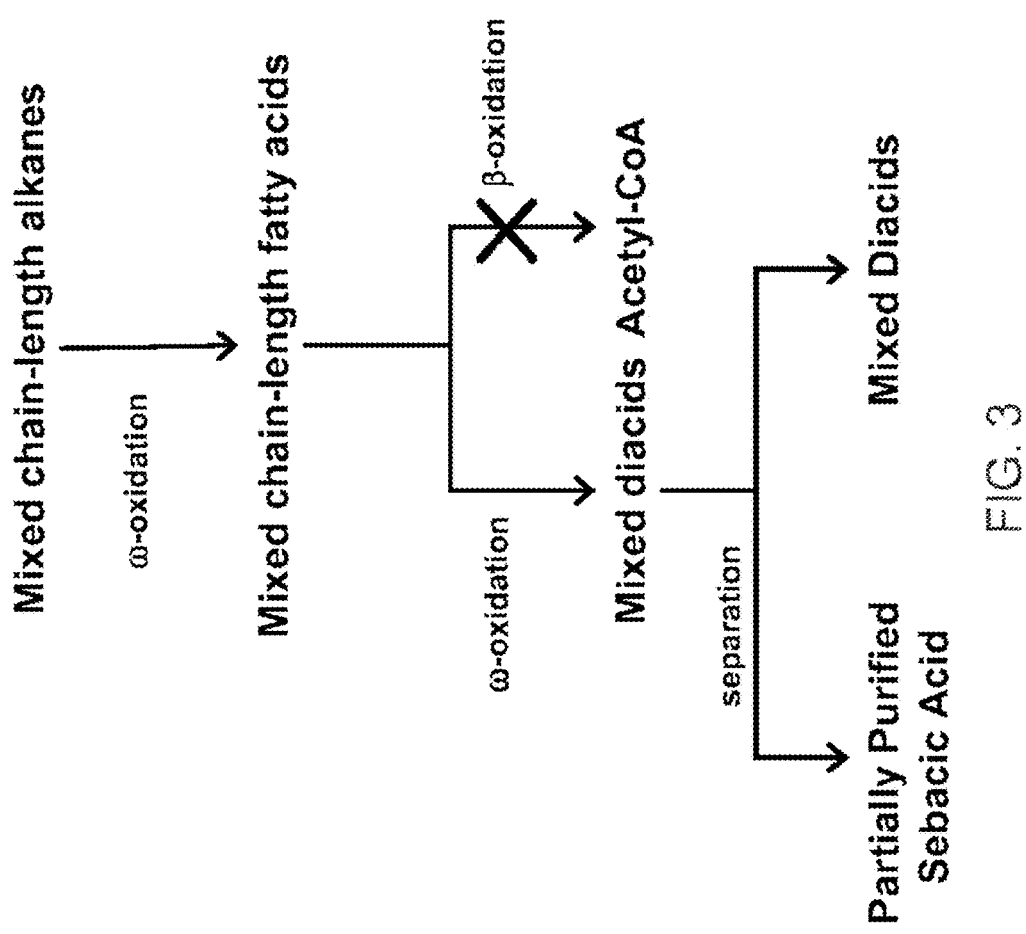
FIG. 3 is a schematic representation of the conversion of a feedstock containing mixed chain-length alkanes to mixed diacids products, including sebacic acid in a beta-oxidation blocked microorganism. Mixed chain-length fatty acids are formed as intermediates during omega oxidation. Sebacic acid can be separated from other diacid products by the use of appropriate separation techniques.
Figure 4:
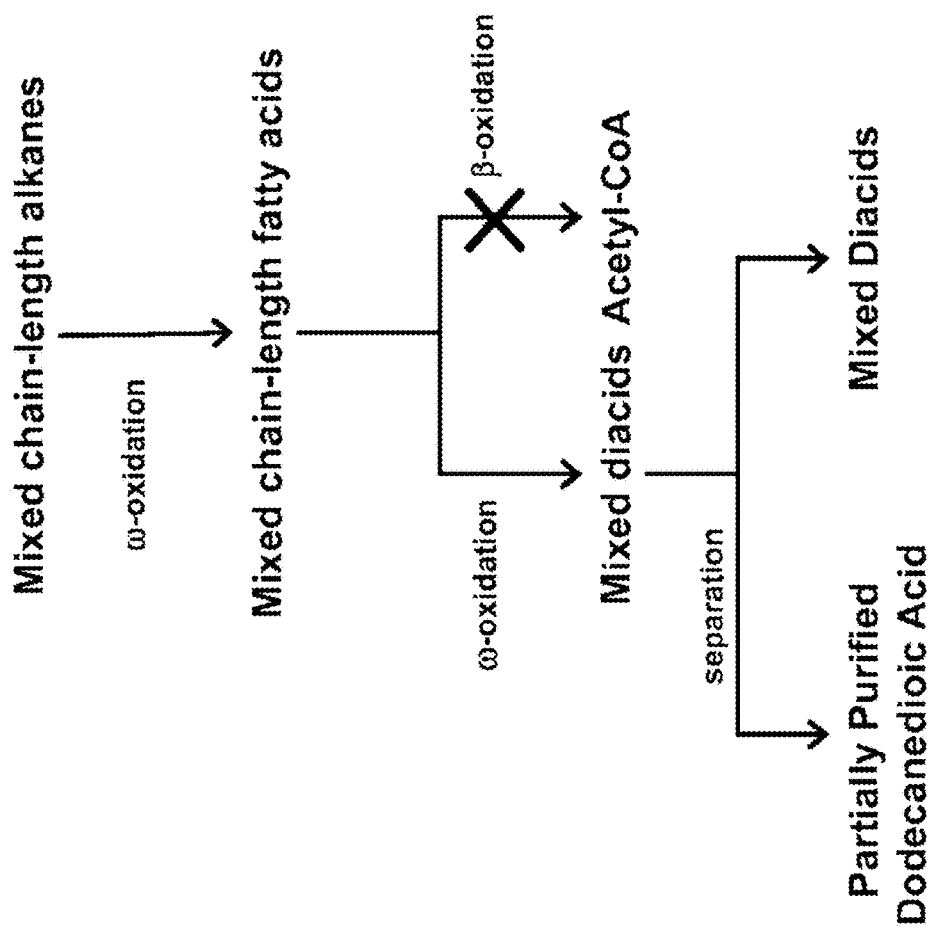
FIG. 4 is a schematic representation of the conversion of a feedstock containing mixed chain-length alkanes to mixed diacids products, including dodecanedioic acid in a beta-oxidation blocked microorganism. Mixed chain-length fatty acids are formed as intermediates during omega oxidation. Dodecanedioic acid can be separated from other diacid products by the use of appropriate separation techniques.
Figure 5:
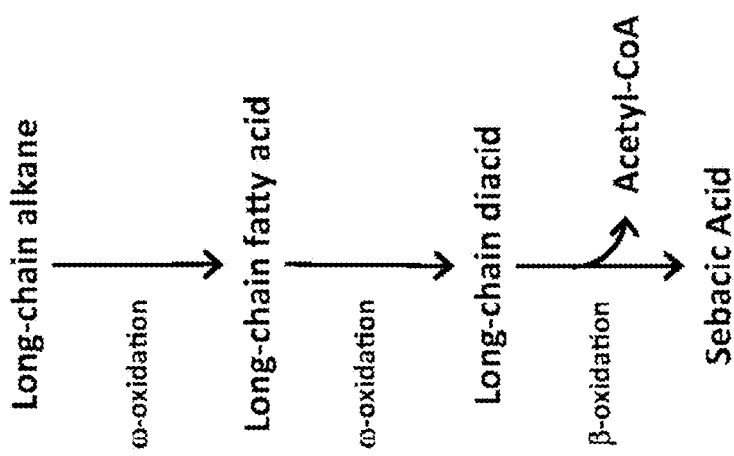
FIG. 5 is a schematic representation of the conversion of a long-chain alkane into sebacic acid in a partially beta-oxidation blocked microorganism. The long-chain alkane is first converted into a long-chain fatty acid and then into a long-chain diacid by activities in the omega-oxidation pathway. The long-chain diacid can be converted to sebacic acid by activities in the beta-oxidation pathway, with the simultaneous generation of acetyl-CoA.
Figure 6:
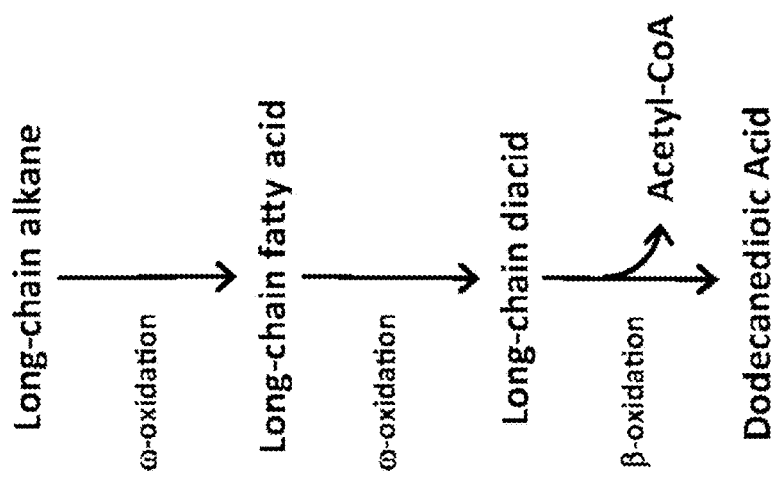
FIG. 6 is a schematic representation of the conversion of a long-chain alkane into dodecanedioic acid in a partially beta-oxidation blocked microorganism. The long-chain alkane is first converted into a long-chain fatty acid and then into a long-chain diacid by activities in the omega-oxidation pathway. The long-chain diacid can be converted to dodecanedioic acid by activities in the beta-oxidation pathway, with the simultaneous generation of acetyl-CoA.
Figure 7:
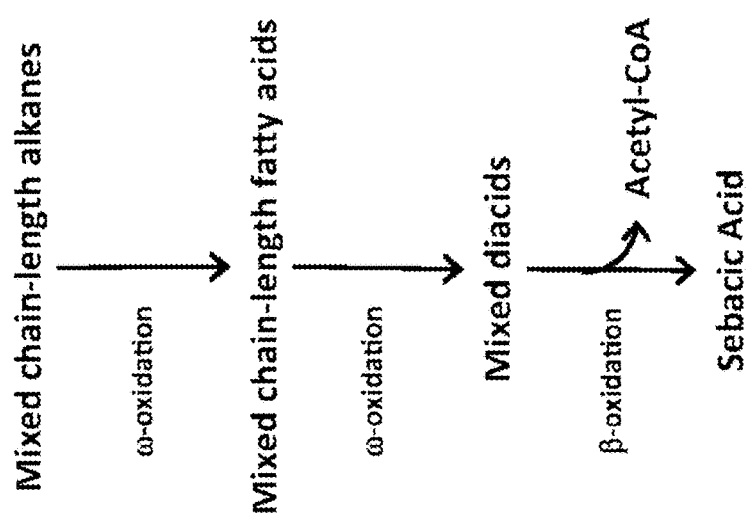
FIG. 7 is a schematic representation of the conversion of a feedstock containing mixed chain-length alkanes into sebacic acid in a partially beta-oxidation blocked microorganism. The mixed chain-length alkanes are first converted into mixed chain-length fatty acids and then mixed diacids by activities in the omega-oxidation pathway. Mixed diacids can be converted to sebacic acid by activities in the beta-oxidation pathway, with the simultaneous generation of acetyl-CoA.
Figure 8:
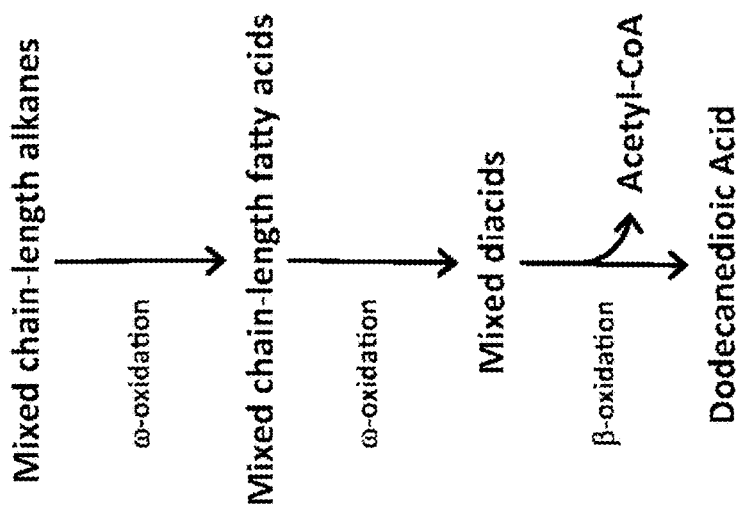
FIG. 8 is a schematic representation of the conversion of a feedstock containing mixed chain-length alkanes into dodecanedioic acid in a partially beta-oxidation blocked microorganism. The mixed chain-length alkanes are first converted into mixed chain-length fatty acids and then mixed diacids by activities in the omega-oxidation pathway. Mixed diacids can be converted to dodecanedioic acid by activities in the beta-oxidation pathway, with the simultaneous generation of acetyl-CoA.

FIGS. 1-8 schematically illustrate non-limiting embodiments of engineered pathways that can be used to produce a fatty dicarboxylic acid (e.g., octanedioic acid, decanedioic acid, dodecanedioic acid, tetradecanedioic acid, hexadecanedioic acid, octadecanedioic acid, eicosanedioic acid) from various starting carbon sources or feedstocks. FIG. 1 depicts an embodiment of a non-limiting engineered biological pathway for producing sebacic acid in microorganisms having a fully blocked beta-oxidation pathway, using decane as the carbon source starting material. FIG. 2 depicts an embodiment of a non-limiting engineered biological pathway for producing dodecanedioic acid in microorganisms having a fully blocked beta-oxidation pathway, using dodecane as the carbon source starting material. FIGS. 3 and 4 depict an embodiment of a non-limiting engineered biological pathway for producing mixed chain-length diacids in a microorganism having a fully blocked beta-oxidation pathway, using mixed chain-length alkanes as the carbon source starting material. Sebacic acid (FIG. 3) and dodecanedioic acid (FIG. 4) can be separated and/or purified away from other diacid products using a suitable combination of centrifugation, organic solvent extraction, chromatography, and/or other purification/separation techniques. FIGS. 5 and 6 depict an embodiment of a non-limiting engineered biological pathway for producing sebacic acid (FIG. 5) and dodecanedioic acid (FIG. 6) in microorganisms having a partially blocked beta oxidation pathway, using long-chain alkanes as the carbon source starting material. FIGS. 7 and 8 depict an embodiment of a non-limiting engineered biological pathway for producing sebacic acid (FIG. 7) and dodecanedioic acid (FIG. 8) in microorganisms having a partially blocked beta oxidation pathway, using mixed-chain length alkanes as the carbon source starting material.

The alkane carbon source starting materials are initially metabolized using naturally occurring and/or engineered activities in naturally occurring and/or engineered pathways to yield an intermediate alcohol which can then be converted to a carboxylic acid (e.g., fatty acid) by the action of other naturally occurring and/or engineered activities in the omega-oxidation pathway depicted in FIGS. 1-8.

Alkanes are omega-hydroxylated by the activity of cytochrome P450 enzymes, thereby generating the equivalent chain-length alcohol derivative of the starting alkane carbon source material. In certain embodiments, a cytochrome P450 activity can be increased by increasing the number of copies of a cytochrome P450 gene (e.g., 2, 3, 4, 5, 6, 7, 8, 9, 10, 15, 20, 25 or more copies of the gene), by increasing the activity of a promoter that regulates transcription of a cytochrome P450 gene, or by increasing the number of copies of a cytochrome P450 gene and increasing the activity of a promoter that regulates transcription of a cytochrome P450 gene, thereby increasing the production of target product (e.g., sebacic or dodecanedioic acid) via increased activity of one or more cytochrome P450 enzymes. In some embodiments, a cytochrome P450 enzyme is endogenous to the host microorganism. One or more cytochrome P450 activities can be added and/or increased dependent on the carbon source starting material, in certain embodiments. Cytochrome P450's sometimes exhibit increased activities in response to stimulation by certain feedstocks or carbon source starting materials. In some embodiments, an engineered microorganism includes an increased number of copies of one or more cytochrome P450s that are stimulated by a chosen carbon source starting material or feedstock. Cytochrome P450 responsiveness to a chosen starting carbon source or feedstock can be determined using any suitable assay. Non-limiting examples of assays suitable for identification of cytochrome P450 responsiveness to a starting carbon source or feedstock include RT-PCR or qRT-PCR after the host microorganism has been exposed to the chosen carbon source or feedstock for varying amounts of time.

Cytochrome P450 is reduced by the activity of cytochrome P450 reductase (CPR), thereby recycling cytochrome P450 to allow further enzymatic activity. In certain embodiments, the CPR enzyme is endogenous to the host microorganism. In some embodiments, host CPR activity can be increased by increasing the number of copies of a CPR gene (e.g., 2, 3, 4, 5, 6, 7, 8, 9, 10, 15, 20, 25 or more copies of the gene), by increasing the activity of a promoter that regulates transcription of a CPR gene, or by increasing the number of copies of a CPR gene and increasing the activity of a promoter that regulates transcription of a CPR gene, thereby increasing the production of target product (e.g., sebacic or dodecanedioic acid) via increased recycling of cytochrome P450. In certain embodiments, the promoter can be a heterologous promoter (e.g., endogenous or exogenous promoter). In some embodiments, the CPR gene is heterologous and exogenous and can be isolated from any suitable organism. Non-limiting examples of organisms from which a CPR gene can be isolated include *C. tropicalis, S. cerevisiae* and *Bacillus megaterium*.

Oxidation of the alcohol to an aldehyde may be performed by an enzyme in the fatty alcohol oxidase family (e.g., long-chain fatty alcohol oxidase EC 1.1.3.20), or an enzyme in the alcohol dehydrogenase family (e.g., fatty alcohol dehydrogenase; EC 1.1.1.1). The aldehyde may be oxidized to a carboxylic acid (e.g., sebacic or dodecanedioic acid) by the activity of the enzyme aldehyde dehydrogenase (e.g., long-chain-aldehyde dehydrogenase or fatty aldehyde dehydrogenase; EC 1.2.1.48). In some embodiments, the long chain fatty alcohol oxidase, fatty alcohol dehydrogenase and/or the long-chain-aldehyde dehydrogenase exist in a host organism. Flux through these two steps may sometimes be augmented by increasing the copy number of the enzymes, or by increasing the activity of the promoter transcribing the genes. In some embodiments alcohol and aldehyde dehydrogenases specific for 10, 12 or 14 carbon substrates may be isolated from another organism, and inserted into the host organism.

FIG. 1 depicts a non-limiting embodiment of an engineered biological pathway for making sebacic acid using decane (e.g., a C10 alkane) as the carbon source starting material. Due to the carbon chain length of decane, no chain shortening is necessary to arrive at the 10 carbon diacid, sebacic acid. Thus a fully beta oxidation blocked microorganism can be utilized to minimize conversion of the desired 10 carbon diacid into diacids having shorter chain lengths.

FIG. 2 depicts a non-limiting embodiment of an engineered biological pathway for making dodecanedioic acid using dodecane (e.g., a C12 alkane) as the carbon source starting material. Due to the carbon chain length of dodecane, no chain shortening is necessary to arrive at the 12 carbon diacid, dodecanedioic acid. Thus a fully beta oxidation blocked microorganism can be utilized to minimize conversion of the desired 12 carbon diacid into diacids having shorter chain lengths.

FIGS. 3 and 4 depict a non-limiting embodiment of an engineered biological pathway for generating a mixed population of diacid (fatty dicarboxylic acid) products, including sebacic acid (FIG. 3) and dodecanedioic acid (FIG. 4), using a carbon source or feedstock that contains mixed-chain-length alkanes as the carbon source starting material. Any suitable mixed-chain-length alkane, fatty alcohol, mixed chain length fatty alcohol feedstock, fatty acid, mixed fatty acid feedstock, paraffin, fat or oil can be used. In some embodiments, the distribution of carbon chain lengths in the starting material is substantially similar to the desired carbon chain length distribution in the mixed diacid product. In certain embodiments, the feedstock is enriched for a desired chain length. In some embodiments, the enriched fraction is enriched for carbon chain lengths of about 10 carbons. In some embodiments, the enriched fraction is enriched for carbon chain lengths of about 12 carbons. Because, in some embodiments, the diacids generated have substantially the same chain lengths as the chain lengths found in the carbon source starting material, a fully beta-oxidation blocked microorganism can be utilized to minimize conversion of the diacids of desired chain length into diacids of shorter chain lengths. The lower part of the pathways in FIG. 3 AND FIG. 4 show the separation of sebacic acid and dodecanedioic acid, respectively, away from the mixed diacid products by the use of separation techniques described herein, or those known in the art.

In certain embodiments involving genetically modified organisms having partially blocked beta-oxidation pathways (see FIGS. 5-8), feedstocks suitable for use include, but are not limited to, fatty acid distillates or soapstocks of renewable oils (palm oil fatty acid distillate, soybean oil soapstock, coconut oil soapstock), renewable oils (coconut oil, palm oil, palm kernel oil, soybean oil, corn oil, etc.), fatty acids of chain length equal to or greater than C10 (in substantially single form (e.g., in substantially pure form) or in mixture form, alkanes of chain length equal to or greater than C10 in substantially single form (e.g., substantially pure form) or in mixture form.

Carbon sources with longer chain lengths (e.g., 12 carbons or greater in length) can be metabolized using naturally occurring and/or engineered pathways to yield molecules that can be further metabolized using the beta oxidation pathway shown in the lower portion of FIGS. 5 through 8. In some embodiments, beta-oxidation activities in the pathways shown in FIGS. 5 through 8 also can be engineered (e.g., as described herein) to enhance metabolism and target product formation. In some embodiments, one acyl-CoA oxidase activity of the beta-oxidation pathway is engineered to be enhanced, and in certain embodiments, the other acyl-CoA oxidase activity in the beta-oxidation pathway is altered to reduce or eliminate the activity, thereby optimizing the production of a diacid of a desired chain-length or diacids with a distribution of desired chain lengths. In some embodiments, an acyl-CoA oxidase is selected and/or engineered to alter the substrate specificity of the enzyme. In certain embodiments, the substrate specificity of a heterologous and/or engineered acyl-CoA oxidase is for carbon chain lengths of between about 12 carbons and about 18 carbons, and in some embodiments a heterologous and/or engineered acyl-CoA oxidase exhibits no activity on substrates below 12 carbons in length. In certain embodiments, a heterologous acyl-CoA oxidase with a desired chain length specificity can be isolated from any suitable organism. Non-limiting examples of organisms that include, or can be used as donors for acyl-CoA oxidase enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*).

In certain embodiments, a carbon source starting material (e.g., alkane, fatty acid, fatty alcohol, dicarboxylic acid) of intermediate or long chain length (e.g., between about 10 carbons and 22 carbons) is converted into an acyl-CoA derivative for entry into the beta-oxidation pathway. The acyl-CoA derivative can be generated by the activity of an acyl-CoA ligase enzyme, in some embodiments. The acyl-CoA derivative is subsequently oxidized by the activity of an acyl-CoA oxidase enzyme (e.g., also known as acyl-CoA oxidoreductase and fatty acyl-coenzyme A oxidase) of natural or altered substrate specificity, in certain embodiments. The trans-2,3-dehydroacyl-CoA derivative long chain fatty alcohol, fatty acid or dicarboxylic acid may be further converted to 3-hydroxyacyl-CoA by the activity of enoyl-CoA hydratase. 3-hydroxyacyl-CoA can be converted to 3-oxoacyl-CoA by the activity of 3-hydroxyacyl-CoA dehydrogenase. 3-oxoacyl-CoA may be converted to an acyl-CoA molecule, shortened by 2 carbons and an acetyl-CoA, by the activity of Acetyl-CoA C-acyltransferase (e.g., also known as beta-ketothiolase and beta-ketothiolase). In some embodiments, acyl-CoA molecules may be repeatedly shortened by beta oxidation until a desired carbon chain length is generated (e.g., 10 or 12 carbons, sebacic acid or dodecanedioic acid, respectively). A shortened fatty acid can be further processed using omega oxidation to yield a dicarboxylic acid (e.g., dodecanedioic acid).

Beta-Oxidation Activities

The term "beta oxidation pathway" as used herein, refers to a series of enzymatic activities utilized to metabolize fatty alcohols, fatty acids, or dicarboxylic acids. The activities utilized to metabolize fatty alcohols, fatty acids, or dicarboxylic acids include, but are not limited to, acyl-CoA ligase activity, acyl-CoA oxidase activity, acyl-CoA hydrolase activity, acyl-CoA thioesterase activity, enoyl-CoA hydratase activity, 3-hydroxyacyl-CoA dehydrogenase activity and acetyl-CoA C-acyltransferase activity. The term "beta oxidation activity" refers to any of the activities in the beta oxidation pathway utilized to metabolize fatty alcohols, fatty acids or dicarboxylic acids.

Beta-Oxidation—Acyl-CoA Ligase

An acyl-CoA ligase enzyme sometimes is encoded by the host organism and can be added to generate an engineered organism. In some embodiments, host acyl-CoA ligase activity can be increased by increasing the number copies of an acyl-CoA ligase gene, by increasing the activity of a promoter that regulates transcription of an acyl-CoA ligase gene, or by increasing the number copies of the gene and by increasing the activity of a promoter that regulates transcription of the gene, thereby increasing production of target product (e.g., sebacic or dodecanedioic acid) due to increased carbon flux through the pathway. In certain embodiments, the acyl-CoA ligase gene can be isolated from any suitable organism. Non-limiting examples of organisms that include, or can be used as donors for, acyl-CoA ligase enzymes include *Candida, Saccharomyces*, or *Yarrowia*.

Beta-Oxidation—Enoyl-CoA Hydratase

An enoyl-CoA hydratase enzyme catalyzes the addition of a hydroxyl group and a proton to the unsaturated β-carbon on a fatty-acyl CoA and sometimes is encoded by the host organism and sometimes can be added to generate an engineered organism. In certain embodiments, the enoyl-CoA hydratase activity is unchanged in a host or engineered organism. In some embodiments, the host enoyl-CoA hydratase activity can be increased by increasing the number of copies of an enoyl-CoA hydratase gene, by increasing the activity of a promoter that regulates transcription of an enoyl-CoA hydratase gene, or by increasing the number copies of the gene and by increasing the activity of a promoter that regulates transcription of the gene, thereby increasing the production of target product (e.g., sebacic or dodecanedioic acid) due to increased carbon flux through the pathway. In certain embodiments, the enoyl-CoA hydratase gene can be isolated from any suitable organism. Non-limiting examples of organisms that include, or can be used as donors for, enoyl-CoA hydratase enzymes include *Candida, Saccharomyces*, or *Yarrowia*.

Beta-Oxidation—3-Hydroxyacyl-CoA Dehydrogenase 3-hydroxyacyl-CoA dehydrogenase enzyme catalyzes the formation of a 3-ketoacyl-CoA by removal of a hydrogen from the newly formed hydroxyl group created by the activity of enoyl-CoA hydratase. In some embodiments, the activity is encoded by the host organism and sometimes can be added or increased to generate an engineered organism. In certain embodiments, the 3-hydroxyacyl-CoA activity is unchanged in a host or engineered organism. In some embodiments, the host 3-hydroxyacyl-CoA dehydrogenase activity can be increased by increasing the number of copies of a 3-hydroxyacyl-CoA dehydrogenase gene, by increasing the activity of a promoter that regulates transcription of a 3-hydroxyacyl-CoA dehydrogenase gene, or by increasing the number copies of the gene and by increasing the activity of a promoter that regulates transcription of the gene, thereby increasing production of target product (e.g., sebacic or dodecanedioic acid) due to increased carbon flux through the pathway. In certain embodiments, the 3-hydroxyacyl-CoA dehydrogenase gene can be isolated from any suitable organism. Non-limiting examples of organisms that include, or can be used as donors for, 3-hydroxyacyl-CoA dehydrogenase enzymes include *Candida, Saccharomyces*, or *Yarrowia*.

Beta-Oxidation—Acetyl-CoA C-Acyltransferase

An Acetyl-CoA C-acyltransferase (e.g., beta-ketothiolase) enzyme catalyzes the formation of a fatty acyl-CoA shortened by 2 carbons by cleavage of the 3-ketoacyl-CoA by the thiol group of another molecule of CoA. The thiol is inserted between C-2 and C-3, which yields an acetyl CoA molecule and an acyl CoA molecule that is two carbons shorter. An Acetyl-CoA C-acyltransferase sometimes is encoded by the host organism and sometimes can be added to generate an engineered organism. In certain embodiments, the acetyl-CoA C-acyltransferase activity is unchanged in a host or engineered organism. In some embodiments, the host acetyl- CoA C-acyltransferase activity can be increased by increasing the number of copies of an acetyl-CoA C-acyltransferase gene, or by increasing the activity of a promoter that regulates transcription of an acetyl-CoA C-acyltransferase gene, thereby increasing the production of target product (e.g., sebacic or dodecanedioic acid) due to increased carbon flux through the pathway. In certain embodiments, the acetyl-CoA C-acyltransferase gene can be isolated from any suitable organism. Non-limiting examples of organisms that include, or can be used as donors for, acetyl-CoA C-acyltransferase enzymes include *Candida, Saccharomyces*, or *Yarrowia*. One type of acetyl-CoA C-acyltransferase is an acetoacetyl CoA thiolase (e.g., "acoat").

Beta-Oxidation—Enoyl CoA Isomerase

Feedstocks, such as fatty acid distillates and soapstocks can comprise unsaturated fatty acids, for example, such as oleic acid (C18:1), linoleic acid (C18:2), and linolenic acid (C18:3). In some embodiments, unsaturated fatty acids are converted to dicarboxylic acids that maintain the position and orientation of the double bonds. Cells can employ additional enzymes to allow the oxidation (e.g., beta oxidation) of these types of unsaturated fatty acids or diacids. In some instances, an enzyme enoyl-CoA isomerase (ECI) is required for the beta-oxidation of substrates with double bonds at odd numbered positions. In some instances, the enzyme dienoyl-CoA reductase (DCR) is required for the beta-oxidation of substrates with double bonds at even numbered positions).

Enoyl CoA Isomerase (ECI) can also be known as enoyl-CoA delta isomerase 1, dodecenoyl-CoA isomerase, 3,2 trans-enoyl-CoA isomerase, acetylene-allene isomerase, delta3, delta2-enoyl-CoA isomerase, dodecenoyl-CoA delta isomerase, and EC 5.3.3.8 (in human for example). Several alternatively spliced transcript variants are also known. ECI is a member of the hydratase/isomerase superfamily. ECI can be a key mitochondrial enzyme involved in beta-oxidation of unsaturated fatty acids. This enzyme can isomerize both 3-cis and 3-trans double bonds into the 2-trans form in a range of ECI enzymes from different species. ECI can catalyze the transformation of 3-cis and 3-trans-enoyl-CoA esters arising during the stepwise degradation of cis-, mono-, and polyunsaturated fatty acids to the 2-trans-enoyl-CoA intermediates. ECI is present in many microorganisms and several species of yeast have at least two ECI enzymes. The percent amino acid sequence identities of two ECI enzymes from *Candida viswanathii* (Cv), two ECI enzymes from *Candida tropicalis* (Ct), one ECI enzyme from *Yarrowia lipolytica* (Yl), and one ECI enzyme from *Saccharomyces cerevisiae* (Sc) are set forth in the FIG. 35. In FIG. 35, "p" refers to "polypeptide":

In some embodiments, ECI is a critical enzyme because of its activity and the normal position of double bonds in some feedstocks (e.g., soapstocks and fatty acid distillates). Many unsaturated fatty acids have a cis-Δ9 double bond. During the beta-oxidation of an 18-carbon diacid with a cis-Δ9 double bond, the double bond is encountered when it has been chain shortened to 12 carbons. At this stage the 12-carbon molecule can have a cis-Δ3 double bond that is not a substrate for an acyl-CoA oxidase. Therefore, in some instances, ECI is required to convert the cis-Δ3 double bond to a trans-Δ2 double bond. In some instances, the product of the ECI reaction is a substrate for the second step in beta-oxidation, and ECI can effectively bypass acyl-CoA oxidase in a particular round of beta-oxidation. In some instances, even if a strain comprises an acyl-CoA oxidase that is not active on feedstocks of less than or equal to C12 (i.e., 12 carbons), an active ECI can effect the shortening of one more rounds of beta-oxidation, which can produce a 10-carbon product for substrates with a cis-Δ9 double bond. Therefore, in some embodiments the ECI gene is disrupted (e.g., knocked out or deleted) in a yeast (e.g., in a *Candida* strain) to prevent chain shortening past a desired chain-length (e.g., in this instance, 12 carbons). In some embodiments, disrupting the expression (e.g. knocking out the expression) of an ECI gene can result in an increase in the production of a fatty dicarboxylic acid comprising 10 to 18 carbons. In some embodiments, disrupting the expression (e.g. knocking out the expression) of an ECI gene can result in an increase in the production of a fatty dicarboxylic acid comprising 10, 12, 14, 16 or 18 carbons. In some embodiments, disrupting the expression of an enoyl CoA isomerase can increase the production of fatty dicarboxylic acid comprising 10, 12, 14, 16 or 18 carbons when using certain feedstocks (e.g., certain soapstocks or fatty acid distillates).

In some embodiments, an ECI knock out (i.e. eciΔ) strain is able to produce DDDA from oleic acid even in the presence of acyl-CoA oxidase with activity on substrates of chain-length less than 12 carbons.

In some embodiments, a 12 carbon dicarboxylic acid produced from fatty acid feedstocks comprising unsaturated fatty acids require hydrogenation to arrive at the fully saturated DDDA product.

Beta-Oxidation—Dienoyl-CoA Reductase

Dienoyl CoA reductase (DCR, e.g., EC 1.3.1.34) is a peripheral enzyme that converts trans-2, cis-4 dienoyl-CoA substrates to trans-3-enoyl-CoA products (Gurvitz A, et al., (1997) JBC 272:22140-22147).

The trans-3-enoyl-CoA is then converted by the enzyme Enoyl-CoA Isomerase (ECI) to trans-2-enoyl-CoA which is then the substrate for the second enzyme in β-oxidation. The DCR reaction is often necessary for complete β-oxidation of fatty acids with double bonds at even numbered positions (e.g., linoleic acid (C18:2) and linolenic acid (C18:3)). Sometimes, the diacids produced from these fatty acids also require the activity of DCR for complete β-oxidation. Diacids are capable of being oxidized starting from either end (diterminal β-oxidation) and sometimes the enzymes required to deal with the double bonds are the same from either direction. This is because even-numbered diacids with double bonds at even-numbered positions maintain the even-numbered position from either end (similarly with double bonds at odd-numbered positions).

This reaction can be essential for complete beta-oxidation of fatty acids with double bonds at even numbered positions, such as linoleic acid and linolenic acid. Depending on the carbon chain length of the desired final di-acid product, it may be useful to either amplify or reduce the activity of one or more DCR enzymes in the host cell or engineered organism. For di-acid products that have a carbon chain length of eight or greater, it may be useful or desirable to reduce or eliminate one or all DCR enzymes in the host cell. For di-acid products that have a carbon chain length of less than eight carbons, it may be useful or desirable to amplify the activity of one or more DCR enzymes in the host cell or engineered organism.

FIG. 36 is a table of diacid products that may be produced from unsaturated fatty acids using a strain comprising a deletion in ECI and/or DCR. A Dcr-strain typically produces exclusively a C8:3 diacid. In some embodiments, a DCR polypeptide is not decreased, such as by disrupting a DCR-encoding polynucleotide, in a strain utilized to produce a diacid product (e.g., adipic acid sebacic acid, DDDA). In certain embodiments, DCR polypeptide production is increased (e.g., introducing additional copy numbers of an endogenous DCR-encoding polynucleotide; introducing one or more copies of a heterologous DCR-encoding polynucleotide) to produce adipic acid from polyunsaturated fatty acids, such as those prevalent in soybean or corn oil.

In yeast such as *Candida tropicalis* and *Candida viswanathii*, there are two DCR homologs, often referred to as DCR1 and DCR2. The yeast *Saccharomyces cerevisiae* includes one DCR enzyme, while the yeast *Yarrowia lipolytica* includes at least three DCR homologs, referred to herein as "DCR1", "DCR2", and "DCR3". The percent identities of some DCR enzymes are shown in FIG. 37 and FIG. 38 below where the prefix Ct is *Candida tropicalis*, Cv is *Candida viswanathii*, Sc is *Saccharomyces cerevisiae* and Yl is *Yarrowia lipolytica*.

Hydrogenation

An unsaturated diacid sometimes is produced from a feedstock comprising an unsaturated fatty acid, and production of a fully saturated diacid in such situations often requires hydrogenation of the unsaturated diacid. For example, an unsaturated C6:1 diacid generated from one or more long chain unsaturated fatty acids in an Eci-, pox4Δ strain, can be converted to a fully saturated C6:0 diacid by reducing the double bond by a suitable method. Non-limiting examples of hydrogenation methods include the use of a metallic chemical catalyst, non-metallic chemical catalyst, enzymatic catalyst, the like or combination thereof.

Figures 38, 39, 40:
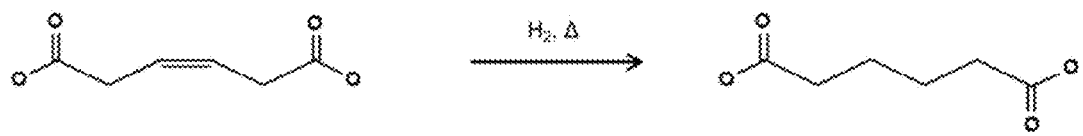
FIG. 38 is a table of the percent identities of some DCR enzymes where the prefix Ct is *Candida tropicalis*, Cv is *Candida viswanathii*, Sc is *Saccharomyces cerevisiae* and Yl is *Yarrowia lipolytica*.
FIG. 39 shows a non-limiting example of a hydrogenation reaction.
FIG. 40 shows the percent identity of the Yor180c to the known DCI enzymes from rat and mouse.

A non-limiting example of a hydrogenation reaction is shown in FIG. 39. Sometimes source hydrogen is provided from molecular hydrogen (e.g., in the case of chemical catalysis) and sometimes source hydrogen is provided from enzymatic cofactors, non-limiting examples of which include NADH, NADPH, FADH2, the like or combination thereof (e.g., in the case of enzymatic catalysis).

In some embodiments catalytic hydrogenation is carried out with a suitable metallic catalyst, non-limiting examples of which include platinum, palladium, rhodium, ruthenium, nickel, the like or combination thereof. Sometimes a catalyst is a homogenous catalyst and sometimes a catalyst is a heterogeneous catalyst. An elevated temperature and/or pressure can be employed to increase reaction rate. For example, an unsaturated diacid (e.g., cis, cis-muconic acid) can be hydrogenated and converted to adipic acid using a 10% Pt on carbon catalyst at 3400 kPa for 2.5 hours at ambient temperature (Niu et al., (2002) *Biotechnol. Prog.* 18:201-211). In some embodiments, catalytic hydrogenation can occur with nonmetallic catalysts such as frustrated Lewis pair compounds (Welch et al., (2006) *Science* 314: 1124-1126).

In certain embodiments, enzymatic hydrogenation is conducted in vivo or in vitro with a suitable native or engineered enzyme that can catalyze a redox reaction with an unsaturated diacid or fatty acid as a substrate or a product. An enzyme can be utilized in vivo in some embodiments by increasing expression of a native enzyme or expressing a non-native enzyme capable of catalyzing a desired hydrogenation reaction in an organism that produces an unsaturated diacid precursor of a saturated diacid product. A lysate of an organism containing an enzyme capable of catalyzing a desired hydrogenation reaction, or a purified or isolated enzyme preparation, sometimes is utilized in an in vitro reaction. Non-limiting examples of a suitable native or engineered enzyme include acyl-CoA dehydrogenase (EC#1.3.1.8), trans-2-enoyl-CoA reductase (EC#1.3.1.44), stearoyl-CoA 9-desaturase (EC#1.14.19.1), the like or combination thereof. In some embodiments, a desired reaction product (e.g., a saturated diacid) is produced by an enzyme operating in a forward or a reverse direction (e.g., a forward or reverse reaction).

Dienoyl CoA Isomerase

Figure 33:
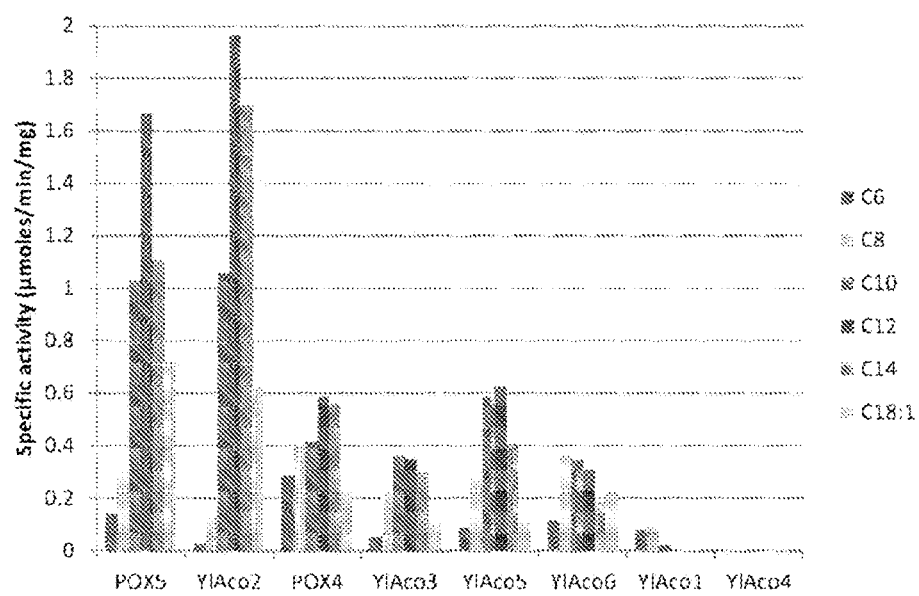
FIG. 33 shows the activity profiles of six *Y. lipolytica* acyl-CoA oxidase proteins in addition to POX4 and POX5 from ATCC20336. The activity profiles for these enzymes was determined using an in vitro acyl-CoA oxidase assay (e.g., as described in Ex. 41) and acyl-CoA substrates of different chain lengths (e.g., C6, six carbons; C8, eight carbons; C10, ten carbons; C12, twelve carbons; C14, fourteen carbons; and C18-1, eighteen carbons).
Figure 34:
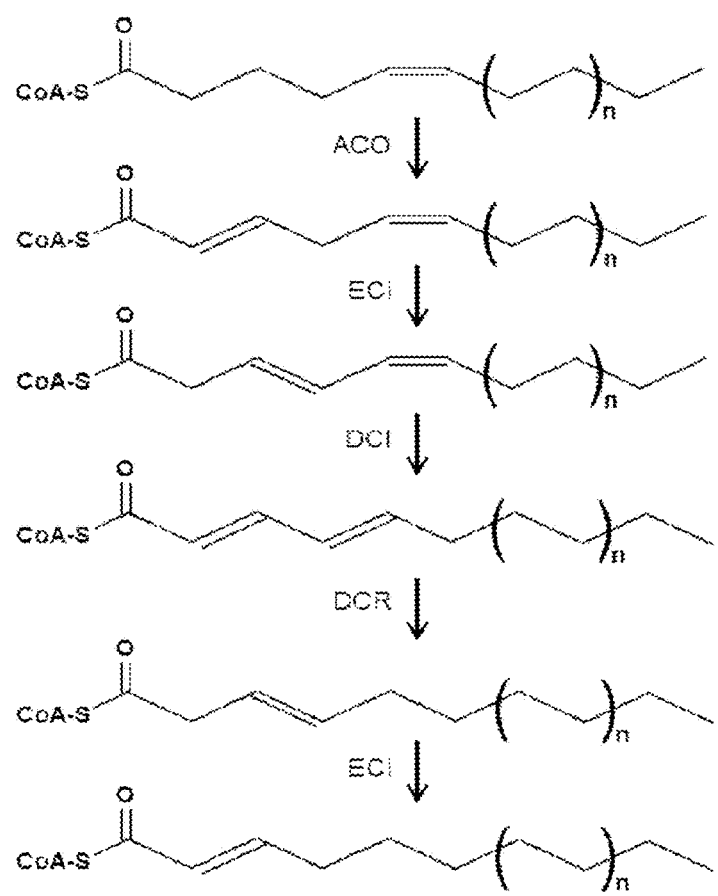
FIG. 34 shows a schematic example of a reaction pathway that includes ACO, ECI, DCI (Dienoyl CoA Isomerase) and a DCR as well as their reaction products and substrates.

Dienoyl CoA Isomerase (DCI, e.g., EC#5.3.3, Δ3,5,Δ2, 4-dienoyl-CoA isomerase, Δ3,5,Δ2,4-dienoyl-coenzyme A isomerase) is a peripheral β-oxidation enzyme that catalyzes the isomerization of a Δ3,5-dienoyl-CoA to a Δ2,4-dienoyl-CoA (e.g., see FIG. 33). This reaction is part of a minor β-oxidation pathway that occurs when the 3,2-enoyl-CoA isomerase (ECI) converts a Δ2,5-dienoyl-CoA to a Δ3,5-dienoyl-CoA. In order to fully oxidize this product DCI converts the Δ3,5-dienoyl-CoA to a Δ2,4-dienoyl-CoA, the latter of which is a substrate for the 2,4-dienoyl-CoA reductase (DCR). The product of the DCR reaction is a 3-enoyl-CoA, which is a substrate for ECI that converts it to a 2-enoyl-CoA that can be fully oxidized through β-oxidation.

A DCI enzyme was identified in mammalian systems. While an *S. cerevisiae* gene YOR180c has been identified as a DCI (Gurvitz et al., J. Biol. Chem. (1999) 274: 24514-24521) it also has been suggested that, while *S. cerevisiae* does contain DCI enzyme activity, such activity is not provided by the gene product of YOR180c (Ntamack et al., (2009) Biochim. Biophys. Acta 1791: 371-378).

The percent identity of the Yor180c to the known DCI enzymes from rat and mouse is quite low (FIG. 40). Performing a sequence alignment search of the *Candida tropicalis* and *Candida viswanathii* genomes for similarity to the mouse Dci1p identified sequences having greater identity than the *S. cerevisiae* Yor180c. All of such sequences identified have C-terminal peroxisomal targeting sequences indicating that they are targeted to the peroxisomal compartment. The putative *Candida* sp. DCI enzymes identified may comprise dienoyl-CoA isomerase activity and also enoyl-CoA isomerase activity. They may also be peripheral β-oxidation enzymes of currently unknown function.

The sequence of some putative DCI proteins are provided in SEQ. ID. NO: 3809-3812. In some embodiments, a polypeptide having DCI activity (e.g., in *C. viswanathii*), is reduced or amplified, depending upon the chain-length of a desired diacid product. For example, for adipic acid production, a DCI activity can be increased to improve productivity of unsaturated fatty acids in a host organism (e.g., DCI activity can be increased by inserting one or more copies of a polynucleotide encoding a polypeptide having DCI (e.g., inserting one or more copies of an endogenous or exogenous polynucleotide)). In some embodiments, for C8 and longer diacids, a DCI activity is reduced (e.g., by introducing a disruption, deletion or knockout of (i) a polynucleotide that encodes a polypeptide having DCI activity, or (ii) a promoter operably linked to a polynucleotide that encodes a polypeptide having DCI activity).

Omega Oxidation Activities

The term "omega oxidation activity" refers to any of the activities in the omega oxidation pathway utilized to metabolize alkanes, fatty alcohols, fatty acids, dicarboxylic acids, or sugars. The activities utilized to metabolize fatty alcohols, fatty acids, or dicarboxylic acids include, but are not limited to, monooxygenase activity (e.g., cytochrome P450 activity), monooxygenase reductase activity (e.g., cytochrome P450 reductase activity), alcohol dehydrogenase activity (e.g., fatty alcohol dehydrogenase activity, or long-chain alcohol dehydrogenase activity), fatty alcohol oxidase activity, fatty aldehyde dehydrogenase activity, and thioesterase activity.

Omega Oxidation—Monooxygenases

A cytochrome P450 enzyme (e.g., monooxygenase activity) often catalyzes the insertion of one atom of oxygen into an organic substrate (RH) while the other oxygen atom is reduced to water. Insertion of the oxygen atom near the omega carbon of a substrate yields an alcohol derivative of the original starting substrate (e.g., yields a fatty alcohol). A cytochrome P450 sometimes is encoded by the host organism and sometimes can be added to generate an engineered organism.

In certain embodiments, the monooxygenase activity is unchanged in a host or engineered organism. In some embodiments, the host monooxygenase activity can be increased by increasing the number of copies of a cytochrome P450 gene, or by increasing the activity of a promoter that regulates transcription of a cytochrome P450 gene, thereby increasing the production of target product (e.g., sebacic or dodecanedioic acid) due to increased carbon flux through the pathway. In certain embodiments, the cytochrome P450 gene can be isolated from any suitable organism. Non-limiting examples of organisms that include, or can be used as donors for, cytochrome P450 enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*).

Omega Oxidation—Monooxygenase Reductases

A cytochrome P450 reductase (e.g., monooxygenase reductase activity) catalyzes the reduction of the heme-thiolate moiety in cytochrome P450 by transferring an electron to the cytochrome P450. A cytochrome P450 reductase sometimes is encoded by the host organism and sometimes can be added to generate an engineered organism. In certain embodiments, the monooxygenase reductase activity is unchanged in a host or engineered organism. In some embodiments, the host monooxygenase reductase activity can be increased by increasing the number of copies of a cytochrome P450 reductase gene, or by increasing the activity of a promoter that regulates transcription of a cytochrome P450 reductase gene, thereby increasing the production of target product (e.g., sebacic or dodecanedioic acid) due to increased carbon flux through the pathway. In certain embodiments, the cytochrome P450 reductase gene can be isolated from any suitable organism. Non-limiting examples of organisms that include, or can be used as donors for, cytochrome P450 reductase enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*).

Omega Oxidation—Alcohol Dehydrogenases

An alcohol dehydrogenase (e.g., fatty alcohol dehydrogenase, long-chain alcohol dehydrogenase) catalyzes the removal of a hydrogen from an alcohol to yield an aldehyde or ketone and a hydrogen atom and NADH, in the endoplasmic reticulum of a cell. An alcohol dehydrogenase sometimes is encoded by the host organism and sometimes can be added to generate an engineered organism. In certain embodiments, the alcohol dehydrogenase activity is unchanged in a host or engineered organism. In some embodiments, the host alcohol dehydrogenase activity can be increased by increasing the number of copies of an alcohol dehydrogenase gene, or by increasing the activity of a promoter that regulates transcription of an alcohol dehydrogenase gene, thereby increasing the production of target product (e.g., sebacic or dodecanedioic acid) due to increased carbon flux through the pathway. In certain embodiments, the alcohol dehydrogenase gene can be isolated from any suitable organism. Non-limiting examples of organisms that include, or can be used as donors for, alcohol dehydrogenase enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*).

Omega Oxidation—Fatty Alcohol Oxidases

A fatty alcohol oxidase (e.g., long-chain alcohol oxidase, EC 1.1.3.20) enzyme catalyzes the addition of oxygen to two molecules of a long-chain alcohol to yield 2 long chain aldehydes and 2 molecules of water, in the peroxisome of a cell. A fatty alcohol oxidase sometimes is encoded by the host organism and sometimes can be added to generate an engineered organism. In certain embodiments, the fatty alcohol oxidase activity is unchanged in a host or engineered organism. In some embodiments, the host fatty alcohol oxidase activity can be increased by increasing the number of copies of a fatty alcohol oxidase gene, or by increasing the activity of a promoter that regulates transcription of a fatty alcohol oxidase gene, thereby increasing the production of target product (e.g., sebacic or dodecanedioic acid) due to increased carbon flux through the pathway. In certain embodiments, the fatty alcohol oxidase gene can be isolated from any suitable organism. Non-limiting examples of organisms that include, or can be used as donors for, fatty alcohol oxidase enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*).

Omega Oxidation—Aldehyde Dehydrogenases

A fatty aldehyde dehydrogenase (e.g., long chain aldehyde dehydrogenase) enzyme catalyzes the oxidation of long chain aldehydes to a long chain carboxylic acid, NADH and H. A fatty aldehyde dehydrogenase sometimes is encoded by the host organism and sometimes can be added to generate an engineered organism. In certain embodiments, the fatty aldehyde dehydrogenase activity is unchanged in a host or engineered organism. In some embodiments, the host fatty aldehyde dehydrogenase activity can be increased by increasing the number of copies of a fatty aldehyde dehydrogenase gene, or by increasing the activity of a promoter that regulates transcription of a fatty aldehyde dehydrogenase gene, thereby increasing the production of target product (e.g., sebacic or dodecanedioic acid) due to increased carbon flux through the pathway. In certain embodiments, the fatty aldehyde dehydrogenase gene can be isolated from any suitable organism. Non-limiting examples of organisms that include, or can be used as donors for, fatty aldehyde dehydrogenase enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*).

Omega Oxidation—Thioesterases

A thioesterase enzyme (e.g., acyl-CoA thioesterase activity, acyl-ACP thioesterase activity) catalyzes the removal of Coenzyme A or acyl carrier protein (e.g., ACP) from a fatty acid including acyl-CoA or acyl carrier protein (e.g., esterified fatty acid) to yield a fatty acid and an alcohol. The reaction occurs in the presence of water and Coenzyme A or acyl carrier protein is specifically removed at a thiol group. A thioesterase sometimes is encoded by the host organism and sometimes can be added to generate an engineered organism. In certain embodiments, the thioesterase activity is unchanged in a host or engineered organism. In some embodiments, the host thioesterase activity can be increased by increasing the number of copies of a thioesterase gene, or by increasing the activity of a promoter that regulates transcription of a thioesterase gene, thereby increasing the production of target product (e.g., sebacic or dodecanedioic acid) due to increased carbon flux through the pathway. In certain embodiments, a thioesterase gene can be isolated from any suitable organism. Non-limiting examples of organisms that include, or can be used as donors for, thioesterase enzymes include yeast (e.g., *Candida, Saccharomyces, Debaryomyces, Meyerozyma, Lodderomyces, Scheffersomyces, Clavispora, Yarrowia, Pichia, Kluyveromyces, Eremothecium, Zygosaccharomyces, Lachancea, Nakaseomyces*), animals (e.g., *Homo, Rattus*), bacteria (e.g., *Escherichia, Pseudomonas, Bacillus*), or plants (e.g., *Arabidopsis, Nictotania, Cuphea*).

Engineered Pathways

FIGS. 1-8 depict embodiments of biological pathways for making sebacic acid and dodecanedioic acid, using various alkanes, fatty acids, fatty alcohols or combinations thereof. Any suitable alkane, fatty acid, fatty alcohol, plant based oil, seed based oil, non-petroleum derived soap stock or the like can be used as the feedstock for the organism (e.g., dodecane, methyl laurate, lauric acid, carbon sources having 10 or greater carbons (e.g. for sebacic acid production) or carbon sources having 12 or greater carbons (e.g. for dodecanedioic acid production). In some embodiments, carbon sources with greater than 12 carbons can be metabolized using naturally occurring and/or engineered pathways to yield molecules that can be further metabolized using the beta oxidation pathway shown in the lower portion of FIGS. 5-8. In some embodiments, the activities in the pathways depicted in FIGS. 1-8 can be engineered, as described herein, to enhance metabolism and target product formation.

In certain embodiments, one or more activities in one or more metabolic pathways can be engineered to increase carbon flux through the engineered pathways to produce a desired product (e.g., sebacic or dodecanedioic acid). The engineered activities can be chosen to allow increased production of metabolic intermediates that can be utilized in one or more other engineered pathways to achieve increased production of a desired product with respect to the unmodified host organism. The engineered activities also can be chosen to allow decreased activity of enzymes that reduce production of a desired intermediate or end product (e.g., reverse activities). This "carbon flux management" can be optimized for any chosen feedstock, by engineering the appropriate activities in the appropriate pathways. Non-limiting examples are given herein using pure alkanes (e.g., single chain length alkanes, dodecane or example), mixed chain-length alkanes, long-chain alkanes, pure fatty acids (e.g., single chain length fatty acids, capric acid for example) and mixed chain length fatty acids (see FIGS. 1-8). The process of "carbon flux management" through engineered pathways produces a dicarboxylic acid (e.g. sebacic acid or dodecanedioic acid) at a level and rate closer to the calculated maximum theoretical yield for any given feedstock, in certain embodiments. The terms "theoretical yield" or "maximum theoretical yield" as used herein refer to the yield of product of a chemical or biological reaction that can be formed if the reaction went to completion. Theoretical yield is based on the stoichiometry of the reaction and ideal conditions in which starting material is completely consumed, undesired side reactions do not occur, the reverse reaction does not occur, and there no losses in the work-up procedure.

A microorganism may be modified and engineered to include or regulate one or more activities in a fatty dicarboxylic acid (e.g., octanedioic acid, decanedioic acid, dodecanedioic acid, tetradecanedioic acid, hexadecanedioic acid, octadecanedioic acid, eicosanedioic acid) pathway. The term "activity" as used herein refers to the functioning of a microorganism's natural or engineered biological pathways to yield various products including a fatty dicarboxylic acid (e.g., octanedioic acid, decanedioic acid, dodecanedioic acid, tetradecanedioic acid, hexadecanedioic acid, octadecanedioic acid, eicosanedioic acid) and its precursors. A fatty dicarboxylic acid (e.g., octanedioic acid, decanedioic acid, dodecanedioic acid, tetradecanedioic acid, hexadecanedioic acid, octadecanedioic acid, eicosanedioic acid) producing activity can be provided by any non-mammalian source in certain embodiments. Such sources include, without limitation, eukaryotes such as yeast and fungi and prokaryotes such as bacteria. In some embodiments, a reverse activity in a pathway described herein can be altered (e.g., disrupted, reduced) to increase carbon flux through a beta oxidation pathway, an omega oxidation pathway, or a beta oxidation and omega oxidation pathway, towards the production of target product (e.g., sebacic or dodecanedioic acid). In some embodiments, a genetic modification disrupts an activity in the beta oxidation pathway, or disrupts a polynucleotide that encodes a polypeptide that carries out a forward reaction in the beta oxidation pathway, which renders beta oxidation activity undetectable. The term "undetectable" as used herein refers to an amount of an analyte that is below the limits of detection, using detection methods or assays known (e.g., described herein). In certain embodiments, the genetic modification partially reduces beta oxidation activity. The term "partially reduces beta oxidation activity" as used here refers to a level of activity in an engineered organism that is lower than the level of activity found in the host or starting organism.

In some embodiments, a beta-oxidation activity can be modified to alter the catalytic specificity of the chosen activity. In certain embodiments, an acyl-CoA oxidase activity can be altered by modifying a catalytic domain associated with carbon chain length preference and/or specificity. In some embodiments, the altered catalytic specificity can be found by screening naturally occurring variant or mutant populations of a host organism. In certain embodiments, the altered catalytic can be generated by various mutagenesis techniques in conjunction with selection and/or screening for the desired activity. In some embodiments, the altered catalytic activity can be generated by generating chimeric acyl-CoA oxidases using a mix and match approach, followed by selection and/or screening for the desired catalytic activity. Examples of experiments performed to generate acyl-CoA oxidases with altered catalytic activity are described herein.

An activity within an engineered microorganism provided herein can include one or more (e.g., 1, 2, 3, 4, 5, 6, 7, 8, 9, 10, 11, 12, 13, 14 or all) of the following activities: 6-oxohexanoic acid dehydrogenase activity; 6-hydroxyhexanoic acid dehydrogenase activity; cytochrome P450 activity; cytochrome P450 reductase activity; fatty alcohol oxidase activity; acyl-CoA ligase activity, acyl-CoA oxidase activity; enoyl-CoA hydratase activity, 3-hydroxyacyl-CoA dehydrogenase activity, fatty acid synthase activity, lipase activity, acetyl-CoA carboxylase activity, acyltransferase activity (diacylglycerol acyl transferase, lecithin-cholesterol acyltransferase, phospholipid: diacylglycerol acyltransferase) and thioesterase activity (e.g., acyl-CoA hydrolase, acyl-CoA thioesterase, acyl-ACP thioesterase, acetyl-CoA C-acyltransferase, beta-ketothiolase, and the like). In certain embodiments, one or more (e.g., 1, 2, 3, 4, 5, 6, 7, 8, 9, 10 or all) of the foregoing activities is altered by way of a genetic modification. In some embodiments, one or more (e.g., 1, 2, 3, 4, 5, 6, 7, 8, 9, 10, 11, 12, 13, 14 or all) of the foregoing activities is altered by way of (i) adding a heterologous polynucleotide that encodes a polypeptide having the activity, and/or (ii) altering or adding a regulatory sequence that regulates the expression of a polypeptide having the activity. In certain embodiments, one or more of the foregoing activities is altered by way of (i) disrupting an endogenous polynucleotide that encodes a polypeptide having the activity (e.g., insertional mutagenesis), (ii) deleting a regulatory sequence that regulates the expression of a polypeptide having the activity, and/or (iii) deleting the coding sequence that encodes a polypeptide having the activity (e.g., knock out mutagenesis).

The term "omega hydroxyl fatty acid dehydrogenase activity" as used herein refers to conversion of an omega hydroxyl fatty acid to an omega oxo fatty acid. The omega hydroxyl fatty acid dehydrogenase activity can be provided by a polypeptide. In some embodiments, the polypeptide is encoded by a heterologous nucleotide sequence introduced to a host microorganism. In certain embodiments, an endogenous polypeptide having the omega hydroxyl fatty acid dehydrogenase activity is identified in the host microorganism, and the host microorganism is genetically altered to increase the amount of the polypeptide produced (e.g., a heterologous promoter is introduced in operable linkage with a polynucleotide that encodes the polypeptide; the copy number of a polynucleotide that encodes the polypeptide is increased (e.g., by introducing a plasmid that includes the polynucleotide)). Nucleic acid sequences conferring omega hydroxyl fatty acid dehydrogenase activity can be obtained from a number of sources, including Actinobacter, Norcardia, *Pseudomonas* and Xanthobacter bacteria. Examples of an amino acid sequence of a polypeptide having omega hydroxyl fatty acid dehydrogenase activity and a nucleotide sequence of a polynucleotide that encodes the polypeptide, are presented herein. Presence, absence or amount of omega hydroxyl fatty acid dehydrogenase activity can be detected by any suitable method known in the art. In some embodiments, omega hydroxyl fatty acid dehydrogenase activity is not altered in a host microorganism, and in certain embodiments, the activity is added or increased in the engineered microorganism relative to the host microorganism.

The term "monooxygenase activity" as used herein refers to inserting one atom of oxygen from $O_2$ into an organic substrate (RH) and reducing the other oxygen atom to water. In some embodiments, monooxygenase activity refers to incorporation of an oxygen atom onto a six-carbon organic substrate. In certain embodiments, monooxygenase activity refers to conversion of hexanoate to 6-hydroxyhexanoic acid. Monooxygenase activity can be provided by any suitable polypeptide, such as a cytochrome P450 polypeptide (hereafter "CYP450") in certain embodiments. Nucleic acid sequences conferring CYP450 activity can be obtained from a number of sources, including *Bacillus megaterium* and may be induced in organisms including but not limited to *Candida tropicalis, Yarrowia lipolytica, Aspergillus nidulans*, and *Aspergillus parasiticus*. Examples of oligonucleotide sequences utilized to isolate a polynucleotide sequence encoding a polypeptide having CYP450 activity (e.g., CYP52A12 polynucleotide, a CYP52A13 polynucleotide, a CYP52A14 polynucleotide, a CYP52A15 polynucleotide, a CYP52A16 polynucleotide, a CYP52A17 polynucleotide, a CYP52A18 polynucleotide, a CYP52A19 polynucleotide, a CYP52A20 polynucleotide, a CYP52D2 polynucleotide, and/or a BM3 polynucleotide) are presented herein. In some embodiments, monooxygenase activity is not altered in a host microorganism, and in certain embodiments, the activity is added or increased in the engineered microorganism relative to the host microorganism. In some embodiments, the altered monooxygenase activity is an endogenous activity, and in certain embodiments, the altered monooxygenase activity is an exogenous activity. In some embodiments, the exogenous activity is a single polypeptide with both monooxygenase and monooxygenase reductase activities (e.g., *B. megaterium* cytochrome P450:NADPH P450 reductase).

Presence, absence or amount of cytochrome P450 activity can be detected by any suitable method known in the art. For example, detection can be performed by assaying a reaction containing cytochrome P450 (CYP52A family) and NADPH—cytochrome P450 reductase (see Appl. Environ. Microbiol. 69: 5983 and 5992). Briefly, cells are grown under standard conditions and harvested for production of microsomes, which are used to detect CYP activity. Microsomes are prepared by lysing cells in Tris-buffered sucrose (10 mM Tris-HCl pH 7.5, 1 mM EDTA, 0.25M sucrose). Differential centrifugation is performed first at 25,000×g then at 100,000×g to pellet cell debris then microsomes, respectively. The microsome pellet is resuspended in 0. IM phosphate buffer (pH 7.5), 1 mM EDTA to a final concentration of approximately 10 mg protein/mL. A reaction mixture containing approximately 0.3 mg microsomes, 0.1 mM sodium hexanoate, 0.7 mM NADPH, 50 mM Tris-HCl pH 7.5 in 1 mL is initiated by the addition of NADPH and incubated at 37° C. for 10 minutes. The reaction is terminated by addition of 0.25 mL 5M HCl and 0.25 mL 2.5 ug/mL 10-hydroxydecanoic acid is added as an internal standard (3.3 nmol). The mixture is extracted with 4.5 mL diethyl ether under NaCl-saturated conditions. The organic phase is transferred to a new tube and evaporated to dryness. The residue is dissolved in acetonitrile containing 10 mM 3-bromomethyl-7-methoxy-1,4-benzoxazin-2-one (BrMB) and 0.1 mL of 15 mg/mL 18-crown-6 in acetonitrile saturated with $K_2CO_3$. The solution is incubated at 40° C. for 30 minutes before addition of 0.05 mL 2% acetic acid. The fluorescently labeled omega-hydroxy fatty acids are resolved via HPLC with detection at 430 nm and excitation at 355 nm (Yamada et al., 1991, Anal. Biochem. 199: 132-136). Optionally, specifically induced CYP gene(s) may be detected by Northern blotting and/or quantitative RT-PCR. (Craft et al., 2003, App. Environ. Micro. 69: 5983-5991).

The term "monooxygenase reductase activity" as used herein refers to the transfer of an electron from NAD(P)H, FMN, or FAD by way of an electron transfer chain, reducing the ferric heme iron of cytochrome P450 to the ferrous state.

The term "monooxygenase reductase activity" as used herein also can refer to the transfer of a second electron via the electron transport system, reducing a dioxygen adduct to a negatively charged peroxo group. In some embodiments, a monooxygenase activity can donate electrons from the two-electron donor NAD(P)H to the heme of cytochrome P450 (e.g., monooxygenase activity) in a coupled two-step reaction in which NAD(P)H can bind to the NAD(P)H-binding domain of the polypeptide having the monooxygenase reductase activity and electrons are shuttled from NAD(P)H through FAD and FMN to the heme of the monooxygenase activity, thereby regenerating an active monooxygenase activity (e.g., cytochrome P450). Monooxygenase reductase activity can be provided by any suitable polypeptide, such as a cytochrome P450 reductase polypeptide (hereafter "CPR") in certain embodiments. Nucleic acid sequences conferring CPR activity can be obtained from and/or induced in a number of sources, including but not limited to *Bacillus megaterium, Candida tropicalis, Yarrowia lipolytica, Aspergillus nidulans,* and *Aspergillus parasiticus*. Examples of oligonucleotide sequences utilized to isolate a polynucleotide sequence encoding a polypeptide having CPR activity are presented herein. In some embodiments, monooxygenase reductase activity is not altered in a host microorganism, and in certain embodiments, the activity is added or increased in the engineered microorganism relative to the host microorganism. In some embodiments, the altered monooxygenase reductase activity is an endogenous activity, and in certain embodiments, the altered monooxygenase reductase activity is an exogenous activity. In some embodiments, the exogenous activity is a single polypeptide with both monooxygenase and monooxygenase reductase activities (e.g., *B. megaterium* cytochrome P450:NADPH P450 reductase).

Presence, absence or amount of CPR activity can be detected by any suitable method known in the art. For example, an engineered microorganism having an increased number of genes encoding a CPR activity, relative to the host microorganism, could be detected using quantitative nucleic acid detection methods (e.g., southern blotting, PCR, primer extension, the like and combinations thereof). An engineered microorganism having increased expression of genes encoding a CPR activity, relative to the host microorganism, could be detected using quantitative expression based analysis (e.g., RT-PCR, western blot analysis, northern blot analysis, the like and combinations thereof). Alternately, an enzymatic assay can be used to detect Cytochrome P450 reductase activity, where the enzyme activity alters the optical absorbance at 550 nanometers of a substrate solution (Masters, B. S. S., Williams, C. H., Kamin, H. (1967) Methods in Enzymology, X, 565-573).

Acyl-CoA Oxidases

The term "acyl-CoA oxidase activity" as used herein refers to the oxidation of a long chain fatty-acyl-CoA to a trans-2,3-dehydroacyl-CoA fatty alcohol. In some embodiments, the acyl-CoA activity is from a peroxisome. In certain embodiments, the acyl-CoA oxidase activity is a peroxisomal acyl-CoA oxidase (POX) activity, carried out by a POX polypeptide. In some embodiments the acyl-CoA oxidase activity is encoded by the host organism and sometimes can be altered to generate an engineered organism. Acyl-CoA oxidase activity is encoded by the POX4 and POX5 genes of *Candida* strain ATCC20336. In certain embodiments, endogenous acyl-CoA oxidase activity can be increased. In some embodiments, acyl-CoA oxidase activity of the POX4 polypeptide or the POX5 polypeptide can be altered independently of each other (e.g., increase activity of POX4 alone, POX5 alone, increase one and disrupt the other, and the like). Increasing the activity of one POX activity, while disrupting the activity of another POX activity, may alter the specific activity of acyl-CoA oxidase with respect to carbon chain length, while maintaining or increasing overall flux through the beta oxidation pathway, in certain embodiments.

In certain embodiments, host acyl-CoA oxidase activity of one of the POX genes can be increased by genetically altering (e.g., increasing) the amount of the polypeptide produced (e.g., a strongly transcribed or constitutively expressed heterologous promoter is introduced in operable linkage with a polynucleotide that encodes the polypeptide; the copy number of a polynucleotide that encodes the polypeptide is increased (e.g., by introducing a plasmid that includes the polynucleotide, integration of additional copies in the host genome)). In some embodiments, the host acyl-CoA oxidase activity can be decreased by disruption (e.g., knockout, insertion mutagenesis, the like and combinations thereof) of an acyl-CoA oxidase gene, or by decreasing the activity of the promoter (e.g., addition of repressor sequences to the promoter or 5'UTR) which transcribes an acyl-CoA oxidase gene.

As noted above, disruption of nucleotide sequences encoding POX4, POX 5, or POX4 and POX5 sometimes can alter pathway efficiency, specificity and/or specific activity with respect to metabolism of carbon chains of different lengths (e.g., carbon chains including fatty alcohols, fatty acids, paraffins, dicarboxylic acids of between about 1 and about 60 carbons in length). In some embodiments, the nucleotide sequence of POX4, POX5, or POX4 and POX5 is disrupted with a URA3 nucleotide sequence encoding a selectable marker, and introduced to a host microorganism, thereby generating an engineered organism deficient in POX4, POX5 or POX4 and POX5 activity. Nucleic acid sequences encoding POX4 and POX5 can be obtained from a number of sources, including *Candida tropicalis*, for example. Examples of POX4 and POX5 amino acid sequences and nucleotide sequences of polynucleotides that encode the polypeptides, are presented herein. Described in the examples are experiments conducted to amplify the activity encoded by the POX5 gene.

Also as noted above, catalytic specificity of acyl-CoA oxidases (e.g., POX4, POX5) can be altered by a variety of methods. Altering the binding and/or catalytic specificity of acyl-CoA oxidases may prove advantageous for generating novel acyl-CoA oxidases with altered chain length recognition, altered chain length catalytic activity, and/or generation of an acyl-CoA oxidase activity with a narrow or specific chain length specificity, thereby allowing further increases in pathway efficiency, specificity and/or specific activity with respect to metabolism of carbon chains of different lengths or metabolism of carbon chain distributions found in a particular chosen feedstock. In some embodiments the altered acyl-CoA oxidase sequences are identified and/or generated by; (i) screening naturally occurring variant populations; (ii) mutagenesis of endogenous sequences; (iii) introduction of heterologous sequences having a desired specificity; (iv) generation of chimeric sequences having a portion of the coding sequence from one polynucleotide source (e.g., gene, organism) and a portion of the coding sequence from another source and/or (v) intelligent design using nucleotide sequences and three dimensional structure analysis from an acyl-CoA oxidase having a desired specificity to remodel an endogenous acyl-CoA oxidase, thereby generating a novel specificity enzyme. In some embodiments a chimeric acyl-CoA oxidase sequence can have polynucleotide sequence contributions from two or more sources. In some embodiments, a chimeric acyl-CoA oxidase sequence comprises a portion of the coding sequences from an endogenous polynucleotide and a portion of the coding sequence from a heterologous polynucleotide. Described in the examples are methods utilized to identify and/or generate acyl-CoA oxidases with novel catalytic and binding specificities.

Figure 21:
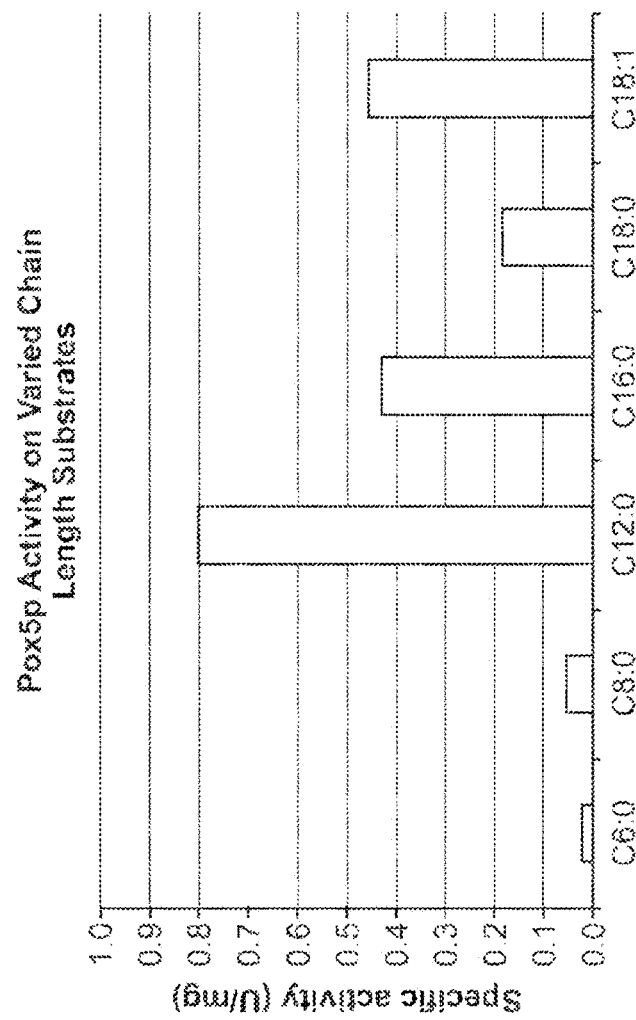
FIG. 21 shows an acyl CoA oxidase activity profile for Pox5 isolated from a *Candida* strain.

Introduction of Heterologous Acyl CoA Oxidase Sequences Having a Desired Specificity Thousands of Acyl CoA Oxidases and Acyl CoA-like Oxidases have been cloned, sequenced and isolated from a variety of organisms (SEQ ID NO. 51 through SEQ ID NO. 3673 and SEQ ID NO. 3810 through SEQ ID NO. 3882). Many of these enzymes have reported catalytic activity with selective substrate specificity. For example, some Acyl CoA Oxidases (e.g., Pox5p from a *Candida* strain) display optimal activity on substrates of 12 to 18 carbons (FIG. 21). In some embodiments, an organism (e.g., a yeast) or a genetically modified organism (e.g., a genetically modified yeast, e.g., a yeast in which β-oxidation activity is blocked) is engineered to express a heterologous Acyl-CoA Oxidase with selective substrate specificity. In some embodiments, an organism (e.g., a yeast) or a genetically modified organism (e.g., a genetically modified yeast, e.g., a yeast in which β-oxidation activity is blocked) is engineered to express an Acyl-CoA Oxidase or Acyl CoA-like Oxidase selected from SEQ ID NO. 51 to SEQ ID NO. 3673. In some embodiments, an organism (e.g., a yeast) or a genetically modified organism (e.g., a genetically modified yeast, e.g., a yeast in which β-oxidation activity is blocked) is engineered to express an Acyl-CoA Oxidase or Acyl CoA-like Oxidase selected from SEQ ID NO. 3810 through SEQ ID NO. 3882.

Presence, absence or amount of acyl-CoA oxidase activity can be detected by any suitable method known in the art. For example, using enzymatic assays as described in Shimizu et al, 1979, and as described herein in the Examples, POX4, POX5 and other acyl-CoA oxidase activities can be assessed. Alternatively, nucleic acid sequences representing native and/or disrupted POX4 and POX5 sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered organism exhibits decreased RNA and/or polypeptide levels as compared to the host organism.

Genetic Modification of Acyl-CoA Oxidases

A rate-limiting step for β-oxidation is the first step in the pathway carried out by the enzyme acyl CoA oxidase. Different Acyl-CoA oxidases can display different chain-length substrate specificities. Some acyl CoA oxidases display broad chain-length specificity and can accept any fatty acyl CoA (or diacyl-CoA) as a substrate. However, some acyl CoA oxidases can display narrow chain-length specificity.

For example the Pox5 enzyme from *Candida* strain ATCC20336 displays a decrease in activity on substrates below C10 (FIG. 21) and has low activity on C6 and C8 substrates. In a cell with Pox5 as the only functional acyl CoA oxidase, long chain fatty acyl-CoA or diacyl-CoA substrates can be shortened to about 8 carbons and do not typically enter another cycle of β-oxidation. The shorter substrates (e.g., a C8 fatty dicarboxylic acid) are not typically recognized as a substrate by Pox5, the CoA is removed by peroxisomal thioesterases and the fatty dicarboxylic acid (e.g., an α,ω-dicarboxylic acid) product is secreted from the cell. In this embodiment, the acyl CoA oxidase chain-length substrate specificity effectively controls the chain length of a diacid produced.

In some embodiments, a β-oxidation pathway in a yeast is active and includes a genetically modified acyl CoA oxidase. In some embodiments, an acyl CoA oxidase is genetically modified to prevent complete oxidation of fatty acyl-CoA or diacyl-CoA substrates. Genetic modification of an acyl CoA oxidase can increase the production yield of a desired fatty acid or fatty dicarboxylic acid product. Therefore, in some embodiments, metabolic degradation of a fatty acid of a specified chain length (e.g., the chain length of a desired or target fatty acid or fatty dicarboxylic acid product) is reduced significantly, when an acyl CoA oxidase is genetically modified. In some embodiments, metabolic degradation of a fatty dicarboxylic acid product (e.g., DDDA) by beta-oxidation is reduced significantly, when an acyl CoA oxidase is genetically modified. This can be accomplished by modifying the substrate specificity of an acyl CoA oxidase such that the enzyme has low activity (e.g., enzymatic activity) with chain lengths less than that of a desired product.

In some embodiments, the substrate specificity of an acyl CoA oxidase is modified such that the enzyme has low activity for aliphatic molecules with chain lengths less than C24 (i.e., 24 carbons). In some embodiments, the substrate specificity of an acyl CoA oxidase is modified such that the enzyme has very low activity with chain lengths less than 24, 22, 20, 18, 16, 14, 12, 10, 8, 6 or 4 carbons. In some embodiments, the substrate specificity of an acyl CoA oxidase is modified such that the enzyme has very low activity with chain lengths less than 18, 16, 14, 12, 10 or 8 carbons. In some embodiments, the substrate specificity of an acyl CoA oxidase is modified such that the enzyme has very low activity with chain lengths less than C12. In some embodiments, the substrate specificity of an acyl CoA oxidase is modified such that the enzyme has very low activity with chain lengths less than C10.

In some embodiments, genes encoding a genetically modified acyl CoA oxidase are engineered and expressed in a suitable organism (e.g., a bacteria (e.g., *E. coli*) or a yeast) to test the substrate specificity of the modified enzyme in vitro. In some embodiments, genes encoding a genetically modified acyl CoA oxidase are engineered and expressed in a suitable yeast and the substrate specificity is tested. In some embodiments, yeast that express a modified acyl CoA oxidase are tested for production of the desired fatty acid or fatty dicarboxylic acid product. A modified acyl CoA oxidase can be generated in any suitable manner, non limiting examples of which are provided hereafter.

Random Mutagenesis of Acyl-CoA Oxidase

A library of genetically modified acyl CoA oxidases can be generated using several methods known in the art (e.g., site-directed mutagenesis). Genetically modified acyl CoA oxidase genes can then be transformed into a β-oxidation blocked strain of a suitable yeast strain (e.g., *Candida* spp. (e.g., *Candida viswanathii* or *Candida tropicalis*)). In some embodiments, a genetically modified acyl CoA oxidase is expressed under the control of the POX4 promoter or another strong constitutive or inducible promoter in a pox4Δ/pox4Δ pox5Δ/pox5Δ (e.g., an organism that lacks endogenous acyl CoA oxidase activity) background. In some embodiments, the genetically modified acyl CoA oxidase is expressed under the control of endogenous promoter. In some embodiments, the genetically modified acyl CoA oxidase is expressed under the control of a heterologous promoter. The transformants can be selected by growth in a fatty acid or methyl-derivate fatty acid containing fatty acids with two more carbons than the diacid product of interest. For example, for adipic acid, the transformants can be grown in caprylic acid or methyl-caprylate. For example, for dodecanedioic acid, the transformants can be grown in tetradecanedioic acid. The group of transformants can then be moved to a medium with a carbon source of a fatty acid of interest (for example dodecanedioic acid) in the presence of an agent that kills growing cells (e.g., Nystatin) and cells that cannot metabolize the carbon source (e.g., dodecanedioic acid in this example) can be selected. The resulting modified strains can then be further characterized for acyl CoA oxidase activity. This method can be used to select for any modified acyl CoA oxidase (e.g., those listed and/or described in the TABLES herein). In addition, this method can be used to select for any heterologous acyl CoA oxidase (e.g., those listed in SEQ ID NO. 51 through 3273 and SEQ ID NO. 3728 through 3810) expressed in a suitable organism.

Rational Mutagenesis of Acyl-CoA Oxidase

Structural and sequence information and experimental data can be combined to determine specific mutations to be tested in a acyl-CoA oxidase for altered specificity. For example, primary sequences of acyl-CoA oxidases tested can be compared and correlated with substrate specificity. Based on such an analysis, single amino-acids, small numbers of contiguous amino acids and/or domains can be proposed for providing a desired substrate specificity. Those amino acids positions can be targeted for specific or random mutations for improve specificity.

Acyl CoA oxidase structure also can be modeled against a known tertiary structure using modeling methods known in the art. The models can be used to propose amino acids and regions pertaining to substrate selectivity. For example, biochemical, structure and sequence data suggest that the N-terminus of acyl CoA oxidases often, in part, determines substrate specificity. Mutations or region replacements can be introduced based on such analyses and the specificity of the new acyl CoA oxidase tested as described before. The resulting information can be used to go back to the models to postulate new potential mutations. As for random mutagenesis, any suitable acyl CoA oxidase can be modified to alter substrate specificity (e.g., those listed in SEQ ID NO. 51 through 3273 and SEQ ID NO. 3728 through 3810)

The term "acyl CoA oxidase activity" as used herein refers to the enzymatic activity (e.g., catalytic activity) of a acyl CoA oxidase. An acyl CoA oxidase can catalyze the following chemical reaction:

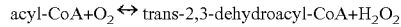

acyl-CoA+$O_2 \leftrightarrow$ trans-2,3-dehydroacyl-CoA+$H_2O_2$

In some embodiments, acyl CoA oxidase activity refers to oxidation of a long chain fatty-acyl-CoA to a trans-2,3-dehydroacyl-CoA fatty alcohol. In some embodiments, acyl CoA oxidase activity refers to its enzyme activity (or lack thereof) on a selective set of substrates. The activity of an acyl CoA oxidase can be affected by its ability to bind a substrate, oxidize a substrate and/or release a product. In some embodiments, an acyl CoA oxidase is active in one compartment of a cell and not in another compartment of the cell. In some embodiments, the acyl CoA oxidase activity is from a peroxisome. In certain embodiments, the acyl CoA oxidase activity is a peroxisomal acyl CoA oxidase (POX) activity, carried out by a POX polypeptide. In some embodiments the acyl CoA oxidase activity is encoded by the host organism and sometimes can be altered to generate an engineered organism. Acyl-CoA oxidase activity can be encoded by the POX4 and POX5 genes of Candida spp. In certain embodiments, endogenous acyl CoA oxidase activity can be increased. In some embodiments, acyl CoA oxidases in an organism, containing one or more acyl CoA oxidases, can be independently modified (e.g., one or more acyl CoA oxidases can be modified). In some embodiments, acyl CoA oxidase activity of a POX4 polypeptide or a POX5 polypeptide can be altered independently of each other (e.g., increase activity of POX4 alone, POX5 alone, increase one and disrupt the other, and the like). Increasing the activity of one POX activity, while disrupting the activity of another POX activity, may alter the specific activity of acyl CoA oxidase with respect to carbon chain length, while maintaining or increasing overall flux through the beta oxidation pathway, in certain embodiments.

In certain embodiments, host activity of one or more acyl CoA oxidase genes can be increased by genetically altering (e.g., increasing) the amount of a polypeptide produced (e.g., a strongly transcribed or constitutively expressed heterologous promoter is introduced in operable linkage with a polynucleotide that encodes a polypeptide; the copy number of a polynucleotide that encodes the polypeptide is increased (e.g., by introducing a plasmid that includes the polynucleotide, integration of additional copies in the host genome)). In some embodiments, host activity of one or more acyl CoA oxidases can be decreased by disruption (e.g., knockout, insertion mutagenesis, the like and combinations thereof) of an acyl CoA oxidase gene, or by decreasing the activity of the promoter (e.g., addition of repressor sequences to the promoter or 5'UTR) which transcribes an acyl CoA oxidase gene.

As noted above, disruption of nucleotide sequences encoding one or more acyl CoA oxidases (e.g., POX4, POX 5, or POX4 and POX5) sometimes can alter pathway efficiency, specificity and/or specific activity with respect to metabolism of carbon chains of different lengths (e.g., carbon chains including fatty alcohols, fatty acids, paraffins, dicarboxylic acids, aliphatic molecules of between about 1 and about 60 carbons in length). In some embodiments, the nucleotide sequence of one or more acyl CoA oxidases (e.g., POX4, POX 5, or POX4 and POX5) is disrupted with a URA3 nucleotide sequence encoding a selectable marker, and introduced to a host microorganism, thereby generating an engineered organism deficient in an acyl CoA oxidase activity.

Site-Directed Mutagenesis of Candida Pox4 and Pox5 for Altering Substrate Specificity In some embodiments, amino acid residues located in or near the substrate binding pocket (e.g., residues located in helical domain 3 (see TABLE 23) of POX5 are mutated (e.g., deleted or substituted) to alter the activity profile of POX5. In some embodiments amino acid 428 and/or 429 in POX5, or corresponding residues in a related enzyme (e.g., see related enzymes and corresponding residues in TABLE 23) are located in helical domain 3 and independently are mutated (e.g., deleted or substituted) to alter the activity profile of POX5 or a related enzyme. Sometimes amino acid 428 and/or 429 independently are substituted with a suitable amino acid, non-limiting examples of which include positive charged and hydrophilic amino acids (e.g., lysine, arginine or histidine), negative charged and hydrophilic amino acids (e.g., aspartic acid, glutamic acid), sulfur containing amino acids (e.g., serine, threonine, cysteine, methionine), amide containing amino acids (e.g., asparagine, glutamine), aliphatic amino acids (e.g., glycine, alanine, valine, leucine, isoleucine), aromatic amino acid (e.g., phenylalanine, tyrosine, tryptophan), proline, ornithine, selenocystein, taurine, the like, or combinations thereof.

Also as noted above, catalytic specificity of acyl CoA oxidases (e.g., POX4, POX5) can be altered by a variety of methods. Altering the binding and/or catalytic specificity of acyl CoA oxidases may prove advantageous for generating novel acyl CoA oxidases with altered chain length recognition, altered chain length catalytic activity, and/or generation of an acyl CoA oxidase activity with a narrow or specific chain length specificity, thereby allowing further increases in pathway efficiency, specificity and/or specific activity with respect to metabolism of carbon chains of different lengths or metabolism of carbon chain distributions found in a particular chosen feedstock. In some embodiments the altered acyl CoA oxidase sequences are identified and/or generated by: (i) screening naturally occurring variant populations; (ii) mutagenesis of endogenous sequences; (iii) introduction of heterologous sequences having a desired specificity (e.g., introduction of one or more unmodified or modified acyl CoA oxidases from another organism into a host organism in which one or more endogenous acyl-CoA oxidases are optionally disrupted); (iv) generation of chimeric sequences having a portion of the coding sequence from one polynucleotide source (e.g., gene, organism) and a portion of the coding sequence from another source and/or (v) intelligent design using nucleotide sequences and three dimensional structure analysis from an acyl CoA oxidase having a desired specificity to remodel an endogenous acyl CoA oxidase, thereby generating a novel specificity enzyme. In some embodiments a chimeric acyl CoA oxidase sequence can have polynucleotide sequence contributions from two or more sources. In some embodiments, a chimeric acyl CoA oxidase sequence comprises a portion of the coding sequences from an endogenous polynucleotide and a portion of the coding sequence from a heterologous polynucleotide. Described in the examples are methods utilized to identify and/or generate acyl CoA oxidases with novel catalytic and binding specificities.

Nucleic acid sequences encoding acyl CoA oxidases (e.g., POX4 and POX5) can be obtained from any suitable source, including any animal (e.g., mammals, fish, reptiles, amphibians, etc.), any plant, fungus, yeast, protozoan, bacteria, virus, phage, and the like). Non-limiting examples of suitable yeast sources include *Yarrowia* yeast (e.g., *Y. lipolytica* (formerly classified as *Candida lipolytica*)), *Candida* yeast (e.g., *C. revkaufi, C. viswanathii, C. pulcherrima, C. tropicalis, C. utilis*), *Rhodotorula* yeast (e.g., *R. glutinus, R. graminis*), *Rhodosporidium* yeast (e.g., *R. toruloides*), *Saccharomyces* yeast (e.g., *S. cerevisiae, S. bayanus, S. pastorianus, S. carlsbergensis*), *Cryptococcus* yeast, *Trichosporon* yeast (e.g., *T. pullans, T. cutaneum*), *Pichia* yeast (e.g., *P. pastoris*) and *Lipomyces* yeast (e.g., *L. starkeyii, L. lipoferus*). In some embodiments, a suitable yeast is of the genus *Arachniotus, Aspergillus, Aureobasidium, Auxarthron, Blastomyces, Candida, Chrysosporuim, Chrysosporuim Debaryomyces, Coccidiodes, Cryptococcus, Gymnoascus, Hansenula, Histoplasma, Issatchenkia, Kluyveromyces, Lipomyces, Lssatchenkia, Microsporum, Myxotrichum, Myxozyma, Oidiodendron, Pachysolen, Penicillium, Pichia, Rhodosporidium, Rhodotorula, Rhodotorula, Saccharomyces, Schizosaccharomyces, Scopulariopsis, Sepedonium, Trichosporon*, or *Yarrowia*. In some embodiments, a suitable yeast is of the species *Arachniotus flavoluteus, Aspergillus flavus, Aspergillus fumigatus, Aspergillus niger, Aureobasidium pullulans, Auxarthron thaxteri, Blastomyces dermatitidis, Candida albicans, Candida dubliniensis, Candida famata, Candida glabrata, Candida guilliermondii, Candida kefyr, Candida krusei, Candida lambica, Candida lipolytica, Candida lustitaniae, Candida parapsilosis, Candida pulcherrima, Candida revkaufi, Candida rugosa, Candida tropicalis, Candida utilis, Candida viswanathii, Candida xestobii, Chrysosporuim keratinophilum, Coccidiodes immitis, Cryptococcus albidus* var. *diffluens, Cryptococcus laurentii, Cryptococcus neofomans, Debaryomyces hansenii, Gymnoascus dugwayensis, Hansenula anomala, Histoplasma capsulatum, Issatchenkia occidentalis, Isstachenkia orientalis, Kluyveromyces lactis, Kluyveromyces marxianus, Kluyveromyces thermotolerans, Kluyveromyces waltii, Lipomyces lipoferus, Lipomyces starkeyii, Microsporum gypseum, Myxotrichum deflexum, Oidiodendron echinulatum, Pachysolen tannophilus, Penicillium notatum, Pichia anomala, Pichia pastoris, Pichia stipitis, Rhodosporidium toruloides, Rhodotorula glutinus, Rhodotorula graminis, Saccharomyces cerevisiae, Saccharomyces kluyveri, Schizosaccharomyces pombe, Scopulariopsis acremonium, Sepedonium chrysospermum, Trichosporon cutaneum, Trichosporon pullans, Yarrowia lipolytica*, or *Yarrowia lipolytica* (formerly classified as *Candida lipolytica*). In some embodiments, a suitable yeast is a *Y. lipolytica* strain that includes, but is not limited to, ATCC20362, ATCC8862, ATCC18944, ATCC20228, ATCC76982 and LGAM S(7)1 strains (Papanikolaou S., and Aggelis G., Bioresour. Technol. 82(1):43-9 (2002)). In certain embodiments, a suitable yeast is a *Candida* species (i.e., *Candida* spp.) yeast. Any nucleic acid sequence encoding an acyl CoA oxidase, acyl CoA oxidase-like activity or acyl-CoA dehydrogenase activity can be used to alter the substrate specificity of a yeast as described herein. Non-limiting examples of acyl CoA oxidase, acyl CoA oxidase-like and acyl CoA dehydrogenase amino acid sequences and nucleotide sequences are provided herein and in SEQ ID NO. 51 through 3810. Described in the examples are experiments conducted to modify and amplify the activity of an acyl CoA oxidase gene (e.g., the POX5 gene). Percent identity at the amino acid and nucleotide level of POX 4 and POX 5 from *Candida* strain ATCC 20336 and *Yarrowia lipolytica* is shown in the tables below:

|        | POX4 | YlAco2 | YlAco3 | YlAco5 |
|--------|------|--------|--------|--------|
| POX5   | 59.4 | 41.6   | 41.6   | 40.5   |
| POX4   |      | 40.4   | 41.6   | 39.1   |
| YlAco2 |      |        | 66.8   | 61     |
| YlAco3 |      |        |        | 68.8   |

|        | POX4 | YlAco2 | YlAco3 | YlAco5 |
|--------|------|--------|--------|--------|
| POX5   | 68.6 | 54.9   | 53.4   | 52.4   |
| POX4   |      | 55.7   | 55     | 52.4   |
| YlAco2 |      |        | 72.1   | 67.9   |
| YlAco3 |      |        |        | 72.1   |

Presence, absence or amount of acyl CoA oxidase activity can be detected by any suitable method known in the art. For example, enzymatic assays as described in Shimizu et al, 1979, and as described herein in the Examples can be used to assess acyl CoA oxidase activity. Nucleic acid sequences representing native and/or disrupted acyl CoA oxidase sequences also can be detected using nucleic acid detection methods (e.g., PCR, primer extension, nucleic acid hybridization, the like and combinations thereof), or quantitative expression based analysis (e.g., RT-PCR, western blot analysis, northern blot analysis, the like and combinations thereof), where the engineered organism exhibits decreased RNA and/or polypeptide levels as compared to the host organism.

Acyl CoA Dehydrogenase

Acyl-CoA dehydrogenases (ACADs) are a class of enzymes that can function to catalyze the initial step in each cycle of fatty acid β-oxidation in the mitochondria of cells. They can be very similar in structure and function to Acyl CoA oxidases. Their action results in the introduction of a trans double-bond between C2 and C3 of an acyl-CoA thioester substrate. FAD is a required co-factor in the mechanism in order for the enzyme to bind to its appropriate substrate.

Acyl-CoA dehydrogenases can be categorized into four distinct groups based on their specificity for short-, medium-, or long-chain fatty acid, and very long-chain fatty acid acyl-CoA substrates. While different dehydrogenases target fatty acids of varying chain length, all types of acyl-CoA dehydrogenases can be mechanistically similar. Differences in ACADs can occur based on the location of the active site along the amino acid sequence.

The medium chain acyl-CoA dehydrogenase is a homotetramer with each subunit containing roughly 400 amino acids and one equivalent of FAD. The tetramer is classified as a "dimer of dimers".

The interface between the two monomers of a single dimer of an acyl-CoA dehydrogenase contains the FAD binding sites and has extensive bonding interactions. In contrast, the interface between the two dimers has few interactions. There are a total of 4 active sites within the tetramer, each of which contains a single FAD molecule and an acyl-CoA substrate. This gives a total of four FAD molecules and four acyl-CoA substrates per enzymatic molecule.

FAD is bound between the three domains of the monomer, where only the nucleotide portion is accessible. FAD binding contributes significantly to overall enzyme stability. The acyl-CoA substrate is bound completely within each monomer of the enzyme. In some ACADs, the active site is lined with the residues F252, T255, V259, T96, T99, A100, L103, Y375, Y375, and E376. The area of interest within the substrate can become wedged between Glu 376 and FAD, lining up the molecules into an ideal position for the reaction.

Some ACAD sequences are presented in SEQ ID NOs. 3728 through 3810.

Thioesterase

The term "thioesterase activity" as used herein refers to removal of Coenzyme A from hexanoate. The term "thioesterase activity" as used herein also refers to the removal of Coenzyme A from an activated fatty acid (e.g., fatty-acyl-CoA). A Non-limiting example of an enzyme with thioesterase activity includes acyl-CoA hydrolase (e.g., EC 3.1.2.20; also referred to as acyl coenzyme A thioesterase, acyl-CoA thioesterase, acyl coenzyme A hydrolase, thioesterase B, thioesterase II, lecithinase B, lysophopholipase L1, acyl-CoA thioesterase 1, and acyl-CoA thioesterase). Thioesterases that remove Coenzyme A from fatty-acyl-CoA molecules catalyze the reaction,

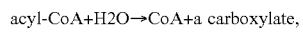

acyl-CoA+H2O→CoA+a carboxylate, where the carboxylate often is a fatty acid. The released Coenzyme A can then be reused for other cellular activities.

The thioesterase activity can be provided by a polypeptide. In certain embodiments, the polypeptide is an endogenous nucleotide sequence that is increased in copy number, operably linked to a heterologous and/or endogenous promoter, or increased in copy number and operably linked to a heterologous and/or endogenous promoter. In some embodiments, the polypeptide is encoded by a heterologous nucleic acid sequence introduced to a host microorganism. Nucleic acid sequences conferring thioesterase activity can be obtained from a number of sources, including *Cuphea lanceolata, C. tropicalis* (e.g., see SEQ ID NOS: 33 and 35), and *E. coli* (e.g., see SEQ ID NO: 37). Additional organisms that can be used as thioesterase polynucleotide sequence donors are given herein. Examples of such polypeptides include, without limitation, acyl-(ACP) thioesterase type B from *Cuphea lanceolata* (see SEQ ID NO: 1), acyl-CoA hydrolase (e.g., ACHA and ACHB, see SEQ ID NOS: 34 and 36)) from *C. tropicalis*, acyl-CoA thioesterase (e.g., TESA, see SEQ ID NO: 38) from *E. coli*. A non-limiting example of a thioesterase polynucleotide sequences is referenced by accession number CAB60830 at the World Wide Web Uniform Resource Locator (URL) ncbi.nlm.nih.gov of the National Center for Biotechnology Information (NCBI).

Presence, absence or amount of thioesterase activity can be detected by any suitable method known in the art. An example of such a method is described Chemistry and Biology 9: 981-988. In some embodiments, thioesterase activity is not altered in a host microorganism, and in certain embodiments, the activity is added or increased in the engineered microorganism relative to the host microorganism. In some embodiments, a polypeptide having thioesterase activity is linked to another polypeptide (e.g., a hexanoate synthase A or hexanoate synthase B polypeptide). Non-limiting examples of polynucleotide sequences encoding thioesterase activities and polypeptides having thioesterase activity are provided in Example 33.

Reducing Omega Fatty Acid Conversion—General

The term "a genetic modification that reduces omega hydroxyl fatty acid conversion" as used herein refer to genetic alterations of a host microorganism that reduce an endogenous activity that converts an omega hydroxyl fatty acid to another product. In some embodiments, an endogenous omega hydroxyl fatty acid dehydrogenase activity is reduced. Such alterations can advantageously increase the amount of a dicarboxylic acid, which can be purified and further processed.

Reducing Beta Oxidation—General

The term "a genetic modification that reduces beta-oxidation activity" as used herein refers to a genetic alteration of a host microorganism that reduces an endogenous activity that oxidizes a beta carbon of carboxylic acid containing organic molecules. In certain embodiments, the organic molecule is a ten or twelve carbon molecule, and sometimes contains one or two carboxylic acid moieties located at a terminus of the molecule (e.g., sebacic or dodecanedioic acid). Such alterations can advantageously increase yields of end products, such as a fatty dicarboxylic acid (e.g., octanedioic acid, decanedioic acid, dodecanedioic acid, tetradecanedioic acid, hexadecanedioic acid, octadecanedioic acid, eicosanedioic acid).

Increasing Fatty Acid Synthesis—General

The term "a genetic modification that results in increased fatty acid synthesis" as used herein also refers to a genetic alteration of a host microorganism that reduces an endogenous activity that converts fatty acids into fatty-acyl-CoA intermediates. In some embodiments, an endogenous activity that converts fatty acids into fatty-acyl-CoA intermediates is reduced. In certain embodiments, an acyl-CoA synthetase activity is reduced. Such alterations can advantageously increase yields of end products, such as a fatty dicarboxylic acid (e.g., octanedioic acid, decanedioic acid, dodecanedioic acid, tetradecanedioic acid, hexadecanedioic acid, octadecanedioic acid, eicosanedioic acid).

Acyl-CoA Synthetase

Fatty acids can be converted into fatty-acyl-CoA intermediates by the activity of an acyl-CoA synthetase (e.g., ACS1, ACS2; EC 6.2.1.3; also referred to as acyl-CoA synthetase, acyl-CoA ligase), in many organisms. Acyl-CoA synthetase has six isoforms encoded by ACS1, FAT1, ACS2A, ACS2B, ACS2C and ACS2D, respectively, in *Candida* spp. (e.g., homologous to FAA1, FAT1, and FAA2 in *S. cerevisiae*). Acyl-CoA synthetase is a member of the ligase class of enzymes and catalyzes the reaction, ATP+Fatty Acid+CoA<=>AMP+Pyrophosphate+
Fatty-Acyl-CoA.

Fatty acids and Coenzyme A often are utilized in the activation of fatty acids to fatty-acyl-CoA intermediates for entry into various cellular processes. Without being limited by theory, it is believed that reduction in the amount of fatty-acyl-CoA available for various cellular processes can increase the amount of fatty acids available for conversion into a fatty dicarboxylic acid (e.g., a sebacic or dodecanedioic acid) by other engineered pathways in the same host organism (e.g., omega oxidation pathway, beta oxidation pathway, omega oxidation pathway and beta oxidation pathway). Acyl-CoA synthetase can be inactivated by any suitable means. Described herein are gene knockout methods suitable for use to disrupt the nucleotide sequence that encodes a polypeptide having ACS1 activity. A nucleotide sequence of ACS1 is provided in Example 33, SEQ ID NO: 39. An example of an integration/disruption construct, configured to generate a deletion mutant for ACS1 is also provided in the Examples.

The presence, absence or amount of acyl-CoA synthetase activity can be detected by any suitable method known in the art. Non-limiting examples of suitable detection methods include enzymatic assays (e.g., Lageweg et al "A Fluorometric Assay for Acyl-CoA Synthetase Activity", Analytical Biochemistry, 197(2):384-388 (1991)), PCR based assays (e.g., qPCR, RT-PCR), immunological detection methods (e.g., antibodies specific for acyl-CoA synthetase), the like and combinations thereof.

The term "a genetic modification that results in increased fatty acid synthesis" as used herein also refers to a genetic alteration of a host microorganism that reduces an endogenous activity that converts long chain and very long chain fatty acids into activated fatty-acyl-CoA intermediates. In some embodiments, an endogenous activity that converts long chain and very long chain fatty acids into activated fatty-acyl-CoA intermediates is reduced. In certain embodiments, a long chain acyl-CoA synthetase activity is reduced. Such alterations can advantageously increase yields of end products, such as a fatty dicarboxylic acid (e.g., octanedioic acid, decanedioic acid, dodecanedioic acid, tetradecanedioic acid, hexadecanedioic acid, octadecanedioic acid, eicosanedioic acid).

Long chain fatty acids (e.g., C12-C18 chain lengths) and very long chain fatty acids (e.g., C20-C26) often are activated and/or transported by the thioesterification activity of a long-chain acyl-CoA synthetase (e.g., FAT1; EC 6.2.1.3; also referred to as long-chain fatty acid-CoA ligase, acyl-CoA synthetase; fatty acid thiokinase (long chain); acyl-activating enzyme; palmitoyl-CoA synthase; lignoceroyl-CoA synthase; arachidonyl-CoA synthetase; acyl coenzyme A synthetase; acyl-CoA ligase; palmitoyl coenzyme A synthetase; thiokinase; palmitoyl-CoA ligase; acyl-coenzyme A ligase; fatty acid CoA ligase; long-chain fatty acyl coenzyme A synthetase; oleoyl-CoA synthetase; stearoyl-CoA synthetase; long chain fatty acyl-CoA synthetase; long-chain acyl CoA synthetase; fatty acid elongase (ELO); LCFA synthetase; pristanoyl-CoA synthetase; ACS3; long-chain acyl-CoA synthetase I; long-chain acyl-CoA synthetase II; fatty acyl-coenzyme A synthetase; long-chain acyl-coenzyme A synthetase; and acid:CoA ligase (AMP-forming)), in some organisms. Fatty acids also can be transported into the host organism from feedstocks by the activity of long chain acyl-CoA synthetase. Long-chain acyl-CoA synthetase catalyzes the reaction, ATP+a long-chain carboxylic acid+CoA=AMP+
diphosphate+an acyl-CoA, where "an acyl-CoA" refers to a fatty-acyl-CoA molecule. As noted herein, activation of fatty acids is often necessary for entry of fatty acids into various cellular processes (e.g., as an energy source, as a component for membrane formation and/or remodeling, as carbon storage molecules). Deletion mutants of FAT1 have been shown to accumulate very long chain fatty acids and exhibit decreased activation of these fatty acids. Without being limited by theory, it is believed that reduction in the activity of long-chain acyl-CoA synthetase may reduce the amount of long chain fatty acids converted into fatty-acyl-CoA intermediates, thereby increasing the amount of fatty acids available for conversion into a fatty dicarboxylic acid (e.g., octanedioic acid, decanedioic acid, dodecanedioic acid, tetradecanedioic acid, hexadecanedioic acid, octadecanedioic acid, eicosanedioic acid) by other engineered pathways in the same host organism (e.g., omega oxidation pathway, beta oxidation pathway, omega oxidation pathway and beta oxidation pathway). Long-chain-acyl-CoA synthetase activity can be reduced or inactivated by any suitable means. Described herein are gene knockout methods suitable for disrupting the nucleotide sequence that encodes the polypeptide having FAT1 activity. The nucleotide sequence of FAT1 is provided in Example 33, SEQ ID NO: 41. DNA vectors suitable for use in constructing "knockout" constructs are described herein.

The presence, absence or amount of long-chain-acyl-CoA synthetase activity can be detected by any suitable method known in the art. Non-limiting examples of suitable detection methods include enzymatic assays, binding assays (e.g., Erland et al, Analytical Biochemistry 295(1):38-44 (2001)), PCR based assays (e.g., qPCR, RTPCR), immunological detection methods (e.g., antibodies specific for long-chain-acyl-CoA synthetase), the like and combinations thereof.

Selective Modification of ACS Activity

In some embodiments, a beta-oxidation pathway is functional and is modified for selective substrate specificity. In some embodiments a beta-oxidation pathway is selective for only diacyl-CoA thioesters and in some embodiments only on diacyl-CoA's of a chain length greater than 6, 8, 10, 12, 14, 16, 18 or 20 carbons. Beta-oxidation selectivity can be achieved by: 1) utilizing the difference in transport of acyl-CoA's and diacids across the peroxisomal membrane, 2) selectively knocking out acyl-CoA synthetase (ACS) activity in the cytosolic compartment, 3) knocking out ACS activity in the peroxisomal compartment for isozymes with substrate specificity for short chain substrates, and/or 4) engineering a beta-oxidation pathway that will work only on substrates longer than 6, 8, 10, 12, 14, 16, 18 or 20 carbons.

In *S. cerevisiae*, cytoplasmic ACS activity is encoded by FAA1, FAA3, FAA4 and FAT1, while peroxisomal activity is encoded by FAA2. Homologs for FAA1 and FAT1 were identified in *Candida* strains however there were no identified homologs for FAA3 or FAA4. As many as five homologs for the *S. cerevisiae* peroxisomal FAA2 were identified in *Candida* strains. Two of the five homologs display 95% identity to one another and are most likely alleles of the same gene. Four FAA2 homologs were identified in *Candida* strain ATCC20336 (e.g., ACS2A through ACS2D).

In some embodiments, one strategy is to control the subcellular location of ACS enzyme activity so that it is only present in the peroxisome. FAA1 and FAT1 mutants, faa1Δ and fat1Δ were constructed and should have very little ACS activity targeted to the cytoplasm. In these mutant strains, exogenously supplied long-chain free fatty acids accumulate in the cytoplasm since they cannot be transported into the peroxisome unless they are activated to the acyl-CoA thioester. High concentrations of free fatty acid can be toxic, so the cell acts to detoxify itself by oxidizing the free fatty acids to dicarboxylic acids that are much less toxic. Unlike long-chain fatty acids, long-chain dicarboxylic acids are able to diffuse into the peroxisomal compartment where they can then be activated to diacyl-CoA thioesters, which is required for entry into the beta-oxidation pathway. With multiple peroxisomal ACS isozymes it may be that each isozyme has different substrate specificity. In some embodiments, it is desired to retain those peroxisomal ACS enzymes with substrate specificity matching the chain-length of the fatty acid feedstock but without activity (or low activity) on diacids of chain-length ≤6, 8, 10, 12, 14, 16, 18 or 20 carbons. With this strategy any long-chain dicarboxyl-CoA that is chain-shortened by beta-oxidation to 12 carbons, for example, that is subsequently hydrolyzed to a dicarboxylic acid and free CoA cannot be reactivated to a dicarboxyl-CoA for re-entry into beta-oxidation for further chain shortening. In some embodiments, in combination with controlling the substrate chain-length specificity of the peroxisomal ACS, a peroxisomal thioesterase activity is amplified with maximum activity at the desired chain-length of our product. This strategy can control the chain-length of the dicarboxylic acid produced by beta-oxidation.

In some embodiments, the flow of fatty acids into the peroxisome is controlled by knocking out the genes PXA1 and PXA2. These genes encode subunits of an ATP binding cassette transporter that is responsible for transporting long-chain fatty acyl-CoA's from the cytoplasm across the peroxisomal membrane into the peroxisomal matrix. Even though, in some embodiments, the genes encoding the cytoplasmic ACS's are knocked out, there may still be some residual ACS activity in the cytoplasm from the peroxisomal ACS's. The ACS isozymes destined for the peroxisome are translated in the cytoplasm and fully folded prior to import into the peroxisome. Therefore the peroxisomal ACS's may contribute to a small amount of cytoplasmic ACS activity. Deletion of the Pxa1p/Pxa2p transporter can prevent any of the long-chain fatty acids activated to acyl-CoA thioesters from being transported into the peroxisome for degradation.

Acyl-CoA Sterol Acyltransferase

The term "a genetic modification that results in increased fatty acid synthesis" as used herein also refers to a genetic alteration of a host microorganism that reduces an endogenous activity that converts fatty acids into cholesterol esters. In some embodiments, an endogenous activity that converts fatty acids into cholesterol esters is reduced. In certain embodiments, an acyl-CoA sterol acyltransferase activity is reduced. Such alterations can advantageously increase yields of end products, such as a fatty dicarboxylic acid (e.g., octanedioic acid, decanedioic acid, dodecanedioic acid, tetradecanedioic acid, hexadecanedioic acid, octadecanedioic acid, eicosanedioic acid).

Fatty acids can be converted into a cholesterol-ester by the activity of acyl-CoA sterol acyltransferase (e.g., ARE1, ARE2, EC 2.3.1.26; also referred to as sterol O-acyltransferase; cholesterol acyltransferase; sterol-ester synthase; sterol-ester synthetase; sterol-ester synthase; acyl coenzyme A-cholesterol-O-acyltransferase; acyl-CoA: cholesterol acyltransferase; ACAT; acylcoenzyme A:cholesterol O-acyltransferase; cholesterol ester synthase; cholesterol ester synthetase; and cholesteryl ester synthetase), in many organisms. Without being limited by any theory, cholesterol esterification may be involved in directing fatty acids away from incorporation into cell membranes and towards storage forms of lipids. Acyl-CoA sterol acyltransferase catalyzes the reaction, acyl-CoA+cholesterol=CoA+cholesterol ester.

The esterification of cholesterol is believed to limit its solubility in cell membrane lipids and thus promotes accumulation of cholesterol ester in the fat droplets (e.g., a form of carbon storage molecule) within cytoplasm. Therefore, without being limited by any theory esterification of cholesterol may cause the accumulation of lipid storage molecules, and disruption of the activity of acyl-CoA sterol acyltransferase may cause an increase in acyl-CoA levels that can be converted into a fatty dicarboxylic acid (e.g., octanedioic acid, decanedioic acid, dodecanedioic acid, tetradecanedioic acid, hexadecanedioic acid, octadecanedioic acid, eicosanedioic acid) by other engineered pathways in the same host organism (e.g., omega oxidation pathway, beta oxidation pathway, omega oxidation pathway and beta oxidation pathway). Acyl-CoA sterol acyltransferase can be inactivated by any suitable means. Described herein are gene knockout methods suitable for disrupting nucleotide sequences that encode polypeptides having ARE1 activity, ARE2 activity or ARE1 activity and ARE2 activity. The nucleotide sequences of ARE1 and ARE2 are provided in Example 33, SEQ ID NOS: 43 and 45. DNA vectors suitable for use in constructing "knockout" constructs are described herein.

The presence, absence or amount of acyl-CoA sterol acyltransferase activity can be detected by any suitable method known in the art. Non-limiting examples of suitable detection methods include enzymatic assays (e.g., Chen et al, Plant Physiology 145:974-984 (2007)), binding assays, PCR based assays (e.g., qPCR, RT-PCR), immunological detection methods (e.g., antibodies specific for long-chain-acyl-CoA synthetase), the like and combinations thereof.

Diacylglycerol Acyltransferase & Acyltransferases

The term "a genetic modification that results in increased fatty acid synthesis" as used herein also refers to a genetic alteration of a host microorganism that reduces an endogenous activity that catalyzes diacylglycerol esterification (e.g., addition of acyl group to a diacylglycerol to form a triacylglycerol). In some embodiments, an endogenous activity that converts diacylglycerol into triacylglycerol is reduced. In certain embodiments, an acyltransferase activity is reduced. In some embodiments a diacylglycerol acyltransferase activity is reduced. In some embodiments a diacylglycerol acyltransferase (e.g., DGA1, EC 23.1.20) activity and an acyltransferase (e.g., LRO1) activity are reduced. Such alterations can advantageously increase yields of end products, such as a fatty dicarboxylic acid (e.g., octanedioic acid, decanedioic acid, dodecanedioic acid, tetradecanedioic acid, hexadecanedioic acid, octadecanedioic acid, eicosanedioic acid).

Diacylglycerol can be converted into triacylglycerol by the activity of diacylglycerol acyltransferase (e.g., DGA1;

EC 2.3.1.20; also referred to as diglyceride acyltransferase; 1,2-diacylglycerol acyltransferase; diacylglycerol acyltransferase; diglyceride O-acyltransferase; palmitoyl-CoA-sn-1,2-diacylglycerol acyltransferase; acyl-CoA: 1,2-diacylglycerol O-acyltransferase and acyl-CoA:1,2-diacyl-sn-glycerol O-acyltransferase), in many organisms. Diacylglycerol acyltransferase catalyzes the reaction,

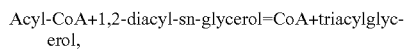

Acyl-CoA+1,2-diacyl-sn-glycerol=CoA+triacylglycerol, and is generally considered the terminal and only committed step in triglyceride synthesis. The product of the DGA1 gene in yeast normally is localized to lipid particles.

In addition to the diacylglycerol esterification activity described for DGA1, many organisms also can generate triglycerides by the activity of other acyltransferase activities, non-limiting examples of which include lecithin-cholesterol acyltransferase activity (e.g., LRO1; EC 2.3.1.43; also referred to as phosphatidylcholine-sterol O-acyltransferase activity; lecithin-cholesterol acyltransferase activity; phospholipid-cholesterol acyltransferase activity; LCAT (lecithin-cholesterol acyltransferase) activity; lecithin:cholesterol acyltransferase activity; and lysolecithin acyltransferase activity) and phospholipid:diacylglycerol acyltransferase (e.g., EC 2.3.1.158; also referred to as PDAT activity and phospholipid:1,2-diacyl-sn-glycerol O-acyltransferase activity). Acyltransferases of the families EC 2.3.1.43 and EC 2.3.1.58 catalyze the general reaction,

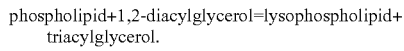

phospholipid+1,2-diacylglycerol=lysophospholipid+triacylglycerol.

Triacylglycerides often are utilized as carbon (e.g., fatty acid or lipid) storage molecules. Without being limited by any theory, it is believe that reducing the activity of acyltransferase may reduce the conversion of diacylglycerol to triacylglycerol, which may cause increased accumulation of fatty acid, in conjunction with additional genetic modifications (e.g., lipase to further remove fatty acids from the glycerol backbone) that can be converted into a fatty dicarboxylic acid (e.g., octanedioic acid, decanedioic acid, dodecanedioic acid, tetradecanedioic acid, hexadecanedioic acid, octadecanedioic acid, eicosanedioic acid) by other engineered pathways in the same host organism (e.g., omega oxidation pathway, beta oxidation pathway, omega oxidation pathway and beta oxidation pathway). Acyltransferases can be inactivated by any suitable means. Described herein are gene knockout methods suitable for disrupting nucleotide sequences that encode polypeptides having DGA1 activity, LRO1 activity or DGA1 activity and LRO1 activity. The nucleotide sequence of DGA1 is provided in Example 33, SEQ ID NO: 47 The nucleotide sequence of LRO1 is provided in Example 33, SEQ ID NO: 49. DNA vectors suitable for use in constructing "knockout" constructs are described herein.

The presence, absence or amount of acyltransferase activity can be detected by any suitable method known in the art. Non-limiting examples of suitable detection methods include enzymatic assays (e.g., Geelen, Analytical Biochemistry 322(2):264-268 (2003), Dahlqvist et al, PNAS 97(12):6487-6492 (2000)), binding assays, PCR based assays (e.g., qPCR, RTPCR), immunological detection methods (e.g., antibodies specific for a DGA1 or LRO1 acyltransferase), the like and combinations thereof.

Polynucleotides and Polypeptides

A nucleic acid (e.g., also referred to herein as nucleic acid reagent, target nucleic acid, target nucleotide sequence, nucleic acid sequence of interest or nucleic acid region of interest) can be from any source or composition, such as DNA, cDNA, gDNA (genomic DNA), RNA, siRNA (short inhibitory RNA), RNAi, tRNA or mRNA, for example, and can be in any form (e.g., linear, circular, supercoiled, single-stranded, double-stranded, and the like). A nucleic acid can also comprise DNA or RNA analogs (e.g., containing base analogs, sugar analogs and/or a non-native backbone and the like). It is understood that the term "nucleic acid" does not refer to or infer a specific length of the polynucleotide chain, thus polynucleotides and oligonucleotides are also included in the definition. Deoxyribonucleotides include deoxyadenosine, deoxycytidine, deoxyguanosine and deoxythymidine. For RNA, the uracil base is uridine.

A nucleic acid sometimes is a plasmid, phage, autonomously replicating sequence (ARS), centromere, artificial chromosome, yeast artificial chromosome (e.g., YAC) or other nucleic acid able to replicate or be replicated in a host cell. In certain embodiments a nucleic acid can be from a library or can be obtained from enzymatically digested, sheared or sonicated genomic DNA (e.g., fragmented) from an organism of interest. In some embodiments, nucleic acid subjected to fragmentation or cleavage may have a nominal, average or mean length of about 5 to about 10,000 base pairs, about 100 to about 1,000 base pairs, about 100 to about 500 base pairs, or about 10, 15, 20, 25, 30, 35, 40, 45, 50, 55, 60, 65, 70, 75, 80, 85, 90, 95, 100, 200, 300, 400, 500, 600, 700, 800, 900, 1000, 2000, 3000, 4000, 5000, 6000, 7000, 8000, 9000 or 10000 base pairs. Fragments can be generated by any suitable method in the art, and the average, mean or nominal length of nucleic acid fragments can be controlled by selecting an appropriate fragment-generating procedure by the person of ordinary skill. In some embodiments, the fragmented DNA can be size selected to obtain nucleic acid fragments of a particular size range.

Nucleic acid can be fragmented by various methods known to the person of ordinary skill, which include without limitation, physical, chemical and enzymic processes. Examples of such processes are described in U.S. Patent Application Publication No. 20050112590 (published on May 26, 2005, entitled "Fragmentation-based methods and systems for sequence variation detection and discovery," naming Van Den Boom et al.). Certain processes can be selected by the person of ordinary skill to generate non-specifically cleaved fragments or specifically cleaved fragments. Examples of processes that can generate non-specifically cleaved fragment sample nucleic acid include, without limitation, contacting sample nucleic acid with apparatus that expose nucleic acid to shearing force (e.g., passing nucleic acid through a syringe needle; use of a French press); exposing sample nucleic acid to irradiation (e.g., gamma, x-ray, UV irradiation; fragment sizes can be controlled by irradiation intensity); boiling nucleic acid in water (e.g., yields about 500 base pair fragments) and exposing nucleic acid to an acid and base hydrolysis process.

Nucleic acid may be specifically cleaved by contacting the nucleic acid with one or more specific cleavage agents. The term "specific cleavage agent" as used herein refers to an agent, sometimes a chemical or an enzyme that can cleave a nucleic acid at one or more specific sites. Specific cleavage agents often will cleave specifically according to a particular nucleotide sequence at a particular site. Examples of enzyme specific cleavage agents include without limitation endonucleases (e.g., DNase (e.g., DNase I, II); RNase (e.g., RNase E, F, H, P); Cleavase™ enzyme; Taq DNA polymerase; E. coli DNA polymerase I and eukaryotic structure-specific endonucleases; murine FEN-1 endonucleases; type I, II or III restriction endonucleases such as Acc I, Afl III, Alu I, Alw44 I, Apa I, Asn I, Ava I, Ava II, BamH I, Ban II, Bcl I, Bgl I. Bgl II, Bln I, Bsm I, BssH II, BstE II, Cfo I, Cla I, Dde I, Dpn I, Dra I, EclX I, EcoR I, EcoR I, EcoR II, EcoR V, Hae II, Hae II, Hind II, Hind III, Hpa I, Hpa II, Kpn I, Ksp I, Mlu I, MIuN I, Msp I, Nci I, Nco I, Nde I, Nde II, Nhe I, Not I, Nru I, Nsi I, Pst I, Pvu I, Pvu II, Rsa I, Sac I, Sal I. Sau3A I, Sca 1, ScrF I, Sfi I, Sma 1, Spe I, Sph 1, Ssp I, Stu I, Sty I, Swa I, Taq I, Xba I, Xho I); glycosylases (e.g., uracil-DNA glycolsylase (UDG), 3-methyladenine DNA glycosylase, 3-methyladenine DNA glycosylase II, pyrimidine hydrate-DNA glycosylase, FaPy-DNA glycosylase, thymine mismatch-DNA glycosylase, hypoxanthine-DNA glycosylase, 5-Hydroxymethyluracil DNA glycosylase (I-ImUDG), 5-Hydroxymethylcytosine DNA glycosylase, or I,N6-etheno-adenine DNA glycosylase); exonucleases (e.g., exonuclease III); ribozymes, and DNAzymes. Sample nucleic acid may be treated with a chemical agent, or synthesized using modified nucleotides, and the modified nucleic acid may be cleaved. In non-limiting examples, sample nucleic acid may be treated with (i) alkylating agents such as methylnitrosourea that generate several alkylated bases, including N3-methyladenine and N3-methylguanine, which are recognized and cleaved by alkyl purine DNA-glycosylase; (ii) sodium bisulfite, which causes deamination of cytosine residues in DNA to form uracil residues that can be cleaved by uracil N-glycosylase; and (iii) a chemical agent that converts guanine to its oxidized form, 8-hydroxyguanine, which can be cleaved by formamidopyrimidine DNA N-glycosylase. Examples of chemical cleavage processes include without limitation alkylation, (e.g., alkylation of phosphorothioate-modified nucleic acid); cleavage of acid lability of P3'-N5'-phosphoroamidate-containing nucleic acid; and osmium tetroxide and piperidine treatment of nucleic acid.

As used herein, the term "complementary cleavage reactions" refers to cleavage reactions that are carried out on the same nucleic acid using different cleavage reagents or by altering the cleavage specificity of the same cleavage reagent such that alternate cleavage patterns of the same target or reference nucleic acid or protein are generated. In certain embodiments, nucleic acids of interest may be treated with one or more specific cleavage agents (e.g., 1, 2, 3, 4, 5, 6, 7, 8, 9, 10 or more specific cleavage agents) in one or more reaction vessels (e.g., nucleic acid of interest is treated with each specific cleavage agent in a separate vessel).

A nucleic acid suitable for use in the embodiments described herein sometimes is amplified by any amplification process known in the art (e.g., PCR, RT-PCR and the like). Nucleic acid amplification may be particularly beneficial when using organisms that are typically difficult to culture (e.g., slow growing, require specialize culture conditions and the like). The terms "amplify", "amplification", "amplification reaction", or "amplifying" as used herein refer to any in vitro processes for multiplying the copies of a target sequence of nucleic acid. Amplification sometimes refers to an "exponential" increase in target nucleic acid. However, "amplifying" as used herein can also refer to linear increases in the numbers of a select target sequence of nucleic acid, but is different than a one-time, single primer extension step. In some embodiments, a limited amplification reaction, also known as pre-amplification, can be performed. Pre-amplification is a method in which a limited amount of amplification occurs due to a small number of cycles, for example 10 cycles, being performed. Pre-amplification can allow some amplification, but stops amplification prior to the exponential phase, and typically produces about 500 copies of the desired nucleotide sequence(s). Use of pre-amplification may also limit inaccuracies associated with depleted reactants in standard PCR reactions.

In some embodiments, a nucleic acid reagent sometimes is stably integrated into the chromosome of the host organism, or a nucleic acid reagent can be a deletion of a portion of the host chromosome, in certain embodiments (e.g., genetically modified organisms, where alteration of the host genome confers the ability to selectively or preferentially maintain the desired organism carrying the genetic modification). Such nucleic acid reagents (e.g., nucleic acids or genetically modified organisms whose altered genome confers a selectable trait to the organism) can be selected for their ability to guide production of a desired protein or nucleic acid molecule. When desired, the nucleic acid reagent can be altered such that codons encode for (i) the same amino acid, using a different tRNA than that specified in the native sequence, or (ii) a different amino acid than is normal, including unconventional or unnatural amino acids (including detectably labeled amino acids). As described herein, the term "native sequence" refers to an unmodified nucleotide sequence as found in its natural setting (e.g., a nucleotide sequence as found in an organism).

A nucleic acid or nucleic acid reagent can comprise certain elements often selected according to the intended use of the nucleic acid. Any of the following elements can be included in or excluded from a nucleic acid reagent. A nucleic acid reagent, for example, may include one or more or all of the following nucleotide elements: one or more promoter elements, one or more 5' untranslated regions (5'UTRs), one or more regions into which a target nucleotide sequence may be inserted (an "insertion element"), one or more target nucleotide sequences, one or more 3' untranslated regions (3'UTRs), and one or more selection elements. A nucleic acid reagent can be provided with one or more of such elements and other elements may be inserted into the nucleic acid before the nucleic acid is introduced into the desired organism. In some embodiments, a provided nucleic acid reagent comprises a promoter, 5'UTR, optional 3'UTR and insertion element(s) by which a target nucleotide sequence is inserted (i.e., cloned) into the nucleotide acid reagent. In certain embodiments, a provided nucleic acid reagent comprises a promoter, insertion element(s) and optional 3'UTR, and a 5' UTR/target nucleotide sequence is inserted with an optional 3'UTR. The elements can be arranged in any order suitable for expression in the chosen expression system (e.g., expression in a chosen organism, or expression in a cell free system, for example), and in some embodiments a nucleic acid reagent comprises the following elements in the 5' to 3' direction: (1) promoter element, 5'UTR, and insertion element(s); (2) promoter element, 5'UTR, and target nucleotide sequence; (3) promoter element, 5'UTR, insertion element(s) and 3'UTR; and (4) promoter element, 5'UTR, target nucleotide sequence and 3'UTR.

Promoters

A promoter element typically is required for DNA synthesis and/or RNA synthesis. A promoter element often comprises a region of DNA that can facilitate the transcription of a particular gene, by providing a start site for the synthesis of RNA corresponding to a gene. Promoters generally are located near the genes they regulate, are located upstream of the gene (e.g., 5' of the gene), and are on the same strand of DNA as the sense strand of the gene, in some embodiments. In some embodiments, a promoter element can be isolated from a gene or organism and inserted in functional connection with a polynucleotide sequence to allow altered and/or regulated expression. A non-native promoter (e.g., promoter not normally associated with a given nucleic acid sequence) used for expression of a nucleic acid often is referred to as a heterologous promoter. In certain embodiments, a heterologous promoter and/or a 5'UTR can be inserted in functional connection with a polynucleotide that encodes a polypeptide having a desired activity as described herein. The terms "operably linked" and "in functional connection with" as used herein with respect to promoters, refer to a relationship between a coding sequence and a promoter element. The promoter is operably linked or in functional connection with the coding sequence when expression from the coding sequence via transcription is regulated, or controlled by, the promoter element. The terms "operably linked" and "in functional connection with" are utilized interchangeably herein with respect to promoter elements.

A promoter often interacts with a RNA polymerase. A polymerase is an enzyme that catalyzes synthesis of nucleic acids using a preexisting nucleic acid reagent. When the template is a DNA template, an RNA molecule is transcribed before protein is synthesized. Enzymes having polymerase activity suitable for use in the present methods include any polymerase that is active in the chosen system with the chosen template to synthesize protein. In some embodiments, a promoter (e.g., a heterologous promoter) also referred to herein as a promoter element, can be operably linked to a nucleotide sequence or an open reading frame (ORF). Transcription from the promoter element can catalyze the synthesis of an RNA corresponding to the nucleotide sequence or ORF sequence operably linked to the promoter, which in turn leads to synthesis of a desired peptide, polypeptide or protein.

Promoter elements sometimes exhibit responsiveness to regulatory control. Promoter elements also sometimes can be regulated by a selective agent. That is, transcription from promoter elements sometimes can be turned on, turned off, up-regulated or down-regulated, in response to a change in environmental, nutritional or internal conditions or signals (e.g., heat inducible promoters, light regulated promoters, feedback regulated promoters, hormone influenced promoters, tissue specific promoters, oxygen and pH influenced promoters, promoters that are responsive to selective agents (e.g., kanamycin) and the like, for example). Promoters influenced by environmental, nutritional or internal signals frequently are influenced by a signal (direct or indirect) that binds at or near the promoter and increases or decreases expression of the target sequence under certain conditions.

Non-limiting examples of selective or regulatory agents that can influence transcription from a promoter element used in embodiments described herein include, without limitation, (1) nucleic acid segments that encode products that provide resistance against otherwise toxic compounds (e.g., antibiotics); (2) nucleic acid segments that encode products that are otherwise lacking in the recipient cell (e.g., essential products, tRNA genes, auxotrophic markers); (3) nucleic acid segments that encode products that suppress the activity of a gene product; (4) nucleic acid segments that encode products that can be readily identified (e.g., phenotypic markers such as antibiotics (e.g., β-lactamase), β-galactosidase, green fluorescent protein (GFP), yellow fluorescent protein (YFP), red fluorescent protein (RFP), cyan fluorescent protein (CFP), and cell surface proteins); (5) nucleic acid segments that bind products that are otherwise detrimental to cell survival and/or function; (6) nucleic acid segments that otherwise inhibit the activity of any of the nucleic acid segments described in Nos. 1-5 above (e.g., antisense oligonucleotides); (7) nucleic acid segments that bind products that modify a substrate (e.g., restriction endonucleases); (8) nucleic acid segments that can be used to isolate or identify a desired molecule (e.g., specific protein binding sites); (9) nucleic acid segments that encode a specific nucleotide sequence that can be otherwise non-functional (e.g., for PCR amplification of subpopulations of molecules); (10) nucleic acid segments that, when absent, directly or indirectly confer resistance or sensitivity to particular compounds; (11) nucleic acid segments that encode products that either are toxic or convert a relatively non-toxic compound to a toxic compound (e.g., Herpes simplex thymidine kinase, cytosine deaminase) in recipient cells; (12) nucleic acid segments that inhibit replication, partition or heritability of nucleic acid molecules that contain them; and/or (13) nucleic acid segments that encode conditional replication functions, e.g., replication in certain hosts or host cell strains or under certain environmental conditions (e.g., temperature, nutritional conditions, and the like). In some embodiments, the regulatory or selective agent can be added to change the existing growth conditions to which the organism is subjected (e.g., growth in liquid culture, growth in a fermenter, growth on solid nutrient plates and the like for example).

In some embodiments, regulation of a promoter element can be used to alter (e.g., increase, add, decrease or substantially eliminate) the activity of a peptide, polypeptide or protein (e.g., enzyme activity for example). For example, a microorganism can be engineered by genetic modification to express a nucleic acid reagent that can add a novel activity (e.g., an activity not normally found in the host organism) or increase the expression of an existing activity by increasing transcription from a homologous or heterologous promoter operably linked to a nucleotide sequence of interest (e.g., homologous or heterologous nucleotide sequence of interest), in certain embodiments. In some embodiments, a microorganism can be engineered by genetic modification to express a nucleic acid reagent that can decrease expression of an activity by decreasing or substantially eliminating transcription from a homologous or heterologous promoter operably linked to a nucleotide sequence of interest, in certain embodiments.

In some embodiments the activity can be altered using recombinant DNA and genetic techniques known to the artisan. Methods for engineering microorganisms are further described herein. Tables herein provide non-limiting lists of yeast promoters that are up-regulated by oxygen, yeast promoters that are down-regulated by oxygen, yeast transcriptional repressors and their associated genes, DNA binding motifs as determined using the MEME sequence analysis software. Potential regulator binding motifs can be identified using the program MEME to search intergenic regions bound by regulators for overrepresented sequences. For each regulator, the sequences of intergenic regions bound with p-values less than 0.001 were extracted to use as input for motif discovery. The MEME software was run using the following settings: a motif width ranging from 6 to 18 bases, the "zoops" distribution model, a $6^{th}$ order Markov background model and a discovery limit of 20 motifs. The discovered sequence motifs were scored for significance by two criteria: an E-value calculated by MEME and a specificity score. The motif with the best score using each metric is shown for each regulator. All motifs presented are derived from datasets generated in rich growth conditions with the exception of a previously published dataset for epitope-tagged Gal4 grown in galactose.

In some embodiments, the altered activity can be found by screening the organism under conditions that select for the desired change in activity. For example, certain microorganisms can be adapted to increase or decrease an activity by selecting or screening the organism in question on a media containing substances that are poorly metabolized or even toxic. An increase in the ability of an organism to grow a substance that is normally poorly metabolized may result in an increase in the growth rate on that substance, for example. A decrease in the sensitivity to a toxic substance might be manifested by growth on higher concentrations of the toxic substance, for example. Genetic modifications that are identified in this manner sometimes are referred to as naturally occurring mutations or the organisms that carry them can sometimes be referred to as naturally occurring mutants. Modifications obtained in this manner are not limited to alterations in promoter sequences. That is, screening microorganisms by selective pressure, as described above, can yield genetic alterations that can occur in non-promoter sequences, and sometimes also can occur in sequences that are not in the nucleotide sequence of interest, but in a related nucleotide sequences (e.g., a gene involved in a different step of the same pathway, a transport gene, and the like). Naturally occurring mutants sometimes can be found by isolating naturally occurring variants from unique environments, in some embodiments.

Homology and Identity

In addition to the regulated promoter sequences, regulatory sequences, and coding polynucleotides provided herein, a nucleic acid reagent may include a polynucleotide sequence 80% or more identical to the foregoing (or to the complementary sequences). That is, a nucleotide sequence that is at least 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more identical to a nucleotide sequence described herein can be utilized. The term "identical" as used herein refers to two or more nucleotide sequences having substantially the same nucleotide sequence when compared to each other. One test for determining whether two nucleotide sequences or amino acids sequences are substantially identical is to determine the percent of identical nucleotide sequences or amino acid sequences shared.

Calculations of sequence identity can be performed as follows. Sequences are aligned for optimal comparison purposes (e.g., gaps can be introduced in one or both of a first and a second amino acid or nucleic acid sequence for optimal alignment and non-homologous sequences can be disregarded for comparison purposes). The length of a reference sequence aligned for comparison purposes is sometimes 30% or more, 40% or more, 50% or more, often 60% or more, and more often 70% or more, 80% or more, 90% or more, or 100% of the length of the reference sequence. The nucleotides or amino acids at corresponding nucleotide or polypeptide positions, respectively, are then compared among the two sequences. When a position in the first sequence is occupied by the same nucleotide or amino acid as the corresponding position in the second sequence, the nucleotides or amino acids are deemed to be identical at that position. The percent identity between the two sequences is a function of the number of identical positions shared by the sequences, taking into account the number of gaps, and the length of each gap, introduced for optimal alignment of the two sequences.

Comparison of sequences and determination of percent identity between two sequences can be accomplished using a mathematical algorithm. Percent identity between two amino acid or nucleotide sequences can be determined using the algorithm of Meyers & Miller, CABIOS 4: 11-17 (1989), which has been incorporated into the ALIGN program (version 2.0), using a PAM120 weight residue table, a gap length penalty of 12 and a gap penalty of 4. Also, percent identity between two amino acid sequences can be determined using the Needleman & Wunsch, J. Mol. Biol. 48: 444-453 (1970) algorithm which has been incorporated into the GAP program in the GCG software package (available at the http address www.gcg.com), using either a Blossum 62 matrix or a PAM250 matrix, and a gap weight of 16, 14, 12, 10, 8, 6, or 4 and a length weight of 1, 2, 3, 4, 5, or 6. Percent identity between two nucleotide sequences can be determined using the GAP program in the GCG software package (available at http address www.gcg.com), using a NWSgapdna.CMP matrix and a gap weight of 40, 50, 60, 70, or 80 and a length weight of 1, 2, 3, 4, 5, or 6. A set of parameters often used is a Blossum 62 scoring matrix with a gap open penalty of 12, a gap extend penalty of 4, and a frameshift gap penalty of 5.

Sequence identity can also be determined by hybridization assays conducted under stringent conditions. As use herein, the term "stringent conditions" refers to conditions for hybridization and washing. Stringent conditions are known to those skilled in the art and can be found in Current Protocols in Molecular Biology, John Wiley & Sons, N.Y., 6.3.1-6.3.6 (1989). Aqueous and non-aqueous methods are described in that reference and either can be used. An example of stringent hybridization conditions is hybridization in 6× sodium chloride/sodium citrate (SSC) at about 45° C., followed by one or more washes in 0.2×SSC, 0.1% SDS at 50° C. Another example of stringent hybridization conditions are hybridization in 6× sodium chloride/sodium citrate (SSC) at about 45° C., followed by one or more washes in 0.2×SSC, 0.1% SDS at 55° C. A further example of stringent hybridization conditions is hybridization in 6× sodium chloride/sodium citrate (SSC) at about 45° C., followed by one or more washes in 0.2×SSC, 0.1% SDS at 60° C. Often, stringent hybridization conditions are hybridization in 6× sodium chloride/sodium citrate (SSC) at about 45° C., followed by one or more washes in 0.2×SSC, 0.1% SDS at 65° C. More often, stringency conditions are 0.5M sodium phosphate, 7% SDS at 65° C., followed by one or more washes at 0.2×SSC, 1% SDS at 65° C.

UTRs

As noted above, nucleic acid reagents may also comprise one or more 5' UTR's, and one or more 3'UTR's. A 5' UTR may comprise one or more elements endogenous to the nucleotide sequence from which it originates, and sometimes includes one or more exogenous elements. A 5' UTR can originate from any suitable nucleic acid, such as genomic DNA, plasmid DNA, RNA or mRNA, for example, from any suitable organism (e.g., virus, bacterium, yeast, fungi, plant, insect or mammal). The artisan may select appropriate elements for the 5' UTR based upon the chosen expression system (e.g., expression in a chosen organism, or expression in a cell free system, for example). A 5' UTR sometimes comprises one or more of the following elements known to the artisan: enhancer sequences (e.g., transcriptional or translational), transcription initiation site, transcription factor binding site, translation regulation site, translation initiation site, translation factor binding site, accessory protein binding site, feedback regulation agent binding sites, Pribnow box, TATA box, -35 element, E-box (helix-loophelix binding element), ribosome binding site, replicon, internal ribosome entry site (IRES), silencer element and the like. In some embodiments, a promoter element may be isolated such that all 5' UTR elements necessary for proper conditional regulation are contained in the promoter element fragment, or within a functional subsequence of a promoter element fragment.

A 5'UTR in the nucleic acid reagent can comprise a translational enhancer nucleotide sequence. A translational enhancer nucleotide sequence often is located between the promoter and the target nucleotide sequence in a nucleic acid reagent. A translational enhancer sequence often binds to a ribosome, sometimes is an 18S rRNA-binding ribonucleotide sequence (i.e., a 40S ribosome binding sequence) and sometimes is an internal ribosome entry sequence (IRES). An IRES generally forms an RNA scaffold with precisely placed RNA tertiary structures that contact a 40S ribosomal subunit via a number of specific intermolecular interactions. Examples of ribosomal enhancer sequences are known and can be identified by the artisan (e.g., Mignone et al., Nucleic Acids Research 33: D141-D146 (2005); Paulous et al., Nucleic Acids Research 31: 722-733 (2003); Akbergenov et al., Nucleic Acids Research 32: 239-247 (2004); Mignone et al., Genome Biology 3(3): reviews0004.1-0001.10 (2002); Gallie, Nucleic Acids Research 30: 3401-3411 (2002); Shaloiko et al., http address www.interscience.wiley.com, DOI: 10.1002/bit.20267; and Gallie et al., Nucleic Acids Research 15: 3257-3273 (1987)).

A translational enhancer sequence sometimes is a eukaryotic sequence, such as a Kozak consensus sequence or other sequence (e.g., hydroid polyp sequence, GenBank accession no. U07128). A translational enhancer sequence sometimes is a prokaryotic sequence, such as a Shine-Dalgarno consensus sequence. In certain embodiments, the translational enhancer sequence is a viral nucleotide sequence. A translational enhancer sequence sometimes is from a 5' UTR of a plant virus, such as Tobacco Mosaic Virus (TMV), Alfalfa Mosaic Virus (AMV); Tobacco Etch Virus (ETV); Potato Virus Y (PVY); Turnip Mosaic (poty) Virus and Pea Seed Borne Mosaic Virus, for example. In certain embodiments, an omega sequence about 67 bases in length from TMV is included in the nucleic acid reagent as a translational enhancer sequence (e.g., devoid of guanosine nucleotides and includes a 25 nucleotide long poly (CAA) central region).

A 3' UTR may comprise one or more elements endogenous to the nucleotide sequence from which it originates and sometimes includes one or more exogenous elements. A 3' UTR may originate from any suitable nucleic acid, such as genomic DNA, plasmid DNA, RNA or mRNA, for example, from any suitable organism (e.g., a virus, bacterium, yeast, fungi, plant, insect or mammal). The artisan can select appropriate elements for the 3' UTR based upon the chosen expression system (e.g., expression in a chosen organism, for example). A 3' UTR sometimes comprises one or more of the following elements known to the artisan: transcription regulation site, transcription initiation site, transcription termination site, transcription factor binding site, translation regulation site, translation termination site, translation initiation site, translation factor binding site, ribosome binding site, replicon, enhancer element, silencer element and polyadenosine tail. A 3' UTR often includes a polyadenosine tail and sometimes does not, and if a polyadenosine tail is present, one or more adenosine moieties may be added or deleted from it (e.g., about 5, about 10, about 15, about 20, about 25, about 30, about 35, about 40, about 45 or about 50 adenosine moieties may be added or subtracted).

In some embodiments, modification of a 5' UTR and/or a 3' UTR can be used to alter (e.g., increase, add, decrease or substantially eliminate) the activity of a promoter. Alteration of the promoter activity can in turn alter the activity of a peptide, polypeptide or protein (e.g., enzyme activity for example), by a change in transcription of the nucleotide sequence(s) of interest from an operably linked promoter element comprising the modified 5' or 3' UTR. For example, a microorganism can be engineered by genetic modification to express a nucleic acid reagent comprising a modified 5' or 3' UTR that can add a novel activity (e.g., an activity not normally found in the host organism) or increase the expression of an existing activity by increasing transcription from a homologous or heterologous promoter operably linked to a nucleotide sequence of interest (e.g., homologous or heterologous nucleotide sequence of interest), in certain embodiments. In some embodiments, a microorganism can be engineered by genetic modification to express a nucleic acid reagent comprising a modified 5' or 3' UTR that can decrease the expression of an activity by decreasing or substantially eliminating transcription from a homologous or heterologous promoter operably linked to a nucleotide sequence of interest, in certain embodiments.

Target Nucleotide Sequence

A nucleotide reagent sometimes can comprise a target nucleotide sequence. A "target nucleotide sequence" as used herein encodes a nucleic acid, peptide, polypeptide or protein of interest, and may be a ribonucleotide sequence or a deoxyribonucleotide sequence. A target nucleic acid sometimes is an untranslated ribonucleic acid and sometimes is a translated ribonucleic acid. An untranslated ribonucleic acid may include, but is not limited to, a small interfering ribonucleic acid (siRNA), a short hairpin ribonucleic acid (shRNA), other ribonucleic acid capable of RNA interference (RNAi), an antisense ribonucleic acid, or a ribozyme. A translatable target nucleotide sequence (e.g., a target ribonucleotide sequence) sometimes encodes a peptide, polypeptide or protein, which are sometimes referred to herein as "target peptides," "target polypeptides" or "target proteins."

Any peptides, polypeptides or proteins, or an activity catalyzed by one or more peptides, polypeptides or proteins may be encoded by a target nucleotide sequence and may be selected by a user. Representative proteins include enzymes (e.g., acetyl-CoA carboxylase, acyl-CoA oxidase, thioesterase, monooxygenase, monooxygenase reductase, fatty alcohol oxidase, acyltransferase and the like, for example), antibodies, serum proteins (e.g., albumin), membrane bound proteins, hormones (e.g., growth hormone, erythropoietin, insulin, etc.), cytokines, etc., and include both naturally occurring and exogenously expressed polypeptides. Representative activities (e.g., enzymes or combinations of enzymes which are functionally associated to provide an activity) include thioesterase activity, monooxygenase activity, monooxygenase reductase activity, acyltransferase activity, omega hydroxyl fatty acid dehydrogenase activity, beta-oxidation activity, omega-oxidation activity and the like, for example. The term "enzyme" as used herein refers to a protein which can act as a catalyst to induce a chemical change in other compounds, thereby producing one or more products from one or more substrates.

Specific polypeptides (e.g., enzymes) useful for embodiments described herein are listed herein. The term "protein" as used herein refers to a molecule having a sequence of amino acids linked by peptide bonds. This term includes fusion proteins, oligopeptides, peptides, cyclic peptides, polypeptides and polypeptide derivatives, whether native or recombinant, and also includes fragments, derivatives, homologs, and variants thereof. A protein or polypeptide sometimes is of intracellular origin (e.g., located in the nucleus, cytosol, or interstitial space of host cells in vivo) and sometimes is a cell membrane protein in vivo. In some embodiments (described above, and in further detail hereafter in Engineering and Alteration Methods), a genetic modification can result in a modification (e.g., increase, substantially increase, decrease or substantially decrease) of a target activity.

A translatable nucleotide sequence generally is located between a start codon (AUG in ribonucleic acids and ATG in deoxyribonucleic acids) and a stop codon (e.g., UAA (ochre), UAG (amber) or UGA (opal) in ribonucleic acids and TAA, TAG or TGA in deoxyribonucleic acids), and sometimes is referred to herein as an "open reading frame" (ORF). A translatable nucleotide sequence (e.g., ORF) sometimes is encoded differently in one organism (e.g., most organisms encode CTG as leucine) than in another organism (e.g., *C. tropicalis* encodes CTG as serine). In some embodiments, a translatable nucleotide sequence is altered to correct alternate genetic code (e.g., codon usage) differences between a nucleotide donor organism and an nucleotide recipient organism (e.g., engineered organism). In certain embodiments, a translatable nucleotide sequence is altered to improve; (i) codon usage, (ii) transcriptional efficiency, (iii) translational efficiency, (iv) the like, and combinations thereof.

Nucleic Acid Reagents & Tools

A nucleic acid reagent sometimes comprises one or more ORFs. An ORF may be from any suitable source, sometimes from genomic DNA, mRNA, reverse transcribed RNA or complementary DNA (cDNA) or a nucleic acid library comprising one or more of the foregoing, and is from any organism species that contains a nucleic acid sequence of interest, protein of interest, or activity of interest. Non-limiting examples of organisms from which an ORF can be obtained include bacteria, yeast, fungi, human, insect, nematode, bovine, equine, canine, feline, rat or mouse, for example.

A nucleic acid reagent sometimes comprises a nucleotide sequence adjacent to an ORF that is translated in conjunction with the ORF and encodes an amino acid tag. The tag-encoding nucleotide sequence is located 3' and/or 5' of an ORF in the nucleic acid reagent, thereby encoding a tag at the C-terminus or N-terminus of the protein or peptide encoded by the ORF. Any tag that does not abrogate in vitro transcription and/or translation may be utilized and may be appropriately selected by the artisan. Tags may facilitate isolation and/or purification of the desired ORF product from culture or fermentation media A tag sometimes specifically binds a molecule or moiety of a solid phase or a detectable label, for example, thereby having utility for isolating, purifying and/or detecting a protein or peptide encoded by the ORF. In some embodiments, a tag comprises one or more of the following elements: FLAG (e.g., DYKDDDDKG) (SEQ ID NO: 3814), V5 (e.g., GKPIPNPLLGLDST) (SEQ ID NO: 3815), c-MYC (e.g., EQKLISEEDL) (SEQ ID NO: 3816), HSV (e.g., QPELAPEDPED) (SEQ ID NO: 3817), influenza hemaglutinin, HA (e.g., YPYDVPDYA) (SEQ ID NO: 3818), VSV-G (e.g., YTDIEMNRLGK) (SEQ ID NO: 3819), bacterial glutathione-S-transferase, maltose binding protein, a streptavidin- or avidin-binding tag (e.g., pcDNA™6 BioEase™ Gateway® Biotinylation System (Invitrogen)), thioredoxin, β-galactosidase, VSV-glycoprotein, a fluorescent protein (e.g., green fluorescent protein or one of its many color variants (e.g., yellow, red, blue)), a polylysine or polyarginine sequence, a polyhistidine sequence (e.g., His6) (SEQ ID NO: 3820) or other sequence that chelates a metal (e.g., cobalt, zinc, copper), and/or a cysteine-rich sequence that binds to an arsenic-containing molecule. In certain embodiments, a cysteine-rich tag comprises the amino acid sequence CC-Xn-CC (SEQ ID NO: 3821), wherein X is any amino acid and n is 1 to 3, and the cysteine-rich sequence sometimes is CCPGCC (SEQ ID NO: 3822). In certain embodiments, the tag comprises a cysteine-rich element and a polyhistidine element (e.g., CCPGCC (SEQ ID NO: 3822) and His6 (SEQ ID NO: 3820)).

A tag often conveniently binds to a binding partner. For example, some tags bind to an antibody (e.g., FLAG) and sometimes specifically bind to a small molecule. For example, a polyhistidine tag specifically chelates a bivalent metal, such as copper, zinc and cobalt; a polylysine or polyarginine tag specifically binds to a zinc finger; a glutathione S-transferase tag binds to glutathione; and a cysteine-rich tag specifically binds to an arsenic-containing molecule. Arsenic-containing molecules include LUMIO™ agents (Invitrogen, California), such as FlAsH™ (EDT2[4',5'-bis(1,3, 2-dithioarsolan-2-yl)fluorescein-(1,2-ethanedithiol)2]) and ReAsH reagents (e.g., U.S. Pat. No. 5,932,474 to Tsien et al., entitled "Target Sequences for Synthetic Molecules;" U.S. Pat. No. 6,054,271 to Tsien et al., entitled "Methods of Using Synthetic Molecules and Target Sequences;" U.S. Pat. Nos. 6,451,569 and 6,008,378; published U.S. Patent Application 2003/0083373, and published PCT Patent Application WO 99/21013, all to Tsien et al. and all entitled "Synthetic Molecules that Specifically React with Target Sequences"). Such antibodies and small molecules sometimes are linked to a solid phase for convenient isolation of the target protein or target peptide.

A tag sometimes comprises a sequence that localizes a translated protein or peptide to a component in a system, which is referred to as a "signal sequence" or "localization signal sequence" herein. A signal sequence often is incorporated at the N-terminus of a target protein or target peptide, and sometimes is incorporated at the C-terminus. Examples of signal sequences are known to the artisan, are readily incorporated into a nucleic acid reagent, and often are selected according to the organism in which expression of the nucleic acid reagent is performed. A signal sequence in some embodiments localizes a translated protein or peptide to a cell membrane. Examples of signal sequences include, but are not limited to, a nucleus targeting signal (e.g., steroid receptor sequence and N-terminal sequence of SV40 virus large T antigen); mitochondrial targeting signal (e.g., amino acid sequence that forms an amphipathic helix); peroxisome targeting signal (e.g., C-terminal sequence in YFG from *S.cerevisiae*); and a secretion signal (e.g., N-terminal sequences from invertase, mating factor alpha, PHO5 and SUC2 in *S.cerevisiae*; multiple N-terminal sequences of *B. subtilis* proteins (e.g., Tjalsma et al., Microbiol. Molec. Biol. Rev. 64: 515-547 (2000)); alpha amylase signal sequence (e.g., U.S. Pat. No. 6,288,302); pectate lyase signal sequence (e.g., U.S. Pat. No. 5,846,818); precollagen signal sequence (e.g., U.S. Pat. No. 5,712,114); OmpA signal sequence (e.g., U.S. Pat. No. 5,470,719); lam beta signal sequence (e.g., U.S. Pat. No. 5,389,529); *B. brevis* signal sequence (e.g., U.S. Pat. No. 5,232,841); and *P. pastoris* signal sequence (e.g., U.S. Pat. No. 5,268,273)).

A tag sometimes is directly adjacent to the amino acid sequence encoded by an ORF (i.e., there is no intervening sequence) and sometimes a tag is substantially adjacent to an ORF encoded amino acid sequence (e.g., an intervening sequence is present). An intervening sequence sometimes includes a recognition site for a protease, which is useful for cleaving a tag from a target protein or peptide. In some embodiments, the intervening sequence is cleaved by Factor Xa (e.g., recognition site I (E/D)GR), thrombin (e.g., recognition site LVPRGS (SEQ ID NO: 3823)), enterokinase (e.g., recognition site DDDDK (SEQ ID NO: 3824)), TEV protease (e.g., recognition site ENLYFQG (SEQ ID NO: 3825)) or PreScission™ protease (e.g., recognition site LEVLFQGP (SEQ ID NO: 3826)), for example.

An intervening sequence sometimes is referred to herein as a "linker sequence," and may be of any suitable length selected by the artisan. A linker sequence sometimes is about 1 to about 20 amino acids in length, and sometimes about 5 to about 10 amino acids in length. The artisan may select the linker length to substantially preserve target protein or peptide function (e.g., a tag may reduce target protein or peptide function unless separated by a linker), to enhance disassociation of a tag from a target protein or peptide when a protease cleavage site is present (e.g., cleavage may be enhanced when a linker is present), and to enhance interaction of a tag/target protein product with a solid phase. A linker can be of any suitable amino acid content, and often comprises a higher proportion of amino acids having relatively short side chains (e.g., glycine, alanine, serine and threonine).

A nucleic acid reagent sometimes includes a stop codon between a tag element and an insertion element or ORF, which can be useful for translating an ORF with or without the tag. Mutant tRNA molecules that recognize stop codons (described above) suppress translation termination and thereby are designated "suppressor tRNAs." Suppressor tRNAs can result in the insertion of amino acids and continuation of translation past stop codons (e.g., U.S. Patent Application No. 60/587,583, filed Jul. 14, 2004, entitled "Production of Fusion Proteins by Cell-Free Protein Synthesis,"; Eggertsson, et al., (1988) Microbiological Review 52(3):354-374, and Engleerg-Kukla, et al. (1996) in *Escherichia coli* and *Salmonella* Cellular and Molecular Biology, Chapter 60, pps 909-921, Neidhardt, et al. eds., ASM Press, Washington, D.C.). A number of suppressor tRNAs are known, including but not limited to, supE, supP, supD, supF and supZ suppressors, which suppress the termination of translation of the amber stop codon; supB, glT, supL, supN, supC and supM suppressors, which suppress the function of the ochre stop codon and glyT, trpT and Su-9 suppressors, which suppress the function of the opal stop codon. In general, suppressor tRNAs contain one or more mutations in the anti-codon loop of the tRNA that allows the tRNA to base pair with a codon that ordinarily functions as a stop codon. The mutant tRNA is charged with its cognate amino acid residue and the cognate amino acid residue is inserted into the translating polypeptide when the stop codon is encountered. Mutations that enhance the efficiency of termination suppressors (i.e., increase stop codon read-through) have been identified. These include, but are not limited to, mutations in the uar gene (also known as the prfA gene), mutations in the ups gene, mutations in the sueA, sueB and sueC genes, mutations in the rpsD (ramA) and rpsE (spcA) genes and mutations in the rplL gene.

Thus, a nucleic acid reagent comprising a stop codon located between an ORF and a tag can yield a translated ORF alone when no suppressor tRNA is present in the translation system, and can yield a translated ORF-tag fusion when a suppressor tRNA is present in the system. Suppressor tRNA can be generated in cells transfected with a nucleic acid encoding the tRNA (e.g., a replication incompetent adenovirus containing the human tRNA-Ser suppressor gene can be transfected into cells, or a YAC containing a yeast or bacterial tRNA suppressor gene can be transfected into yeast cells, for example). Vectors for synthesizing suppressor tRNA and for translating ORFs with or without a tag are available to the artisan (e.g., Tag-On-Demand™ kit (Invitrogen Corporation, California); Tag-On-Demand™ Suppressor Supernatant Instruction Manual, Version B, 6 Jun. 2003, at http address www.invitrogen.com/content/sfs/manuals/tagondemand_supernatant_man.pdf; Tag-On-Demand™ Gateway® Vector Instruction Manual, Version B, 20 June, 2003 at http address www.invitrogen.com/content/sfs/manuals/tagondemand_vectors_man.pdf; and Capone et al., Amber, ochre and opal suppressor tRNA genes derived from a human serine tRNA gene. EMBO J. 4:213, 1985).

Any convenient cloning strategy known in the art may be utilized to incorporate an element, such as an ORF, into a nucleic acid reagent. Known methods can be utilized to insert an element into the template independent of an insertion element, such as (1) cleaving the template at one or more existing restriction enzyme sites and ligating an element of interest and (2) adding restriction enzyme sites to the template by hybridizing oligonucleotide primers that include one or more suitable restriction enzyme sites and amplifying by polymerase chain reaction (described in greater detail herein). Other cloning strategies take advantage of one or more insertion sites present or inserted into the nucleic acid reagent, such as an oligonucleotide primer hybridization site for PCR, for example, and others described herein. In some embodiments, a cloning strategy can be combined with genetic manipulation such as recombination (e.g., recombination of a nucleic acid reagent with a nucleic acid sequence of interest into the genome of the organism to be modified, as described further herein). In some embodiments, the cloned ORF(s) can produce (directly or indirectly) a fatty dicarboxylic acid (e.g., octanedioic acid, decanedioic acid, dodecanedioic acid, tetradecanedioic acid, hexadecanedioic acid, octadecanedioic acid, eicosanedioic acid), by engineering a microorganism with one or more ORFs of interest, which microorganism comprises one or more altered activities selected from the group consisting of omega hydroxyl fatty acid dehydrogenase activity, acyl-CoA oxidase activity, acyltransferase activity, thioesterase activity, monooxygenase activity and monooxygenase reductase activity.

In some embodiments, the nucleic acid reagent includes one or more recombinase insertion sites. A recombinase insertion site is a recognition sequence on a nucleic acid molecule that participates in an integration/recombination reaction by recombination proteins. For example, the recombination site for Cre recombinase is loxP, which is a 34 base pair sequence comprised of two 13 base pair inverted repeats (serving as the recombinase binding sites) flanking an 8 base pair core sequence (e.g., Figure 1 of Sauer, B., Curr. Opin. Biotech. 5:521-527 (1994)). Other examples of recombination sites include attB, attP, attL, and attR sequences, and mutants, fragments, variants and derivatives thereof, which are recognized by the recombination protein λ Int and by the auxiliary proteins integration host factor (IHF), FIS and excisionase (Xis) (e.g., U.S. Pat. Nos. 5,888,732; 6,143,557; 6,171,861; 6,270,969; 6,277,608; and 6,720,140; U.S. patent application Ser. No. 09/517,466, filed Mar. 2, 2000, and Ser.

No. 09/732,914, filed Aug. 14, 2003, and in U.S. patent publication no. 2002-0007051-A1; Landy, Curr. Opin. Biotech. 3:699-707 (1993)).

Examples of recombinase cloning nucleic acids are in Gateway® systems (Invitrogen, California), which include at least one recombination site for cloning a desired nucleic acid molecules in vivo or in vitro. In some embodiments, the system utilizes vectors that contain at least two different site-specific recombination sites, often based on the bacteriophage lambda system (e.g., att1 and att2), and are mutated from the wild-type (att0) sites. Each mutated site has a unique specificity for its cognate partner att site (i.e., its binding partner recombination site) of the same type (for example attB1 with attP1, or attL1 with attR1) and will not cross-react with recombination sites of the other mutant type or with the wild-type att0 site. Different site specificities allow directional cloning or linkage of desired molecules thus providing desired orientation of the cloned molecules. Nucleic acid fragments flanked by recombination sites are cloned and subcloned using the Gateway® system by replacing a selectable marker (for example, ccdB) flanked by att sites on the recipient plasmid molecule, sometimes termed the Destination Vector. Desired clones are then selected by transformation of a ccdB sensitive host strain and positive selection for a marker on the recipient molecule. Similar strategies for negative selection (e.g., use of toxic genes) can be used in other organisms such as thymidine kinase (TK) in mammals and insects.

A recombination system useful for engineering yeast is outlined briefly. The system makes use of the URA3 gene (e.g., for *S. cerevisiae* and *C. albicans*, for example) or URA4 and URA5 genes (e.g., for *S. pombe*, for example) and toxicity of the nucleotide analogue 5-Fluoroorotic acid (5-FOA). The URA3 or URA4 and URA5 genes encode orotine-5'-monophosphate (OMP) dicarboxylase. Yeast with an active URA3 or URA4 and URA5 gene (phenotypically Ura+) convert 5-FOA to fluorodeoxyuridine, which is toxic to yeast cells. Yeast carrying a mutation in the appropriate gene(s) or having a knock out of the appropriate gene(s) can grow in the presence of 5-FOA, if the media is also supplemented with uracil.

A nucleic acid engineering construct can be made which may comprise the URA3 gene or cassette (for *S. cerevisiae*), flanked on either side by the same nucleotide sequence in the same orientation. The URA3 cassette comprises a promoter, the URA3 gene and a functional transcription terminator. Target sequences which direct the construct to a particular nucleic acid region of interest in the organism to be engineered are added such that the target sequences are adjacent to and abut the flanking sequences on either side of the URA3 cassette. Yeast can be transformed with the engineering construct and plated on minimal media without uracil. Colonies can be screened by PCR to determine those transformants that have the engineering construct inserted in the proper location in the genome. Checking insertion location prior to selecting for recombination of the ura3 cassette may reduce the number of incorrect clones carried through to later stages of the procedure. Correctly inserted transformants can then be replica plated on minimal media containing 5-FOA to select for recombination of the URA3 cassette out of the construct, leaving a disrupted gene and an identifiable footprint (e.g., nucleic acid sequence) that can be use to verify the presence of the disrupted gene. The technique described is useful for disrupting or "knocking out" gene function, but also can be used to insert genes or constructs into a host organisms genome in a targeted, sequence specific manner.

In certain embodiments, a nucleic acid reagent includes one or more topoisomerase insertion sites. A topoisomerase insertion site is a defined nucleotide sequence recognized and bound by a site-specific topoisomerase. For example, the nucleotide sequence 5'-(C/T)CCTT-3' is a topoisomerase recognition site bound specifically by most poxvirus topoisomerases, including vaccinia virus DNA topoisomerase I. After binding to the recognition sequence, the topoisomerase cleaves the strand at the 3'-most thymidine of the recognition site to produce a nucleotide sequence comprising 5'-(C/T)CCTT-PO4-TOPO, a complex of the topoisomerase covalently bound to the 3' phosphate via a tyrosine in the topoisomerase (e.g., Shuman, J. Biol. Chem. 266: 11372-11379, 1991; Sekiguchi and Shuman, Nucl. Acids Res. 22:5360-5365, 1994; U.S. Pat. No. 5,766,891; PCT/US95/16099; and PCT/US98/12372). In comparison, the nucleotide sequence 5'-GCAACTT-3' is a topoisomerase recognition site for type IA *E. coli* topoisomerase III. An element to be inserted often is combined with topoisomerase-reacted template and thereby incorporated into the nucleic acid reagent (e.g., World Wide Web URL invitrogen.com/downloads/F-13512_Topo_Flyer.pdf; World Wide Web URL invitrogen.com/content/sfs/brochures/710_021849%20_B_TOPOCloning_bro.pdf; TOPO TA Cloning® Kit and Zero Blunt® TOPO® Cloning Kit product information).

A nucleic acid reagent sometimes contains one or more origin of replication (ORI) elements. In some embodiments, a template comprises two or more ORIs, where one functions efficiently in one organism (e.g., a bacterium) and another functions efficiently in another organism (e.g., a eukaryote, like yeast for example). In some embodiments, an ORI may function efficiently in one species (e.g., *S. cerevisiae*, for example) and another ORI may function efficiently in a different species (e.g., *S. pombe*, for example). A nucleic acid reagent also sometimes includes one or more transcription regulation sites.

A nucleic acid reagent can include one or more selection elements (e.g., elements for selection of the presence of the nucleic acid reagent, and not for activation of a promoter element which can be selectively regulated). Selection elements often are utilized using known processes to determine whether a nucleic acid reagent is included in a cell. In some embodiments, a nucleic acid reagent includes two or more selection elements, where one functions efficiently in one organism and another functions efficiently in another organism. Examples of selection elements include, but are not limited to, (1) nucleic acid segments that encode products that provide resistance against otherwise toxic compounds (e.g., antibiotics); (2) nucleic acid segments that encode products that are otherwise lacking in the recipient cell (e.g., essential products, tRNA genes, auxotrophic markers); (3) nucleic acid segments that encode products that suppress the activity of a gene product; (4) nucleic acid segments that encode products that can be readily identified (e.g., phenotypic markers such as antibiotics (e.g., β-lactamase), β-galactosidase, green fluorescent protein (GFP), yellow fluorescent protein (YFP), red fluorescent protein (RFP), cyan fluorescent protein (CFP), and cell surface proteins); (5) nucleic acid segments that bind products that are otherwise detrimental to cell survival and/or function; (6) nucleic acid segments that otherwise inhibit the activity of any of the nucleic acid segments described in Nos. 1-5 above (e.g., antisense oligonucleotides); (7) nucleic acid segments that bind products that modify a substrate (e.g., restriction endonucleases); (8) nucleic acid segments that can be used to isolate or identify a desired molecule (e.g., specific protein binding sites); (9) nucleic acid segments that encode a specific nucleotide sequence that can be otherwise non-functional (e.g., for PCR amplification of subpopulations of molecules); (10) nucleic acid segments that, when absent, directly or indirectly confer resistance or sensitivity to particular compounds; (11) nucleic acid segments that encode products that either are toxic or convert a relatively non-toxic compound to a toxic compound (e.g., Herpes simplex thymidine kinase, cytosine deaminase) in recipient cells; (12) nucleic acid segments that inhibit replication, partition or heritability of nucleic acid molecules that contain them; and/or (13) nucleic acid segments that encode conditional replication functions, e.g., replication in certain hosts or host cell strains or under certain environmental conditions (e.g., temperature, nutritional conditions, and the like).

A nucleic acid reagent is of any form useful for in vivo transcription and/or translation. A nucleic acid sometimes is a plasmid, such as a supercoiled plasmid, sometimes is a yeast artificial chromosome (e.g., YAC), sometimes is a linear nucleic acid (e.g., a linear nucleic acid produced by PCR or by restriction digest), sometimes is single-stranded and sometimes is double-stranded. A nucleic acid reagent sometimes is prepared by an amplification process, such as a polymerase chain reaction (PCR) process or transcription-mediated amplification process (TMA). In TMA, two enzymes are used in an isothermal reaction to produce amplification products detected by light emission (see, e.g., Biochemistry 1996 Jun. 25; 35(25):8429-38 and http address www.devicelink.com/ivdt/archive/00/11/007.html). Standard PCR processes are known (e.g., U.S. Pat. Nos. 4,683,202; 4,683,195; 4,965,188; and 5,656,493), and generally are performed in cycles. Each cycle includes heat denaturation, in which hybrid nucleic acids dissociate; cooling, in which primer oligonucleotides hybridize; and extension of the oligonucleotides by a polymerase (i.e., Taq polymerase). An example of a PCR cyclical process is treating the sample at 95° C. for 5 minutes; repeating forty-five cycles of 95° C. for 1 minute, 59° C. for 1 minute, 10 seconds, and 72° C. for 1 minute 30 seconds; and then treating the sample at 72° C. for 5 minutes. Multiple cycles frequently are performed using a commercially available thermal cycler. PCR amplification products sometimes are stored for a time at a lower temperature (e.g., at 4° C.) and sometimes are frozen (e.g., at −20° C.) before analysis.

In some embodiments, a nucleic acid reagent, protein reagent, protein fragment reagent or other reagent described herein is isolated or purified. The term "isolated" as used herein refers to material removed from its original environment (e.g., the natural environment if it is naturally occurring, or a host cell if expressed exogenously), and thus is altered "by the hand of man" from its original environment. The term "purified" as used herein with reference to molecules does not refer to absolute purity. Rather, "purified" refers to a substance in a composition that contains fewer substance species in the same class (e.g., nucleic acid or protein species) other than the substance of interest in comparison to the sample from which it originated. "Purified," if a nucleic acid or protein for example, refers to a substance in a composition that contains fewer nucleic acid species or protein species other than the nucleic acid or protein of interest in comparison to the sample from which it originated. Sometimes, a protein or nucleic acid is "substantially pure," indicating that the protein or nucleic acid represents at least 50% of protein or nucleic acid on a mass basis of the composition. Often, a substantially pure protein or nucleic acid is at least 75% on a mass basis of the composition, and sometimes at least 95% on a mass basis of the composition.

Engineering and Alteration Methods

Methods and compositions (e.g., nucleic acid reagents) described herein can be used to generate engineered microorganisms. As noted above, the term "engineered microorganism" as used herein refers to a modified organism that includes one or more activities distinct from an activity present in a microorganism utilized as a starting point for modification (e.g., host microorganism or unmodified organism). Engineered microorganisms typically arise as a result of a genetic modification, usually introduced or selected for, by one of skill in the art using readily available techniques. Non-limiting examples of methods useful for generating an altered activity include, introducing a heterologous polynucleotide (e.g., nucleic acid or gene integration, also referred to as "knock in"), removing an endogenous polynucleotide, altering the sequence of an existing endogenous nucleic acid sequence (e.g., site-directed mutagenesis), disruption of an existing endogenous nucleic acid sequence (e.g., knock outs and transposon or insertion element mediated mutagenesis), selection for an altered activity where the selection causes a change in a naturally occurring activity that can be stably inherited (e.g., causes a change in a nucleic acid sequence in the genome of the organism or in an epigenetic nucleic acid that is replicated and passed on to daughter cells), PCR-based mutagenesis, and the like.

The term "mutagenesis" as used herein refers to any modification to a nucleic acid (e.g., nucleic acid reagent, or host chromosome, for example) that is subsequently used to generate a product in a host or modified organism. Non-limiting examples of mutagenesis include, deletion, insertion, substitution, rearrangement, point mutations, suppressor mutations and the like. Mutagenesis methods are known in the art and are readily available to the artisan. Non-limiting examples of mutagenesis methods are described herein and can also be found in Maniatis, T., E. F. Fritsch and J. Sambrook (1982) *Molecular Cloning: a Laboratory Manual*; Cold Spring Harbor Laboratory, Cold Spring Harbor, N.Y. Another non-limiting example of mutagenesis can be conducted using a Stratagene (San Diego, Calif.) "QuickChange" kit according to the manufacturer's instructions.

The term "genetic modification" as used herein refers to any suitable nucleic acid addition, removal or alteration that facilitates production of a target fatty dicarboxylic acid product (e.g., sebacic or dodecanedioic acid) in an engineered microorganism. Genetic modifications include, without limitation, insertion of one or more nucleotides in a native nucleic acid of a host organism in one or more locations, deletion of one or more nucleotides in a native nucleic acid of a host organism in one or more locations, modification or substitution of one or more nucleotides in a native nucleic acid of a host organism in one or more locations, insertion of a non-native nucleic acid into a host organism (e.g., insertion of an autonomously replicating vector), and removal of a non-native nucleic acid in a host organism (e.g., removal of a vector).

The term "heterologous polynucleotide" as used herein refers to a nucleotide sequence not present in a host microorganism in some embodiments. In certain embodiments, a heterologous polynucleotide is present in a different amount (e.g., different copy number) than in a host microorganism, which can be accomplished, for example, by introducing more copies of a particular nucleotide sequence to a host microorganism (e.g., the particular nucleotide sequence may be in a nucleic acid autonomous of the host chromosome or may be inserted into a chromosome). A heterologous polynucleotide is from a different organism in some embodiments, and in certain embodiments, is from the same type of organism but from an outside source (e.g., a recombinant source).

In some embodiments, an organism engineered using the methods and nucleic acid reagents described herein can produce a fatty dicarboxylic acid (e.g., octanedioic acid, decanedioic acid, dodecanedioic acid, tetradecanedioic acid, hexadecanedioic acid, octadecanedioic acid, eicosanedioic acid). In certain embodiments, an engineered microorganism described herein that produces a fatty dicarboxylic acid (e.g., octanedioic acid, decanedioic acid, dodecanedioic acid, tetradecanedioic acid, hexadecanedioic acid, octadecanedioic acid, eicosanedioic acid) may comprise one ore more altered activities selected from the group consisting of omega oxo fatty acid dehydrogenase activity, omega hydroxyl fatty acid dehydrogenase activity, fatty acid synthase activity, acetyl CoA carboxylase activity, acyl-CoA oxidase activity, monooxygenase activity and monooxygenase reductase activity. In some embodiments, an engineered microorganism as described herein may comprise a genetic modification that adds or increases the omega oxo fatty acid dehydrogenase activity, omega hydroxyl fatty acid dehydrogenase activity, fatty acid synthase activity, acetyl CoA carboxylase activity, acyl-CoA oxidase activity, monooxygenase activity and monooxygenase reductase activity.

In certain embodiments, an engineered microorganism described herein can comprise an altered thioesterase activity. In some embodiments, the engineered microorganism may comprise a genetic alteration that adds or increases a thioesterase activity. In some embodiments, the engineered microorganism comprising a genetic alteration that adds or increases a thioesterase activity, may further comprise a heterologous polynucleotide encoding a polypeptide having thioesterase activity.

The term "altered activity" as used herein refers to an activity in an engineered microorganism that is added or modified relative to the host microorganism (e.g., added, increased, reduced, inhibited or removed activity). An activity can be altered by introducing a genetic modification to a host microorganism that yields an engineered microorganism having added, increased, reduced, inhibited or removed activity.

An added activity often is an activity not detectable in a host microorganism. An increased activity generally is an activity detectable in a host microorganism that has been increased in an engineered microorganism. An activity can be increased to any suitable level for production of a target fatty dicarboxylic acid product (e.g., sebacic or dodecanedioic acid), including but not limited to less than 2-fold (e.g., about 10% increase to about 99% increase; about 20%, 30%, 40%, 50%, 60%, 70%, 80%, 90% increase), 2-fold, 3-fold, 4-fold, 5-fold, 6-fold, 7-fold, 8-fold, 9-fold, of 10-fold increase, or greater than about 10-fold increase. A reduced or inhibited activity generally is an activity detectable in a host microorganism that has been reduced or inhibited in an engineered microorganism. An activity can be reduced to undetectable levels in some embodiments, or detectable levels in certain embodiments. An activity can be decreased to any suitable level for production of a target fatty dicarboxylic acid product (e.g., sebacic or dodecanedioic acid), including but not limited to less than 2-fold (e.g., about 10% decrease to about 99% decrease; about 20%, 30%, 40%, 50%, 60%, 70%, 80%, 90% decrease), 2-fold, 3-fold, 4-fold, 5-fold, 6-fold, 7-fold, 8-fold, 9-fold, of 10-fold decrease, or greater than about 10-fold decrease.

The term "level", as used herein, often refers to a level or amount (e.g., a quantitative or relative amount) of a protein or nucleic acid (e.g. an RNA (e.g. an mRNA) or DNA).

An altered activity sometimes is an activity not detectable in a host organism and is added to an engineered organism. An altered activity also may be an activity detectable in a host organism and is increased in an engineered organism. An activity may be added or increased by increasing the number of copies of a polynucleotide that encodes a polypeptide having a target activity, in some embodiments. In some embodiments, the activity of a native polypeptide can be increased by increasing in the modified organism the number of copies of a polynucleotide that encodes the polypeptide (e.g., introducing 1 to about 100 additional copies of the polynucleotide (e.g., introducing 1, 2, 3, 4, 5, 6, 7, 8, 9, 10, 11, 12, 13, 14, 15, 16, 17, 18, 19, 20, 22, 24, 26, 28, 30 or more additional copies of the polynucleotide). In certain embodiments an activity can be added or increased by inserting into a host microorganism a polynucleotide that encodes a heterologous polypeptide having the added activity or encodes a modified endogenous polypeptide. In such embodiments, 1 to about 100 copies of the polynucleotide can be introduced (e.g., introducing 1, 2, 3, 4, 5, 6, 7, 8, 9, 10, 11, 12, 13, 14, 15, 16, 17, 18, 19, 20, 22, 24, 26, 28, 30 copies). A "modified endogenous polypeptide" often has an activity different than an activity of a native polypeptide counterpart (e.g., different catalytic activity and/or different substrate specificity), and often is active (e.g., an activity (e.g., substrate turnover) is detectable). In certain embodiments, an activity can be added or increased by inserting into a host microorganism a heterologous polynucleotide that is (i) operably linked to another polynucleotide that encodes a polypeptide having the added activity, and (ii) up regulates production of the polynucleotide. Thus, an activity can be added or increased by inserting or modifying a regulatory polynucleotide operably linked to another polynucleotide that encodes a polypeptide having the target activity. In certain embodiments, an activity can be added or increased by subjecting a host microorganism to a selective environment and screening for microorganisms that have a detectable level of the target activity. Examples of a selective environment include, without limitation, a medium containing a substrate that a host organism can process and a medium lacking a substrate that a host organism can process.

An altered activity sometimes is an activity detectable in a host organism and is reduced, inhibited or removed (i.e., not detectable) in an engineered organism. An activity may be reduced or removed by decreasing the number of copies of a polynucleotide that encodes a polypeptide having a target activity, in some embodiments. In some embodiments, an activity can be reduced or removed by (i) inserting a polynucleotide within a polynucleotide that encodes a polypeptide having the target activity (disruptive insertion), and/or (ii) removing a portion of or all of a polynucleotide that encodes a polypeptide having the target activity (deletion or knock out, respectively). In certain embodiments, an activity can be reduced or removed by inserting into a host microorganism a heterologous polynucleotide that is (i) operably linked to another polynucleotide that encodes a polypeptide having the target activity, and (ii) down regulates production of the polynucleotide. Thus, an activity can be reduced or removed by inserting or modifying a regulatory polynucleotide operably linked to another polynucleotide that encodes a polypeptide having the target activity.

An activity also can be reduced or removed by (i) inhibiting a polynucleotide that encodes a polypeptide having the activity or (ii) inhibiting a polynucleotide operably linked to another polynucleotide that encodes a polypeptide having the activity. A polynucleotide can be inhibited by a suitable technique known in the art, such as by contacting an RNA encoded by the polynucleotide with a specific inhibitory RNA (e.g., RNAi, siRNA, ribozyme). An activity also can be reduced or removed by contacting a polypeptide having the activity with a molecule that specifically inhibits the activity (e.g., enzyme inhibitor, antibody). In certain embodiments, an activity can be reduced or removed by subjecting a host microorganism to a selective environment and screening for microorganisms that have a reduced level or removal of the target activity.

In some embodiments, an untranslated ribonucleic acid, or a cDNA can be used to reduce the expression of a particular activity or enzyme. For example, a microorganism can be engineered by genetic modification to express a nucleic acid reagent that reduces the expression of an activity by producing an RNA molecule that is partially or substantially homologous to a nucleic acid sequence of interest which encodes the activity of interest. The RNA molecule can bind to the nucleic acid sequence of interest and inhibit the nucleic acid sequence from performing its natural function, in certain embodiments. In some embodiments, the RNA may alter the nucleic acid sequence of interest which encodes the activity of interest in a manner that the nucleic acid sequence of interest is no longer capable of performing its natural function (e.g., the action of a ribozyme for example).

In certain embodiments, nucleotide sequences sometimes are added to, modified or removed from one or more of the nucleic acid reagent elements, such as the promoter, 5'UTR, target sequence, or 3'UTR elements, to enhance, potentially enhance, reduce, or potentially reduce transcription and/or translation before or after such elements are incorporated in a nucleic acid reagent. In some embodiments, one or more of the following sequences may be modified or removed if they are present in a 5'UTR: a sequence that forms a stable secondary structure (e.g., quadruplex structure or stem loop stem structure (e.g., EMBL sequences X12949, AF274954, AF139980, AF152961, 595936, U194144, AF116649 or substantially identical sequences that form such stem loop stem structures)); a translation initiation codon upstream of the target nucleotide sequence start codon; a stop codon upstream of the target nucleotide sequence translation initiation codon; an ORF upstream of the target nucleotide sequence translation initiation codon; an iron responsive element (IRE) or like sequence; and a 5' terminal oligopyrimidine tract (TOP, e.g., consisting of 5-15 pyrimidines adjacent to the cap). A translational enhancer sequence and/or an internal ribosome entry site (IRES) sometimes is inserted into a 5'UTR (e.g., EMBL nucleotide sequences J04513, X87949, M95825, M12783, AF025841, AF013263, AF006822, M17169, M13440, M22427, D14838 and M17446 and substantially identical nucleotide sequences).

An AU-rich element (ARE, e.g., AUUUA repeats) and/or splicing junction that follows a non-sense codon sometimes is removed from or modified in a 3'UTR. A polyadenosine tail sometimes is inserted into a 3'UTR if none is present, sometimes is removed if it is present, and adenosine moieties sometimes are added to or removed from a polyadenosine tail present in a 3'UTR. Thus, some embodiments are directed to a process comprising: determining whether any nucleotide sequences that increase, potentially increase, reduce or potentially reduce translation efficiency are present in the elements, and adding, removing or modifying one or more of such sequences if they are identified. Certain embodiments are directed to a process comprising: determining whether any nucleotide sequences that increase or potentially increase translation efficiency are not present in the elements, and incorporating such sequences into the nucleic acid reagent.

In some embodiments, an activity can be altered by modifying the nucleotide sequence of an ORF. An ORF sometimes is mutated or modified (for example, by point mutation, deletion mutation, insertion mutation, PCR based mutagenesis and the like) to alter, enhance or increase, reduce, substantially reduce or eliminate the activity of the encoded protein or peptide. The protein or peptide encoded by a modified ORF sometimes is produced in a lower amount or may not be produced at detectable levels, and in other embodiments, the product or protein encoded by the modified ORF is produced at a higher level (e.g., codons sometimes are modified so they are compatible with tRNA's preferentially used in the host organism or engineered organism). To determine the relative activity, the activity from the product of the mutated ORF (or cell containing it) can be compared to the activity of the product or protein encoded by the unmodified ORF (or cell containing it).

In some embodiments, an ORF nucleotide sequence sometimes is mutated or modified to alter the triplet nucleotide sequences used to encode amino acids (e.g., amino acid codon triplets, for example). Modification of the nucleotide sequence of an ORF to alter codon triplets sometimes is used to change the codon found in the original sequence to better match the preferred codon usage of the organism in which the ORF or nucleic acid reagent will be expressed. The codon usage, and therefore the codon triplets encoded by a nucleic acid sequence, in bacteria may be different from the preferred codon usage in eukaryotes, like yeast or plants for example. Preferred codon usage also may be different between bacterial species. In certain embodiments an ORF nucleotide sequences sometimes is modified to eliminate codon pairs and/or eliminate mRNA secondary structures that can cause pauses during translation of the mRNA encoded by the ORF nucleotide sequence. Translational pausing sometimes occurs when nucleic acid secondary structures exist in an mRNA, and sometimes occurs due to the presence of codon pairs that slow the rate of translation by causing ribosomes to pause. In some embodiments, the use of lower abundance codon triplets can reduce translational pausing due to a decrease in the pause time needed to load a charged tRNA into the ribosome translation machinery. Therefore, to increase transcriptional and translational efficiency in bacteria (e.g., where transcription and translation are concurrent, for example) or to increase translational efficiency in eukaryotes (e.g., where transcription and translation are functionally separated), the nucleotide sequence of a nucleotide sequence of interest can be altered to better suit the transcription and/or translational machinery of the host and/or genetically modified microorganism. In certain embodiments, slowing the rate of translation by the use of lower abundance codons, which slow or pause the ribosome, can lead to higher yields of the desired product due to an increase in correctly folded proteins and a reduction in the formation of inclusion bodies.

Codons can be altered and optimized according to the preferred usage by a given organism by determining the codon distribution of the nucleotide sequence donor organism and comparing the distribution of codons to the distribution of codons in the recipient or host organism. Techniques described herein (e.g., site directed mutagenesis and the like) can then be used to alter the codons accordingly.

Comparisons of codon usage can be done by hand, or using nucleic acid analysis software commercially available to the artisan.

Modification of the nucleotide sequence of an ORF also can be used to correct codon triplet sequences that have diverged in different organisms. For example, certain yeast (e.g., *C. tropicalis* and *C. maltosa*) use the amino acid triplet CUG (e.g., CTG in the DNA sequence) to encode serine. CUG typically encodes leucine in most organisms. In order to maintain the correct amino acid in the resultant polypeptide or protein, the CUG codon must be altered to reflect the organism in which the nucleic acid reagent will be expressed. Thus, if an ORF from a bacterial donor is to be expressed in either *Candida* yeast strain mentioned above, the heterologous nucleotide sequence must first be altered or modified to the appropriate leucine codon. Therefore, in some embodiments, the nucleotide sequence of an ORF sometimes is altered or modified to correct for differences that have occurred in the evolution of the amino acid codon triplets between different organisms. In some embodiments, the nucleotide sequence can be left unchanged at a particular amino acid codon, if the amino acid encoded is a conservative or neutral change in amino acid when compared to the originally encoded amino acid.

In some embodiments, an activity can be altered by modifying translational regulation signals, like a stop codon for example. A stop codon at the end of an ORF sometimes is modified to another stop codon, such as an amber stop codon described above. In some embodiments, a stop codon is introduced within an ORF, sometimes by insertion or mutation of an existing codon. An ORF comprising a modified terminal stop codon and/or internal stop codon often is translated in a system comprising a suppressor tRNA that recognizes the stop codon. An ORF comprising a stop codon sometimes is translated in a system comprising a suppressor lRNA that incorporates an unnatural amino acid during translation of the target protein or target peptide. Methods for incorporating unnatural amino acids into a target protein or peptide are known, which include, for example, processes utilizing a heterologous tRNA/synthetase pair, where the tRNA recognizes an amber stop codon and is loaded with an unnatural amino acid (e.g., World Wide Web URL iupac.org/news/prize/2003/wang-.pdf).

Depending on the portion of a nucleic acid reagent (e.g., Promoter, 5' or 3' UTR, ORI, ORF, and the like) chosen for alteration (e.g., by mutagenesis, introduction or deletion, for example) the modifications described above can alter a given activity by (i) increasing or decreasing feedback inhibition mechanisms, (ii) increasing or decreasing promoter initiation, (iii) increasing or decreasing translation initiation, (iv) increasing or decreasing translational efficiency, (v) modifying localization of peptides or products expressed from nucleic acid reagents described herein, or (vi) increasing or decreasing the copy number of a nucleotide sequence of interest, (vii) expression of an anti-sense RNA, RNAi, siRNA, ribozyme and the like. In some embodiments, alteration of a nucleic acid reagent or nucleotide sequence can alter a region involved in feedback inhibition (e.g., 5' UTR, promoter and the like). A modification sometimes is made that can add or enhance binding of a feedback regulator and sometimes a modification is made that can reduce, inhibit or eliminate binding of a feedback regulator.

In certain embodiments, alteration of a nucleic acid reagent or nucleotide sequence can alter sequences involved in transcription initiation (e.g., promoters, 5' UTR, and the like). A modification sometimes can be made that can enhance or increase initiation from an endogenous or heterologous promoter element. A modification sometimes can be made that removes or disrupts sequences that increase or enhance transcription initiation, resulting in a decrease or elimination of transcription from an endogenous or heterologous promoter element.

In some embodiments, alteration of a nucleic acid reagent or nucleotide sequence can alter sequences involved in translational initiation or translational efficiency (e.g., 5' UTR, 3' UTR, codon triplets of higher or lower abundance, translational terminator sequences and the like, for example). A modification sometimes can be made that can increase or decrease translational initiation, modifying a ribosome binding site for example. A modification sometimes can be made that can increase or decrease translational efficiency. Removing or adding sequences that form hairpins and changing codon triplets to a more or less preferred codon are non-limiting examples of genetic modifications that can be made to alter translation initiation and translation efficiency.

In certain embodiments, alteration of a nucleic acid reagent or nucleotide sequence can alter sequences involved in localization of peptides, proteins or other desired products (e.g., a sebacic acid or dodecanedioic acid, for example). A modification sometimes can be made that can alter, add or remove sequences responsible for targeting a polypeptide, protein or product to an intracellular organelle, the periplasm, cellular membranes, or extracellularly. Transport of a heterologous product to a different intracellular space or extracellularly sometimes can reduce or eliminate the formation of inclusion bodies (e.g., insoluble aggregates of the desired product).

In some embodiments, alteration of a nucleic acid reagent or nucleotide sequence can alter sequences involved in increasing or decreasing the copy number of a nucleotide sequence of interest. A modification sometimes can be made that increases or decreases the number of copies of an ORF stably integrated into the genome of an organism or on an epigenetic nucleic acid reagent. Non-limiting examples of alterations that can increase the number of copies of a sequence of interest include, adding copies of the sequence of interest by duplication of regions in the genome (e.g., adding additional copies by recombination or by causing gene amplification of the host genome, for example), cloning additional copies of a sequence onto a nucleic acid reagent, or altering an ORI to increase the number of copies of an epigenetic nucleic acid reagent. Non-limiting examples of alterations that can decrease the number of copies of a sequence of interest include, removing copies of the sequence of interest by deletion or disruption of regions in the genome, removing additional copies of the sequence from epigenetic nucleic acid reagents, or altering an ORI to decrease the number of copies of an epigenetic nucleic acid reagent.

In certain embodiments, increasing or decreasing the expression of a nucleotide sequence of interest can also be accomplished by altering, adding or removing sequences involved in the expression of an anti-sense RNA, RNAi, siRNA, ribozyme and the like. The methods described above can be used to modify expression of anti-sense RNA, RNAi, siRNA, ribozyme and the like.

The methods and nucleic acid reagents described herein can be used to generate genetically modified microorganisms with altered activities in cellular processes involved in a fatty dicarboxylic acid (e.g., octanedioic acid, decanedioic acid, dodecanedioic acid, tetradecanedioic acid, hexadecanedioic acid, octadecanedioic acid, eicosanedioic acid) synthesis. In some embodiments, an engineered microorganism described herein may comprise an increased number of copies of an endogenous polynucleotide encoding a polypeptide having omega oxo fatty acid dehydrogenase activity. In certain embodiments, an engineered microorganism described herein may comprise an increased number of copies of an endogenous polynucleotide encoding a polypeptide having omega hydroxyl fatty acid dehydrogenase activity. In some embodiments, an engineered microorganism described herein may comprise a heterologous polynucleotide encoding a polypeptide having omega oxo fatty acid dehydrogenase activity. In some embodiments, an engineered microorganism described herein may comprise a heterologous polynucleotide encoding a polypeptide having omega hydroxyl fatty acid dehydrogenase activity. In some embodiments, the heterologous polynucleotide can be from a bacterium. In some embodiments, the bacterium can be an *Acinetobacter, Nocardia, Pseudomonas* or Xanthobacter bacterium.

In some embodiments, an engineered microorganism described herein may comprise a heterologous polynucleotide encoding a polypeptide having monooxygenase activity. In certain embodiments, the heterologous polynucleotide can be from a bacterium. In some embodiments, the bacterium can be a *Bacillus* bacterium. In certain embodiments, the *Bacillus* bacterium is *B. megaterium*.

In certain embodiments, an engineered microorganism described herein may comprise a genetic modification that reduces omega hydroxyl fatty acid conversion. In some embodiments, the genetic modification can reduce omega hydroxyl fatty acid dehydrogenase activity. In certain embodiments, an engineered microorganism described herein may comprise a genetic modification that reduces beta-oxidation activity. In some embodiments, the genetic modification can reduce a target activity described herein.

Engineered microorganisms that produce a fatty dicarboxylic acid (e.g., octanedioic acid, decanedioic acid, dodecanedioic acid, tetradecanedioic acid, hexadecanedioic acid, octadecanedioic acid, eicosanedioic acid), as described herein, can comprise an altered monooxygenase activity, in certain embodiments. In some embodiments, the engineered microorganism described herein may comprise a genetic modification that alters the monooxygenase activity. In certain embodiments, the engineered microorganism described herein can comprise an increase number of copies of an endogenous polynucleotide encoding a polypeptide having monooxygenase activity. In some embodiments, the engineered microorganism described herein can comprise a heterologous polynucleotide encoding a polypeptide having monooxygenase activity. In certain embodiments, the heterologous polynucleotide can be from a bacterium. In some embodiments, the bacterium can be a *Bacillus* bacterium. In certain embodiments, the *Bacillus* bacterium is *B. megaterium*. In some embodiments, the genetic modification can reduce a polyketide synthase activity.

Engineered microorganisms that produce a fatty dicarboxylic acid (e.g., octanedioic acid, decanedioic acid, dodecanedioic acid, tetradecanedioic acid, hexadecanedioic acid, octadecanedioic acid, eicosanedioic acid), as described herein, can comprise an altered thioesterase activity, in certain embodiments. In some embodiments, the engineered microorganism may comprise a genetic modification that adds or increases the thioesterase activity. In certain embodiments, the engineered microorganism may comprise a heterologous polynucleotide encoding a polypeptide having thioesterase activity.

In some embodiments, the engineered microorganism with an altered thioesterase activity may comprise an altered omega oxo fatty acid dehydrogenase activity. In certain embodiments, the engineered microorganism with an altered thioesterase activity may comprise a genetic modification that adds or increases omega oxo fatty acid dehydrogenase activity. In some embodiments, the engineered microorganism may comprise a heterologous polynucleotide encoding a polypeptide having altered omega oxo fatty acid dehydrogenase activity. In certain embodiments, the heterologous polynucleotide can be from a bacterium. In some embodiments, the bacterium can be an *Acinetobacter, Nocardia, Pseudomonas* or Xanthobacter bacterium.

Engineered microorganisms that produce a fatty dicarboxylic acid (e.g., octanedioic acid, decanedioic acid, dodecanedioic acid, tetradecanedioic acid, hexadecanedioic acid, octadecanedioic acid, eicosanedioic acid), as described herein, can comprise an altered omega hydroxyl fatty acid dehydrogenase activity. In certain embodiments, the engineered microorganism may comprise a genetic modification that adds or increases the omega hydroxyl fatty acid dehydrogenase activity. In certain embodiments, the engineered microorganism may comprise a heterologous polynucleotide encoding a polypeptide having altered omega hydroxyl fatty acid dehydrogenase activity. In some embodiments, the heterologous polynucleotide is from a bacterium. In certain embodiments, the bacterium can be an *Acinetobacter, Nocardia, Pseudomonas* or Xanthobacter bacterium. In some embodiments, the engineered microorganism can be a eukaryote. In certain embodiments, the eukaryote can be a yeast. In some embodiments, the eukaryote may be a fungus. In certain embodiments, the yeast can be a *Candida* yeast. In some embodiments, the *Candida* yeast may be *C. troplicalis*. In certain embodiments, the fungus can be a *Yarrowia* fungus. In some embodiments the *Yarrowia* fungus may be *Y. lipolytica*. In certain embodiments, the fungus can be an *Aspergillus* fungus. In some embodiments, the *Aspergillus* fungus may be *A. parasiticus* or *A. nidulans*. In some embodiments, an engineered microorganism as described above may comprise a genetic modification that reduces omega hydroxyl fatty acid conversion. In certain embodiments, the genetic modification can reduce omega hydroxyl fatty acid dehydrogenase activity. In some embodiments the genetic may reduce beta-oxidation activity. In certain embodiments, the genetic modification may reduce a target activity described herein.

Engineered microorganisms can be prepared by altering, introducing or removing nucleotide sequences in the host genome or in stably maintained epigenetic nucleic acid reagents, as noted above. The nucleic acid reagents use to alter, introduce or remove nucleotide sequences in the host genome or epigenetic nucleic acids can be prepared using the methods described herein or available to the artisan.

Nucleic acid sequences having a desired activity can be isolated from cells of a suitable organism using lysis and nucleic acid purification procedures described in a known reference manual (e.g., Maniatis, T., E. F. Fritsch and J. Sambrook (1982) *Molecular Cloning: a Laboratory Manual*; Cold Spring Harbor Laboratory, Cold Spring Harbor, N.Y.) or using commercially available cell lysis and DNA purification reagents and kits. In some embodiments, nucleic acids used to engineer microorganisms can be provided for conducting methods described herein after processing of the organism containing the nucleic acid. For example, the nucleic acid of interest may be extracted, isolated, purified or amplified from a sample (e.g., from an organism of interest or culture containing a plurality of organisms of interest, like yeast or bacteria for example). The term "isolated" as used herein refers to nucleic acid removed from its original environment (e.g., the natural environment if it is naturally occurring, or a host cell if expressed exogenously), and thus is altered "by the hand of man" from its original environment. An isolated nucleic acid generally is provided with fewer non-nucleic acid components (e.g., protein, lipid) than the amount of components present in a source sample. A composition comprising isolated sample nucleic acid can be substantially isolated (e.g., about 90%, 91%, 92%, 93%, 94%, 95%, 96%, 97%, 98%, 99% or greater than 99% free of non-nucleic acid components). The term "purified" as used herein refers to sample nucleic acid provided that contains fewer nucleic acid species than in the sample source from which the sample nucleic acid is derived. A composition comprising sample nucleic acid may be substantially purified (e.g., about 90%, 91%, 92%, 93%, 94%, 95%, 96%, 97%, 98%, 99% or greater than 99% free of other nucleic acid species). The term "amplified" as used herein refers to subjecting nucleic acid of a cell, organism or sample to a process that linearly or exponentially generates amplicon nucleic acids having the same or substantially the same nucleotide sequence as the nucleotide sequence of the nucleic acid in the sample, or portion thereof. As noted above, the nucleic acids used to prepare nucleic acid reagents as described herein can be subjected to fragmentation or cleavage.

Amplification of nucleic acids is sometimes necessary when dealing with organisms that are difficult to culture. Where amplification may be desired, any suitable amplification technique can be utilized. Non-limiting examples of methods for amplification of polynucleotides include, polymerase chain reaction (PCR); ligation amplification (or ligase chain reaction (LCR)); amplification methods based on the use of Q-beta replicase or template-dependent polymerase (see US Patent Publication Number US20050287592); helicase-dependent isothermal amplification (Vincent et al., "Helicase-dependent isothermal DNA amplification". EMBO reports 5 (8): 795-800 (2004)); strand displacement amplification (SDA); thermophilic SDA nucleic acid sequence based amplification (3SR or NASBA) and transcription-associated amplification (TAA). Non-limiting examples of PCR amplification methods include standard PCR, AFLP-PCR, Allele-specific PCR, Alu-PCR, Asymmetric PCR, Colony PCR, Hot start PCR, Inverse PCR (IPCR), In situ PCR (ISH), Intersequence-specific PCR (ISSR-PCR), Long PCR, Multiplex PCR, Nested PCR, Quantitative PCR, Reverse Transcriptase PCR (RT-PCR), Real Time PCR, Single cell PCR, Solid phase PCR, combinations thereof, and the like. Reagents and hardware for conducting PCR are commercially available.

Protocols for conducting the various type of PCR listed above are readily available to the artisan. PCR conditions can be dependent upon primer sequences, target abundance, and the desired amount of amplification, and therefore, one of skill in the art may choose from a number of PCR protocols available (see, e.g., U.S. Pat. Nos. 4,683,195 and 4,683,202; and PCR Protocols: A Guide to Methods and Applications, Innis et al., eds, 1990. PCR often is carried out as an automated process with a thermostable enzyme. In this process, the temperature of the reaction mixture is cycled through a denaturing region, a primer-annealing region, and an extension reaction region automatically. Machines specifically adapted for this purpose are commercially available. A non-limiting example of a PCR protocol that may be suitable for embodiments described herein is, treating the sample at 95° C. for 5 minutes; repeating forty-five cycles of 95° C. for 1 minute, 59° C. for 1 minute, 10 seconds, and 72° C. for 1 minute 30 seconds; and then treating the sample at 72° C. for 5 minutes. Additional PCR protocols are described in the example section. Multiple cycles frequently are performed using a commercially available thermal cycler. Suitable isothermal amplification processes known and selected by the person of ordinary skill in the art also may be applied, in certain embodiments. In some embodiments, nucleic acids encoding polypeptides with a desired activity can be isolated by amplifying the desired sequence from an organism having the desired activity using oligonucleotides or primers designed based on sequences described herein.

Amplified, isolated and/or purified nucleic acids can be cloned into the recombinant DNA vectors described in Figures herein or into suitable commercially available recombinant DNA vectors. Cloning of nucleic acid sequences of interest into recombinant DNA vectors can facilitate further manipulations of the nucleic acids for preparation of nucleic acid reagents, (e.g., alteration of nucleotide sequences by mutagenesis, homologous recombination, amplification and the like, for example). Standard cloning procedures (e.g., enzymatic digestion, ligation, and the like) are known (e.g., described in Maniatis, T., E. F. Fritsch and J. Sambrook (1982) *Molecular Cloning: a Laboratory Manual*; Cold Spring Harbor Laboratory, Cold Spring Harbor, N.Y.).

In some embodiments, nucleic acid sequences prepared by isolation or amplification can be used, without any further modification, to add an activity to a microorganism and thereby create a genetically modified or engineered microorganism. In certain embodiments, nucleic acid sequences prepared by isolation or amplification can be genetically modified to alter (e.g., increase or decrease, for example) a desired activity. In some embodiments, nucleic acids, used to add an activity to an organism, sometimes are genetically modified to optimize the heterologous polynucleotide sequence encoding the desired activity (e.g., polypeptide or protein, for example). The term "optimize" as used herein can refer to alteration to increase or enhance expression by preferred codon usage. The term optimize can also refer to modifications to the amino acid sequence to increase the activity of a polypeptide or protein, such that the activity exhibits a higher catalytic activity as compared to the "natural" version of the polypeptide or protein.

Nucleic acid sequences of interest can be genetically modified using methods known in the art. Mutagenesis techniques are particularly useful for small scale (e.g., 1, 2, 5, 10 or more nucleotides) or large scale (e.g., 50, 100, 150, 200, 500, or more nucleotides) genetic modification. Mutagenesis allows the artisan to alter the genetic information of an organism in a stable manner, either naturally (e.g., isolation using selection and screening) or experimentally by the use of chemicals, radiation or inaccurate DNA replication (e.g., PCR mutagenesis). In some embodiments, genetic modification can be performed by whole scale synthetic synthesis of nucleic acids, using a native nucleotide sequence as the reference sequence, and modifying nucleotides that can result in the desired alteration of activity. Mutagenesis methods sometimes are specific or targeted to specific regions or nucleotides (e.g., site-directed mutagenesis, PCR-based site-directed mutagenesis, and in vitro mutagenesis techniques such as transplacement and in vivo oligonucleotide site-directed mutagenesis, for example). Mutagenesis methods sometimes are non-specific or random with respect to the placement of genetic modifications (e.g., chemical mutagenesis, insertion element (e.g., insertion or transposon elements) and inaccurate PCR based methods, for example).

Site directed mutagenesis is a procedure in which a specific nucleotide or specific nucleotides in a DNA molecule are mutated or altered. Site directed mutagenesis typically is performed using a nucleic acid sequence of interest cloned into a circular plasmid vector. Site-directed mutagenesis requires that the wild type sequence be known and used a platform for the genetic alteration. Site-directed mutagenesis sometimes is referred to as oligonucleotide-directed mutagenesis because the technique can be performed using oligonucleotides which have the desired genetic modification incorporated into the complement a nucleotide sequence of interest. The wild type sequence and the altered nucleotide are allowed to hybridize and the hybridized nucleic acids are extended and replicated using a DNA polymerase. The double stranded nucleic acids are introduced into a host (e.g., E. coli, for example) and further rounds of replication are carried out in vivo. The transformed cells carrying the mutated nucleic acid sequence are then selected and/or screened for those cells carrying the correctly mutagenized sequence. Cassette mutagenesis and PCR-based site-directed mutagenesis are further modifications of the site-directed mutagenesis technique. Site-directed mutagenesis can also be performed in vivo (e.g., transplacement "pop-in pop-out", In vivo site-directed mutagenesis with synthetic oligonucleotides and the like, for example).

PCR-based mutagenesis can be performed using PCR with oligonucleotide primers that contain the desired mutation or mutations. The technique functions in a manner similar to standard site-directed mutagenesis, with the exception that a thermocycler and PCR conditions are used to replace replication and selection of the clones in a microorganism host. As PCR-based mutagenesis also uses a circular plasmid vector, the amplified fragment (e.g., linear nucleic acid molecule) containing the incorporated genetic modifications can be separated from the plasmid containing the template sequence after a sufficient number of rounds of thermocycler amplification, using standard electrophoretic procedures. A modification of this method uses linear amplification methods and a pair of mutagenic primers that amplify the entire plasmid. The procedure takes advantage of the E. coli Dam methylase system which causes DNA replicated in vivo to be sensitive to the restriction endonucleases DpnI. PCR synthesized DNA is not methylated and is therefore resistant to DpnI. This approach allows the template plasmid to be digested, leaving the genetically modified, PCR synthesized plasmids to be isolated and transformed into a host bacteria for DNA repair and replication, thereby facilitating subsequent cloning and identification steps. A certain amount of randomness can be added to PCR-based sited directed mutagenesis by using partially degenerate primers.

Recombination sometimes can be used as a tool for mutagenesis. Homologous recombination allows the artisan to specifically target regions of known sequence for insertion of heterologous nucleotide sequences using the host organisms natural DNA replication and repair enzymes. Homologous recombination methods sometimes are referred to as "pop in pop out" mutagenesis, transplacement, knock out mutagenesis or knock in mutagenesis. Integration of a nucleic acid sequence into a host genome is a single cross over event, which inserts the entire nucleic acid reagent (e.g., pop in). A second cross over event excises all but a portion of the nucleic acid reagent, leaving behind a heterologous sequence, often referred to as a "footprint" (e.g., pop out). Mutagenesis by insertion (e.g., knock in) or by double recombination leaving behind a disrupting heterologous nucleic acid (e.g., knock out) both server to disrupt or "knock out" the function of the gene or nucleic acid sequence in which insertion occurs. By combining selectable markers and/or auxotrophic markers with nucleic acid reagents designed to provide the appropriate nucleic acid target sequences, the artisan can target a selectable nucleic acid reagent to a specific region, and then select for recombination events that "pop out" a portion of the inserted (e.g., "pop in") nucleic acid reagent.

Such methods take advantage of nucleic acid reagents that have been specifically designed with known target nucleic acid sequences at or near a nucleic acid or genomic region of interest. Popping out typically leaves a "foot print" of left over sequences that remain after the recombination event. The left over sequence can disrupt a gene and thereby reduce or eliminate expression of that gene. In some embodiments, the method can be used to insert sequences, upstream or downstream of genes that can result in an enhancement or reduction in expression of the gene. In certain embodiments, new genes can be introduced into the genome of a host organism using similar recombination or "pop in" methods. An example of a yeast recombination system using the ura3 gene and 5-FOA were described briefly above and further detail is presented herein.

A method for modification is described in Alani et al., "A method for gene disruption that allows repeated use of URA3 selection in the construction of multiply disrupted yeast strains", Genetics 116(4):541-545 August 1987. The original method uses a Ura3 cassette with 1000 base pairs (bp) of the same nucleotide sequence cloned in the same orientation on either side of the URA3 cassette. Targeting sequences of about 50 bp are added to each side of the construct. The double stranded targeting sequences are complementary to sequences in the genome of the host organism. The targeting sequences allow site-specific recombination in a region of interest. The modification of the original technique replaces the two 1000 bp sequence direct repeats with two 200 bp direct repeats. The modified method also uses 50 bp targeting sequences. The modification reduces or eliminates recombination of a second knock out into the 1000 bp repeat left behind in a first mutagenesis, therefore allowing multiply knocked out yeast. Additionally, the 200 bp sequences used herein are uniquely designed, self-assembling sequences that leave behind identifiable footprints. The technique used to design the sequences incorporate design features such as low identity to the yeast genome, and low identity to each other. Therefore a library of the self-assembling sequences can be generated to allow multiple knockouts in the same organism, while reducing or eliminating the potential for integration into a previous knockout.

As noted above, the URA3 cassette makes use of the toxicity of 5-FOA in yeast carrying a functional URA3 gene. Uracil synthesis deficient yeast are transformed with the modified URA3 cassette, using standard yeast transformation protocols, and the transformed cells are plated on minimal media minus uracil. In some embodiments, PCR can be used to verify correct insertion into the region of interest in the host genome, and certain embodiments the PCR step can be omitted. Inclusion of the PCR step can reduce the number of transformants that need to be counter selected to "pop out" the URA3 cassette. The transformants (e.g., all or the ones determined to be correct by PCR, for example) can then be counter-selected on media containing 5-FOA, which will select for recombination out (e.g., popping out) of the URA3 cassette, thus rendering the yeast ura3 deficient again, and resistant to 5-FOA toxicity. Targeting sequences used to direct recombination events to specific regions are presented herein. A modification of the method described above can be used to integrate genes in to the chromosome, where after recombination a functional gene is left in the chromosome next to the 200 bp footprint.

In some embodiments, other auxotrophic or dominant selection markers can be used in place of URA3 (e.g., an auxotrophic selectable marker), with the appropriate change in selection media and selection agents. Auxotrophic selectable markers are used in strains deficient for synthesis of a required biological molecule (e.g., amino acid or nucleoside, for example). Non-limiting examples of additional auxotrophic markers include; HIS3, TRP1, LEU2, LEU2-d, and LYS2. Certain auxotrophic markers (e.g., URA3 and LYS2) allow counter selection to select for the second recombination event that pops out all but one of the direct repeats of the recombination construct. HIS3 encodes an activity involved in histidine synthesis. TRP1 encodes an activity involved in tryptophan synthesis. LEU2 encodes an activity involved in leucine synthesis. LEU2-d is a low expression version of LEU2 that selects for increased copy number (e.g., gene or plasmid copy number, for example) to allow survival on minimal media without leucine. LYS2 encodes an activity involved in lysine synthesis, and allows counter selection for recombination out of the LYS2 gene using alpha-aminoadipate (α-aminoadipate).

Dominant selectable markers are useful because they also allow industrial and/or prototrophic strains to be used for genetic manipulations. Additionally, dominant selectable markers provide the advantage that rich medium can be used for plating and culture growth, and thus growth rates are markedly increased. Non-limiting examples of dominant selectable markers include; Tn903 kan$^r$, Cm$^r$, Hyg$^r$, CUP1, and DHFR. Tn903 kan$_r$ encodes an activity involved in kanamycin antibiotic resistance (e.g., typically neomycin phosphotransferase II or NPTII, for example). Cm$^r$ encodes an activity involved in chloramphenicol antibiotic resistance (e.g., typically chloramphenicol acetyl transferase or CAT, for example). Hyg$^r$ encodes an activity involved in hygromycin resistance by phosphorylation of hygromycin B (e.g., hygromycin phosphotransferase, or HPT). CUP1 encodes an activity involved in resistance to heavy metal (e.g., copper, for example) toxicity. DHFR encodes a dihydrofolate reductase activity which confers resistance to methotrexate and sulfanilamde compounds.

In contrast to site-directed or specific mutagenesis, random mutagenesis does not require any sequence information and can be accomplished by a number of widely different methods. Random mutagenesis often is used to generate mutant libraries that can be used to screen for the desired genotype or phenotype. Non-limiting examples of random mutagenesis include; chemical mutagenesis, UV-induced mutagenesis, insertion element or transposon-mediated mutagenesis, DNA shuffling, error-prone PCR mutagenesis, and the like.

Chemical mutagenesis often involves chemicals like ethyl methanesulfonate (EMS), nitrous acid, mitomycin C, N-methyl-N-nitrosourea (MNU), diepoxybutane (DEB), 1, 2, 7, 8-diepoxyoctane (DEO), methyl methane sulfonate (MMS), N-methyl-N'-nitro-N-nitrosoguanidine (MNNG), 4-nitroquinoline 1-oxide (4-NQO), 2-methyloxy-6-chloro-9 (3-[ethyl-2-chloroethyl]-aminopropylamino)-acridinedihydrochloride (ICR-170), 2-amino purine (2AP), and hydroxylamine (HA), provided herein as non-limiting examples. These chemicals can cause base-pair substitutions, frame-shift mutations, deletions, transversion mutations, transition mutations, incorrect replication, and the like. In some embodiments, the mutagenesis can be carried out in vivo. Sometimes the mutagenic process involves the use of the host organisms DNA replication and repair mechanisms to incorporate and replicate the mutagenized base or bases.

Another type of chemical mutagenesis involves the use of base-analogs. The use of base-analogs cause incorrect base pairing which in the following round of replication is corrected to a mismatched nucleotide when compared to the starting sequence. Base analog mutagenesis introduces a small amount of non-randomness to random mutagenesis, because specific base analogs can be chose which can be incorporated at certain nucleotides in the starting sequence. Correction of the mispairing typically yields a known substitution. For example, Bromo-deoxyuridine (BrdU) can be incorporated into DNA and replaces T in the sequence. The host DNA repair and replication machinery can sometime correct the defect, but sometimes will mispair the BrdU with a G. The next round of replication then causes a G-C transversion from the original A-T in the native sequence.

Ultra violet (UV) induced mutagenesis is caused by the formation of thymidine dimers when UV light irradiates chemical bonds between two adjacent thymine residues. Excision repair mechanism of the host organism correct the lesion in the DNA, but occasionally the lesion is incorrectly repaired typically resulting in a C to T transition.

Insertion element or transposon-mediated mutagenesis makes use of naturally occurring or modified naturally occurring mobile genetic elements. Transposons often encode accessory activities in addition to the activities necessary for transposition (e.g., movement using a transposase activity, for example). In many examples, transposon accessory activities are antibiotic resistance markers (e.g., see Tn903 kan$^r$ described above, for example). Insertion elements typically only encode the activities necessary for movement of the nucleic acid sequence. Insertion element and transposon mediated mutagenesis often can occur randomly, however specific target sequences are known for some transposons. Mobile genetic elements like IS elements or Transposons (Tn) often have inverted repeats, direct repeats or both inverted and direct repeats flanking the region coding for the transposition genes. Recombination events catalyzed by the transposase cause the element to remove itself from the genome and move to a new location, leaving behind a portion of an inverted or direct repeat. Classic examples of transposons are the "mobile genetic elements" discovered in maize. Transposon mutagenesis kits are commercially available which are designed to leave behind a 5 codon insert (e.g., Mutation Generation System kit, Finnzymes, World Wide Web URL finnzymes.us, for example). This allows the artisan to identify the insertion site, without fully disrupting the function of most genes.

DNA shuffling is a method which uses DNA fragments from members of a mutant library and reshuffles the fragments randomly to generate new mutant sequence combinations. The fragments are typically generated using DNaseI, followed by random annealing and re-joining using self priming PCR. The DNA overhanging ends, from annealing of random fragments, provide "primer" sequences for the PCR process. Shuffling can be applied to libraries generated by any of the above mutagenesis methods.

Error prone PCR and its derivative rolling circle error prone PCR uses increased magnesium and manganese concentrations in conjunction with limiting amounts of one or two nucleotides to reduce the fidelity of the Taq polymerase.

The error rate can be as high as 2% under appropriate conditions, when the resultant mutant sequence is compared to the wild type starting sequence. After amplification, the library of mutant coding sequences must be cloned into a suitable plasmid. Although point mutations are the most common types of mutation in error prone PCR, deletions and frameshift mutations are also possible. There are a number of commercial error-prone PCR kits available, including those from Stratagene and Clontech (e.g., World Wide Web URL strategene.corn and World Wide Web URL clontech.com, respectively, for example). Rolling circle error-prone PCR is a variant of error-prone PCR in which wild-type sequence is first cloned into a plasmid, then the whole plasmid is amplified under error-prone conditions.

As noted above, organisms with altered activities can also be isolated using genetic selection and screening of organisms challenged on selective media or by identifying naturally occurring variants from unique environments. For example, 2-Deoxy-D-glucose is a toxic glucose analog. Growth of yeast on this substance yields mutants that are glucose-deregulated. A number of mutants have been isolated using 2-Deoxy-D-glucose including transport mutants, and mutants that ferment glucose and galactose simultaneously instead of glucose first then galactose when glucose is depleted. Similar techniques have been used to isolate mutant microorganisms that can metabolize plastics (e.g., from landfills), petrochemicals (e.g., from oil spills), and the like, either in a laboratory setting or from unique environments.

Similar methods can be used to isolate naturally occurring mutations in a desired activity when the activity exists at a relatively low or nearly undetectable level in the organism of choice, in some embodiments. The method generally consists of growing the organism to a specific density in liquid culture, concentrating the cells, and plating the cells on various concentrations of the substance to which an increase in metabolic activity is desired. The cells are incubated at a moderate growth temperature, for 5 to 10 days. To enhance the selection process, the plates can be stored for another 5 to 10 days at a low temperature. The low temperature sometimes can allow strains that have gained or increased an activity to continue growing while other strains are inhibited for growth at the low temperature. Following the initial selection and secondary growth at low temperature, the plates can be replica plated on higher or lower concentrations of the selection substance to further select for the desired activity.

A native, heterologous or mutagenized polynucleotide can be introduced into a nucleic acid reagent for introduction into a host organism, thereby generating an engineered microorganism. Standard recombinant DNA techniques (restriction enzyme digests, ligation, and the like) can be used by the artisan to combine the mutagenized nucleic acid of interest into a suitable nucleic acid reagent capable of (i) being stably maintained by selection in the host organism, or (ii) being integrating into the genome of the host organism. As noted above, sometimes nucleic acid reagents comprise two replication origins to allow the same nucleic acid reagent to be manipulated in bacterial before final introduction of the final product into the host organism (e.g., yeast or fungus for example). Standard molecular biology and recombinant DNA methods are known (e.g., described in Maniatis, T., E. F. Fritsch and J. Sambrook (1982) Molecular Cloning: a Laboratory Manual; Cold Spring Harbor Laboratory, Cold Spring Harbor, N.Y.).

Nucleic acid reagents can be introduced into microorganisms using various techniques. Non-limiting examples of methods used to introduce heterologous nucleic acids into various organisms include; transformation, transfection, transduction, electroporation, ultrasound-mediated transformation, particle bombardment and the like. In some instances the addition of carrier molecules (e.g., bis-benzimdazolyl compounds, for example, see U.S. Pat. No. 5,595,899) can increase the uptake of DNA in cells typically though to be difficult to transform by conventional methods. Conventional methods of transformation are known (e.g., described in Maniatis, T., E. F. Fritsch and J. Sambrook (1982) *Molecular Cloning: a Laboratory Manual*; Cold Spring Harbor Laboratory, Cold Spring Harbor, N.Y.).

Modified Activities

Certain activities in a genetically modified organism can be modified by techniques known in the art. An acyl-CoA oxidase activity or acyl-CoA dehydrogenase activity, or acyl-CoA oxidase activity and acyl-CoA dehydrogenase activity, can be modified in an organism in certain embodiments. In some embodiments, a modified endogenous acyl-CoA oxidase polypeptide, modified endogenous acyl-CoA dehydrogenase polypeptide, modified heterologous acyl-CoA oxidase polypeptide, and/or modified heterologous acyl-CoA dehydrogenase polypeptide may be introduced into an organism. A modified polypeptide can be expressed by a host organism that includes a modified polynucleotide encoding the modified polypeptide. Modified polypeptides often have an activity different than the activity of an unmodified counterpart. A modified activity sometimes is a different catalytic activity or a different substrate specificity, or a different catalytic activity and a different substrate specificity. A different activity sometimes is an activity that is higher or lower than the activity of an unmodified counterpart polypeptide. In some embodiments, the catalytic activity of a modified polypeptide is higher or lower than the catalytic activity of the unmodified counterpart for a particular substrate. In certain embodiments, the substrate specificity of a modified polypeptide is higher or lower than the substrate specificity of the unmodified counterpart for a particular substrate. A modified polypeptide often is active and an activity of a modified polypeptide often can be detected (e.g., substrate turnover can be detected). A desired activity for a particular polypeptide sometimes is referred to as a "target activity."

In some embodiments a genetic modification in a genetically modified organism alters a substrate specificity of an acyl-CoA oxidase polypeptide produced in the organism. Sometimes the substrate specificity is reduced for a substrate having a particular chain length. In some embodiments, a modified acyl-CoA oxidase substrate specificity is reduced for a C8, C10, C12, C14, C16, C18, C20 substrate or combination thereof. In certain embodiments, a modified acyl-CoA oxidase substrate specificity is reduced for a C10, C12, or C18 substrate.

In some embodiments a genetic modification in a genetically modified organism alters a substrate specificity of an acyl-CoA dehydrogenase polypeptide produced in the organism. Sometimes a co-factor specificity is modified, and in some embodiments the modified polypeptide prefers to utilize oxygen as a co-factor.

One or more particular modifications can be selected to generate a modified polypeptide having a target activity. Modifications often are amino acid modifications (e.g., deletion, insertion of one or more amino acids). Amino acid modifications sometimes are amino acid substitutions. Amino acid substitutions sometimes are conservative, non-limiting examples of which include substitution of an amino acid containing an acidic moiety to another amino acid containing an acidic moiety (e.g., D, E), substitution of an amino acid containing a basic moiety to another amino acid containing a basic moiety (e.g., H, K, R), substitution of an amino acid containing an aliphatic chain moiety to another amino acid containing an aliphatic chain moiety (V, L, I, A), substitution of an amino acid containing a cyclic moiety to another amino acid containing a cyclic moiety (e.g., W, F, Y), and substitution of an amino acid containing a polar moiety to another amino acid containing a polar moiety (e.g., S, T). Amino acid substitutions sometimes are non-conservative, non-limiting examples of which include substitution of an amino acid containing an acidic moiety to an amino acid containing a basic moiety, substitution of an amino acid containing a basic moiety to an amino acid containing an acidic moiety, substitution of an amino acid containing relatively small moiety (e.g., G, A) to another amino acid containing a relatively large moiety (e.g., Y, W, F, I, L), and substitution of an amino acid containing a relatively large moiety to another amino acid containing an relatively small moiety.

Particular modifications can be selected using any suitable method known in the art. In certain embodiments, a reference structure is known for a related polypeptide with a known activity, and modifications to a target polypeptide can be guided by alignment of the target polypeptide structure to the reference structure. A reference structure sometimes is a primary structure (e.g., polynucleotide or polypeptide sequence) and the primary structure of a target can be aligned to the reference structure using an alignment method known in the art. Particular amino acids in the target that align with (e.g., are identical to or homologous to) or do not align with (e.g., are not identical to or not homologous to) particular amino acids in the reference can be selected for modification. Selections can be made by inspection of an alignment or by software known in the art that identifies, scores and/or ranks amino acids for modification based on an alignment.

A reference structure sometimes is a secondary structure, tertiary structure or quaternary structure, each of which are three dimensional structures pertaining to a polypeptide. A primary structure of a target polypeptide can be modeled to a secondary, tertiary or quaternary reference structure using three-dimensional modeling software known in the art. A secondary, tertiary or quaternary structure of a target polypeptide can be compared to a secondary, tertiary or quaternary reference structure using three-dimensional comparative software known in the art. Particular structures (e.g., a particular individual amino acid; a particular group of contiguous or non-contiguous amino acids) in the target that align with or map to, or do not align with or map to, particular structures in the reference can be selected for modification. Also, particular structures in the target that are in proximity to a substrate or co-factor can be selected for modification. Selections can be made by inspection of an alignment or map or by software known in the art that identifies, scores and/or ranks amino acids and/or structures for modification based on an alignment and map.

After particular amino acids and/or structures are selected for modification in a first polypeptide, amino acids and structures in a second polypeptide that align with the selected amino acids and structures in the first polypeptide may be identified. In a non-limiting example, particular amino acid substitutions and structural modifications (e.g., loop amino acid deletion/insertion) for *Candida* spp. POX4 and POX5 polypeptides are disclosed herein. A primary' structure of another acyl-CoA oxidase polypeptide can be aligned with the amino acid sequence or modeled structure of a POX4 or POX5 polypeptide and some or all amino acids of the other polypeptide that align with those selected for modification in the POX4 or POX5 polypeptide also can be selected for modification. Certain criteria for selecting acyl-CoA dehydrogenase modifications also are described herein.

One or more activities of a modified polypeptide can be characterized using any suitable assay known in the art. A modified polypeptide can be expressed in an organism other than a target organism in which a target product will be produced, for assaying activity. For example, a modified polypeptide can be expressed in a bacterium (e.g., *E. coli*), assayed and then introduced into a yeast (e.g., *Candida* spp. yeast) for production of a target diacid.

Feedstocks, Media, Supplements & Additives

Engineered microorganisms often are cultured under conditions that optimize yield of a fatty dicarboxylic acid (e.g., an eight to eighteen-carbon fatty dicarboxylic acid). Non-limiting examples of fatty dicarboxylic acids include suberic acid (i.e., octanedioic acid, 1,8-octanedioic acid, octanedioic acid, octane-1,8-dioic acid, 1,6-hexanedicarboxylic acid, capryllic diacids), sebacic acid (i.e., 1,10-decanedioic acid, decanedioic acid, decane-1,10-dioic acid, 1,8-octanedicarboxylic acid, capric diacid), dodecanedioic acid (i.e., DDDA, 1,12-dodecanedioic acid, dodecanedioic acid, dodecane-1,12-dioic acid, 1,10-decanedicarboxylic acid, decamethylenedicaboxylic acid, 1,10-dicarboxydecane, lauric diacid), tetradecanedioic acid (i.e., TDDA, 1,14-tetradecanedioic acid, tetradecanedioic acid, tetradecane-1,14-dioic acid, 1,12-dodecanedicarboxylic acid, myristic diacid), thapsic acid (i.e., hexadecanedioic acid, 1,16-hexadecanedioic acid, hexadecanedioic acid, hexadecane-1,16-dioic acid, 1,14-tetradecanedicarboxylic acid, palmitic diacid), cis-9-hexadecenedioic acid (i.e., palmitoleic diacids), octanedioic acid (i.e., 1,18-octadecanedioic acid, octadecanedioic acid, octadecane-1,18-dioic acid, 1,16-hexadecanedicarboxylic acid, stearic diacid), cis-9-octadecenedioic acid (i.e., oleic diacids), cis-9,12-octadecenedioic acid (i.e., linoleic diacids), cis-9,12,15-octadecenedioic acid (i.e., linolenic diacids), arachidic diacid (i.e., eicosanoic diacid, icosanoic diacid), 11-eicosenoic diacid (i.e., cis-11-eicosenedioic acid), 13-eicosenoic diacids (i.e., cis-13-eicosenedioic acid), arachidonic diacid (i.e., cis-5,8,11,14-eicosatetraenedioic acid). Culture conditions often optimize activity of one or more of the following activities: omega oxo fatty acid dehydrogenase activity, omega hydroxyl fatty acid dehydrogenase activity, acetyl CoA carboxylase activity, monooxygenase activity, monooxygenase reductase activity, fatty alcohol oxidase, acyl-CoA ligase, acyl-CoA oxidase, enoyl-CoA hydratase, 3-hydroxyacyl-CoA dehydrogenase, and/or acyltransferase (e.g., acetyl-CoA C-acyltransferase) activities. In general, non-limiting examples of conditions that may be optimized include the type and amount of carbon source, the type and amount of nitrogen source, the carbon-to-nitrogen ratio, the oxygen level, growth temperature, pH, length of the biomass production phase, length of target product accumulation phase, and time of cell harvest.

Culture media generally contain a suitable carbon source. Carbon sources useful for culturing microorganisms and/or fermentation processes sometimes are referred to as feedstocks. The term "feedstock" as used herein refers to a composition containing a carbon source that is provided to an organism, which is used by the organism to produce energy and metabolic products useful for growth. A feedstock may be a natural substance, a "man-made substance," a purified or isolated substance, a mixture of purified substances, a mixture of unpurified substances or combinations thereof. A feedstock often is prepared by and/or provided to an organism by a person, and a feedstock often is formulated prior to administration to the organism. A carbon source may comprise, but is not limited to including, one or more of the following substances: alkanes, alkenes, mono-carboxylic acids, di-carboxylic acids, monosaccharides (e.g., also referred to as "saccharides," which include 6-carbon sugars (e.g., glucose, fructose), 5-carbon sugars (e.g., xylose and other pentoses) and the like), disaccharides (e.g., lactose, sucrose), oligosaccharides (e.g., glycans, homopolymers of a monosaccharide), polysaccharides (e.g., starch, cellulose, heteropolymers of monosaccharides or mixtures thereof), sugar alcohols (e.g., glycerol), and renewable feedstocks (e.g., cheese whey permeate, cornsteep liquor, sugar beet molasses, barley malt).

Carbon sources also can be selected from one or more of the following non-limiting examples: paraffin (e.g., saturated paraffin, unsaturated paraffin, substituted paraffin, linear paraffin, branched paraffin, or combinations thereof); alkanes (e.g., dodecane), alkenes or alkynes, each of which may be linear, branched, saturated, unsaturated, substituted or combinations thereof (described in greater detail below); linear or branched alcohols (e.g., dodecanol); fatty acids (e.g., about 1 carbon to about 60 carbons, including free fatty acids, soap stock, for example); esters of fatty acids; monoglycerides; diglycerides; triglycerides, phospholipids. Non-limiting commercial sources of products for preparing feedstocks include plants, plant oils or plant products (e.g., vegetable oils (e.g., almond oil, canola oil, cocoa butter, coconut oil, corn oil, cottonseed oil, flaxseed oil, grape seed oil, illipe, olive oil, palm oil, palm olein, palm kernel oil, safflower oil, peanut oil, soybean oil, sesame oil, shea nut oil, sunflower oil walnut oil, the like and combinations thereof) and animal fats (e.g., beef tallow, butterfat, lard, cod liver oil). A carbon source may include a petroleum product and/or a petroleum distillate (e.g., diesel, fuel oils, gasoline, kerosene, paraffin wax, paraffin oil, petrochemicals). In some embodiments, a feedstock comprises petroleum distillate. A carbon source can be a fatty acid distillate (e.g., a palm oil distillate or corn oil distillate). Fatty acid distillates can be by-products from the refining of crude plant oils. In some embodiments, a feedstock comprises a fatty acid distillate.

In some embodiments, a feedstock comprises a soapstock (i.e. soap stock). A widely practiced method for purifying crude vegetable oils for edible use is the alkali or caustic refining method. This process employs a dilute aqueous solution of caustic soda to react with the free fatty acids present which results in the formation of soaps. The soaps together with hydrated phosphatides, gums and prooxidant metals are typically separated from the refined oil as the heavy phase discharge from the refining centrifuge and are typically known as soapstock.

A carbon source also may include a metabolic product that can be used directly as a metabolic substrate in an engineered pathway described herein, or indirectly via conversion to a different molecule using engineered or native biosynthetic pathways in an engineered microorganism. In certain embodiments, metabolic pathways can be preferentially biased towards production of a desired product by increasing the levels of one or more activities in one or more metabolic pathways having and/or generating at least one common metabolic and/or synthetic substrate. In some embodiments, a metabolic byproduct (e.g., fatty acid) of an engineered activity (e.g., omega oxidation activity) can be used in one or more metabolic pathways selected from gluconeogenesis, pentose phosphate pathway, glycolysis, fatty acid synthesis, beta oxidation, and omega oxidation, to generate a carbon source that can be converted to a fatty dicarboxylic acid (e.g., octanedioic acid, decanedioic acid, dodecanedioic acid, tetradecanedioic acid, hexadecanedioic acid, octadecanedioic acid, eicosanedioic acid).

The term "paraffin" as used herein refers to the common name for alkane hydrocarbons, independent of the source (e.g., plant derived, petroleum derived, chemically synthesized, fermented by a microorganism), or carbon chain length. A carbon source sometimes comprises a paraffin, and in some embodiments, a paraffin is predominant in a carbon source (e.g., about 75%, 80%, 85%, 90% or 95% paraffin). A paraffin sometimes is saturated (e.g., fully saturated), sometimes includes one or more unsaturations (e.g., about 1, 2, 3, 4, 5, 6, 7, 8, 9, 10 unsaturations) and sometimes is substituted with one or more non-hydrogen substituents. Non-limiting examples of non-hydrogen substituents include halo, acetyl, =O, =N—CN, =N—OR, =NR, OR, $NR_2$, SR, $SO_2R$, $SO_2NR_2$, $NRSO_2R$, $NRCONR_2$, NRCOOR, NRCOR, CN, COOR, $CONR_2$, OOCR, COR, and $NO_2$, where each R is independently H, C1-C8 alkyl, C2-C8 heteroalkyl, C1-C8 acyl, C2-C8 heteroacyl, C2-C8 alkenyl, C2-C8 heteroalkenyl, C2-C8 alkynyl, C2-C8 heteroalkynyl, C6-C10 aryl, or C5-C10 heteroaryl, and each R is optionally substituted with halo, =O, =N—CN, =N—OR', =NR', OR', $NR'_2$, SR', $SO_2R'$, $SO_2NR'_2$, $NR'SO_2R'$, $NR'CONR'_2$, NR'COOR', NR'COR', CN, COOR', $CONR'_2$, OOCR', COR', and $NO_2$, where each R' is independently H, C1-C8 alkyl, C2-C8 heteroalkyl, C1-C8 acyl, C2-C8 heteroacyl, C6-C10 aryl or C5-C10 heteroaryl.

In some embodiments a feedstock is selected according to the genotype and/or phenotype of the engineered microorganism to be cultured. For example, a feedstock rich in 12-carbon fatty acids, 12-carbon dicarboxylic acids or 12-carbon paraffins, or a mixture of 10, 12 and 14-carbon compounds can be useful for culturing yeast strains harboring an alteration that partially blocks beta oxidation by disrupting POX4 activity, as described herein. Non-limiting examples of carbon sources having 10 to 14 carbons include fats (e.g., coconut oil, palm kernel oil), paraffins (e.g., alkanes, alkenes, or alkynes) having 10 to 14 carbons, (e.g., dodecane (also referred to as adakane12, bihexyl, dihexyl and duodecane); tetradecane), alkene and alkyne derivatives), fatty acids (dodecanoic acid, tetradecanoic acid), fatty alcohols (dodecanol, tetradecanol), the like, non-toxic substituted derivatives or combinations thereof.

A carbon source sometimes comprises an alkyl, alkenyl or alkynyl compound or molecule (e.g., a compound that includes an alkyl, alkenyl or alkynyl moiety (e.g., alkane, alkene, alkyne)). In certain embodiments, an alkyl, alkenyl or alkynyl molecule, or combination thereof, is predominant in a carbon source (e.g., about 75%, 80%, 85%, 90% or 95% of such molecules). As used herein, the terms "alkyl," "alkenyl" and "alkynyl" include straight-chain (referred to herein as "linear"), branched-chain (referred to herein as "non-linear"), cyclic monovalent hydrocarbyl radicals, and combinations of these, which contain only C and H atoms when they are unsubstituted. Non-limiting examples of alkyl moieties include methyl, ethyl, isobutyl, cyclohexyl, cyclopentylethyl, 2-propenyl, 3-butynyl, and the like. An alkyl that contains only C and H atoms and is unsubstituted sometimes is referred to as "saturated." An alkenyl or alkynyl generally is "unsaturated" as it contains one or more double bonds or triple bonds, respectively. An alkenyl can include any number of double bonds, such as 1, 2, 3, 4 or 5 double bonds, for example. An alkynyl can include any number of triple bonds, such as 1, 2, 3, 4 or 5 triple bonds, for example. Alkyl, alkenyl and alkynyl molecules sometimes contain between about 2 to about 60 carbon atoms (C). For example, an alkyl, alkenyl and alkynyl molecule can include about 1 carbon atom, about 2 carbon atoms, about 3 carbon atoms, about 4 carbon atoms, about 5 carbon atoms, about 6 carbon atoms, about 7 carbon atoms, about 8 carbon atoms, about 9 carbon atoms, about 10 carbon atoms, about 12 carbon atoms, about 14 carbon atoms, about 16 carbon atoms, about 18 carbon atoms, about 20 carbon atoms, about 22 carbon atoms, about 24 carbon atoms, about 26 carbon atoms, about 28 carbon atoms, about 30 carbon atoms, about 32 carbon atoms, about 34 carbon atoms, about 36 carbon atoms, about 38 carbon atoms, about 40 carbon atoms, about 42 carbon atoms, about 44 carbon atoms, about 46 carbon atoms, about 48 carbon atoms, about 50 carbon atoms, about 52 carbon atoms, about 54 carbon atoms, about 56 carbon atoms, about 58 carbon atoms or about 60 carbon atoms. In some embodiments, paraffins can have a mean number of carbon atoms of between about 8 to about 18 carbon atoms (e.g., about 8 carbon atoms, about 9 carbon atoms, about 10 carbon atoms, about 11 carbon atoms, about 12 carbon atoms, about 13 carbon atoms, about 14 carbon atoms, about 15 carbon atoms, about 16 carbon atoms, about 17 carbon atoms and about 18 carbon atoms). A single group can include more than one type of multiple bond, or more than one multiple bond. Such groups are included within the definition of the term "alkenyl" when they contain at least one carbon-carbon double bond, and are included within the term "alkynyl" when they contain at least one carbon-carbon triple bond. Alkyl, alkenyl and alkynyl molecules include molecules that comprise an alkyl, alkenyl and/or alkynyl moiety, and include molecules that consist of an alkyl, alkenyl or alkynyl moiety (i.e., alkane, alkene and alkyne molecules).

Alkyl, alkenyl and alkynyl substituents sometimes contain 1-20C (alkyl) or 2-20C (alkenyl or alkynyl). They can contain about 8-20C or about 10-20C in some embodiments. A single group can include more than one type of multiple bond, or more than one multiple bond. Such groups are included within the definition of the term "alkenyl" when they contain at least one carbon-carbon double bond, and are included within the term "alkynyl" when they contain at least one carbon-carbon triple bond.

Alkyl, alkenyl and alkynyl groups or compounds sometimes are substituted to the extent that such substitution can be synthesized and can exist. Typical substituents include, but are not limited to, halo, acetyl, =O, =N—CN, =N—OR, =NR, OR, NR$_2$, SR, SO$_2$R, SO$_2$NR$_2$, NRSO$_2$R, NRCONR$_2$, NRCOOR, NRCOR, CN, COOR, CONR$_2$, OOCR, COR, and NO$_2$, where each R is independently H, C1-C8 alkyl, C2-C8 heteroalkyl, C1-C8 acyl, C2-C8 heteroacyl, C2-C8 alkenyl, C2-C8 heteroalkenyl, C2-C8 alkynyl, C2-C8 heteroalkynyl, C6-C11 aryl, or C5-C11 heteroaryl, and each R is optionally substituted with halo, =O, =N—CN, =NR', OR', NR'$_2$, SR', SO$_2$R', SO$_2$NR'$_2$, NR'SO$_2$R', NR'CONR'$_2$, NR'COOR', NR'COR', CN, COOR', CONR'$_2$, OOCR', COR', and NO$_2$, where each R' is independently H, C1-C8 alkyl, C2-C8 heteroalkyl, C1-C8 acyl, C2-C8 heteroacyl, C6-C10 aryl or C5-C10 heteroaryl. Alkyl, alkenyl and alkynyl groups can also be substituted by C1-C8 acyl, C2-C8 heteroacyl, C6-C10 aryl or C5-C10 heteroaryl, each of which can be substituted by the substituents that are appropriate for the particular group.

"Acetylene" or "acetyl" substituents are 2-10C alkynyl groups that are optionally substituted, and are of the formula where Ri is H or C1-C8 alkyl, C2-C8 heteroalkyl, C2-C8 alkenyl, C2-C8 heteroalkenyl, C2-C8 alkynyl, C2-C8 heteroalkynyl, C1-C8 acyl, C2-C8 heteroacyl, C6-C10 aryl, C5-C10 heteroaryl, C7-C12 arylalkyl, or C6-C12 heteroarylalkyl, and each Ri group is optionally substituted with one or more substituents selected from halo, =O, =N—CN, =N—OR', =NR', OR', NR'2, SR', SO$_2$R', SO$_2$NR'$_2$, NR'SO$_2$R', NR'CONR'$_2$, NR'COOR', NR'COR', CN, COOR', CONR'$_2$, OOCR', COR', and NO$_2$, where each R' is independently H, C1-C6 alkyl, C2-C6 heteroalkyl, C1-C6 acyl, C2-C6 heteroacyl, C6-C10 aryl, C5-C10 heteroaryl, C7-12 arylalkyl, or C6-12 heteroarylalkyl, each of which is optionally substituted with one or more groups selected from halo, C1-C4 alkyl, C1-C4 heteroalkyl, C1-C6 acyl, C1-C6 heteroacyl, hydroxy, amino, and =O; and where two R' can be linked to form a 3-7 membered ring optionally containing up to three heteroatoms selected from N, O and S. In some embodiments, Ri of —C≡C-Ri is H or Me.

A carbon source sometimes comprises a heteroalkyl, heteroalkenyl and/or heteroalkynyl molecule or compound (e.g., comprises heteroalkyl, heteroalkenyl and/or heteroalkynyl moiety (e.g., heteroalkane, heteroalkene or heteroalkyne)). "Heteroalkyl", "heteroalkenyl", and "heteroalkynyl" and the like are defined similarly to the corresponding hydrocarbyl (alkyl, alkenyl and alkynyl) groups, but the 'hetero' terms refer to groups that contain one to three O, S or N heteroatoms or combinations thereof within the backbone; thus at least one carbon atom of a corresponding alkyl, alkenyl, or alkynyl group is replaced by one of the specified heteroatoms to form a heteroalkyl, heteroalkenyl, or heteroalkynyl group. The typical and sizes for heteroforms of alkyl, alkenyl and alkynyl groups are generally the same as for the corresponding hydrocarbyl groups, and the substituents that may be present on the heteroforms are the same as those described above for the hydrocarbyl groups. For reasons of chemical stability, it is also understood that, unless otherwise specified, such groups do not include more than two contiguous heteroatoms except where an oxo group is present on N or S as in a nitro or sulfonyl group.

The term "alkyl" as used herein includes cycloalkyl and cycloalkylalkyl groups and compounds, the term "cycloalkyl" may be used herein to describe a carbocyclic non-aromatic compound or group that is connected via a ring carbon atom, and "cycloalkylalkyl" may be used to describe a carbocyclic non-aromatic compound or group that is connected to a molecule through an alkyl linker. Similarly, "heterocyclyl" may be used to describe a non-aromatic cyclic group that contains at least one heteroatom as a ring member and that is connected to the molecule via a ring atom, which may be C or N; and "heterocyclylalkyl" may be used to describe such a group that is connected to another molecule through a linker. The sizes and substituents that are suitable for the cycloalkyl, cycloalkylalkyl, heterocyclyl, and heterocyclylalkyl groups are the same as those described above for alkyl groups. As used herein, these terms also include rings that contain a double bond or two, as long as the ring is not aromatic.

A carbon source sometimes comprises an acyl compound or moiety (e.g., compound comprising an acyl moiety). As used herein, "acyl" encompasses groups comprising an alkyl, alkenyl, alkynyl, aryl or arylalkyl radical attached at one of the two available valence positions of a carbonyl carbon atom, and heteroacyl refers to the corresponding groups where at least one carbon other than the carbonyl carbon has been replaced by a heteroatom chosen from N, O and S. Thus heteroacyl includes, for example, —C(=O)OR and —C(=O)NR$_2$ as well as —C(=O)-heteroaryl.

Acyl and heteroacyl groups are bonded to any group or molecule to which they are attached through the open valence of the carbonyl carbon atom. Typically, they are C1-C8 acyl groups, which include formyl, acetyl, pivaloyl, and benzoyl, and C2-C8 heteroacyl groups, which include methoxyacetyl, ethoxycarbonyl, and 4-pyridinoyl. The hydrocarbyl groups, aryl groups, and heteroforms of such groups that comprise an acyl or heteroacyl group can be substituted with the substituents described herein as generally suitable substituents for each of the corresponding component of the acyl or heteroacyl group.

A carbon source sometimes comprises one or more aromatic moieties and/or heteroaromatic moieties. "Aromatic" moiety or "aryl" moiety refers to a monocyclic or fused bicyclic moiety having the well-known characteristics of aromaticity; examples include phenyl and naphthyl. Similarly, "heteroaromatic" and "heteroaryl" refer to such monocyclic or fused bicyclic ring systems which contain as ring members one or more heteroatoms selected from O, S and N. The inclusion of a heteroatom permits aromaticity in 5 membered rings as well as 6 membered rings. Typical heteroaromatic systems include monocyclic C5-C6 aromatic groups such as pyridyl, pyrimidyl, pyrazinyl, thienyl, furanyl, pyrrolyl, pyrazolyl, thiazolyl, oxazolyl, and imidazolyl and the fused bicyclic moieties formed by fusing one of these monocyclic groups with a phenyl ring or with any of the heteroaromatic monocyclic groups to form a C8-C10 bicyclic group such as indolyl, benzimidazolyl, indazolyl, benzotriazolyl, isoquinolyl, quinolyl, benzothiazolyl, benzofuranyl, pyrazolopyridyl, quinazolinyl, quinoxalinyl, cinnolinyl, and the like. Any monocyclic or fused ring bicyclic system which has the characteristics of aromaticity in terms of electron distribution throughout the ring system is included in this definition. It also includes bicyclic groups where at least the ring which is directly attached to the remainder of the molecule has the characteristics of aromaticity. Typically, the ring systems contain 5-12 ring member atoms. The monocyclic heteroaryls sometimes contain 5-6 ring members, and the bicyclic heteroaryls sometimes contain 8-10 ring members.

Aryl and heteroaryl moieties may be substituted with a variety of substituents including C1-C8 alkyl, C2-C8 alkenyl, C2-C8 alkynyl, C5-C12 aryl, C1-C8 acyl, and heteroforms of these, each of which can itself be further substituted; other substituents for aryl and heteroaryl moieties include halo, OR, $NR_2$, SR, $SO_2R$, $SO_2NR_2$, $NRSO_2R$, $NRCONR_2$, NRCOOR, NRCOR, CN, COOR, $CONR_2$, OOCR, COR, and $NO_2$, where each R is independently H, C1-C8 alkyl, C2-C8 heteroalkyl, C2-C8 alkenyl, C2-C8 heteroalkenyl, C2-C8 alkynyl, C2-C8 heteroalkynyl, C6-C10 aryl, C5-C10 heteroaryl, C7-C12 arylalkyl, or C6-C12 heteroarylalkyl, and each R is optionally substituted as described above for alkyl groups. The substituent groups on an aryl or heteroaryl group may be further substituted with the groups described herein as suitable for each type of such substituents or for each component of the substituent. Thus, for example, an arylalkyl substituent may be substituted on the aryl portion with substituents typical for aryl groups, and it may be further substituted on the alkyl portion with substituents as typical or suitable for alkyl groups.

Similarly, "arylalkyl" and "heteroarylalkyl" refer to aromatic and heteroaromatic ring systems, which are stand-alone molecules (e.g., benzene or substituted benzene, pyridine or substituted pyridine), or which are bonded to an attachment point through a linking group such as an alkylene, including substituted or unsubstituted, saturated or unsaturated, cyclic or acyclic linkers. A linker often is C1-C8 alkyl or a hetero form thereof. These linkers also may include a carbonyl group, thus making them able to provide substituents as an acyl or heteroacyl moiety. An aryl or heteroaryl ring in an arylalkyl or heteroarylalkyl group may be substituted with the same substituents described above for aryl groups. An arylalkyl group sometimes includes a phenyl ring optionally substituted with the groups defined above for aryl groups and a C1-C4 alkylene that is unsubstituted or is substituted with one or two C1-C4 alkyl groups or heteroalkyl groups, where the alkyl or heteroalkyl groups can optionally cyclize to form a ring such as cyclopropane, dioxolane, or oxacyclopentane. Similarly, a heteroarylalkyl group often includes a C5-C6 monocyclic heteroaryl group optionally substituted with one or more of the groups described above as substituents typical on aryl groups and a C1-C4 alkylene that is unsubstituted. A heteroarylalkyl group sometimes is substituted with one or two C1-C4 alkyl groups or heteroalkyl groups, or includes an optionally substituted phenyl ring or C5-C6 monocyclic heteroaryl and a C1-C4 heteroalkylene that is unsubstituted or is substituted with one or two C1-C4 alkyl or heteroalkyl groups, where the alkyl or heteroalkyl groups can optionally cyclize to form a ring such as cyclopropane, dioxolane, or oxacyclopentane.

Where an arylalkyl or heteroarylalkyl group is described as optionally substituted, the substituents may be on the alkyl or heteroalkyl portion or on the aryl or heteroaryl portion of the group. The substituents optionally present on the alkyl or heteroalkyl portion sometimes are the same as those described above for alkyl groups, and the substituents optionally present on the aryl or heteroaryl portion often are the same as those described above for aryl groups generally.

"Arylalkyl" groups as used herein are hydrocarbyl groups if they are unsubstituted, and are described by the total number of carbon atoms in the ring and alkylene or similar linker. Thus a benzyl group is a C7-arylalkyl group, and phenylethyl is a C8-arylalkyl.

"Heteroarylalkyl" as described above refers to a moiety comprising an aryl group that is attached through a linking group, and differs from "arylalkyl" in that at least one ring atom of the aryl moiety or one atom in the linking group is a heteroatom selected from N, O and S. The heteroarylalkyl groups are described herein according to the total number of atoms in the ring and linker combined, and they include aryl groups linked through a heteroalkyl linker; heteroaryl groups linked through a hydrocarbyl linker such as an alkylene; and heteroaryl groups linked through a heteroalkyl linker. Thus, for example, C7-heteroarylalkyl includes pyridylmethyl, phenoxy, and N-pyrrolylmethoxy.

"Alkylene" as used herein refers to a divalent hydrocarbyl group. Because an alkylene is divalent, it can link two other groups together. An alkylene often is referred to as —$(CH_2)_n$— where n can be 1-20, 1-10, 1-8, or 1-4, though where specified, an alkylene can also be substituted by other groups, and can be of other lengths, and the open valences need not be at opposite ends of a chain. Thus —CH(Me)- and —$C(Me)_2$— may also be referred to as alkylenes, as can a cyclic group such as cyclopropan-1,1-diyl. Where an alkylene group is substituted, the substituents include those typically present on alkyl groups as described herein.

In some embodiments, a feedstock includes a mixture of carbon sources, where each carbon source in the feedstock is selected based on the genotype of the engineered microorganism. In certain embodiments, a mixed carbon source feedstock includes one or more carbon sources selected from sugars, cellulose, alkanes, fatty acids, triacylglycerides, paraffins, the like and combinations thereof.

Nitrogen may be supplied from an inorganic (e.g., $(NH_4)_2SO_4$) or organic source (e.g., urea or glutamate). In addition to appropriate carbon and nitrogen sources, culture media also can contain suitable minerals, salts, cofactors, buffers, vitamins, metal ions (e.g., $Mn^{+2}$, $Co^{+2}$, $Zn^{+2}$, $Mg^{+2}$) and other components suitable for culture of microorganisms.

Engineered microorganisms sometimes are cultured in complex media (e.g., yeast extract-peptone-dextrose broth (YPD)). In some embodiments, engineered microorganisms are cultured in a defined minimal media that lacks a component necessary for growth and thereby forces selection of a desired expression cassette (e.g., Yeast Nitrogen Base (DIFCO Laboratories, Detroit, Mich.)).

Culture media in some embodiments are common commercially prepared media, such as Yeast Nitrogen Base (DIFCO Laboratories, Detroit, Mich.). Other defined or synthetic growth media may also be used and the appropriate medium for growth of the particular microorganism are known. A variety of host organisms can be selected for the production of engineered microorganisms. Non-limiting examples include yeast (e.g., *Candida tropicalis* (e.g., ATCC20336, ATCC20913, ATCC20962), *Yarrowia lipolytica* (e.g., ATCC20228)) and filamentous fungi (e.g., *Aspergillus nidulans* (e.g., ATCC38164) and *Aspergillus parasiticus* (e.g., ATCC 24690)). In specific embodiments, yeast are cultured in YPD media (10 g/L Bacto Yeast Extract, 20 g/L Bacto Peptone, and 20 g/L Dextrose). Filamentous fungi, in particular embodiments, are grown in CM (Complete Medium) containing 10 g/L Dextrose, 2 g/L Bacto Peptone, 1 g/L Bacto Yeast Extract, 1 g/L Casamino acids, 50 mL/L 20× Nitrate Salts (120 g/L $NaNO_3$, 10.4 g/L KCl, 10.4 g/L $MgSO_4.7H_2O$), 1 mL/L 1000× Trace Elements (22 g/L $ZnSO_4.7H_2O$, 11 g/L $H_3BO_3$, 5 g/L $MnCl_2.7H_2O$, 5 g/L $FeSO_4.7H_2O$, 1.7 g/L $CoCl_2.6H_2O$, 1.6 g/L $CuSO_4.5H_2O$, 1.5 g/L $Na_2MoO_4.2H_2O$, and 50 g/L $Na_4EDTA$), and 1 mL/L Vitamin Solution (100 mg each of Biotin, pyridoxine, thiamine, riboflavin, p-aminobenzoic acid, and nicotinic acid in 100 mL water).

Growth Conditions & Fermentation

A suitable pH range for the fermentation often is between about pH 4.0 to about pH 8.0, where a pH in the range of about pH 5.5 to about pH 7.0 sometimes is utilized for initial culture conditions. Depending on the host organism, culturing may be conducted under aerobic or anaerobic conditions, where microaerobic conditions sometimes are maintained. A two-stage process may be utilized, where one stage promotes microorganism proliferation and another state promotes production of target molecule. In a two-stage process, the first stage may be conducted under aerobic conditions (e.g., introduction of air and/or oxygen) and the second stage may be conducted under anaerobic conditions (e.g., air or oxygen are not introduced to the culture conditions). In some embodiments, the first stage may be conducted under anaerobic conditions and the second stage may be conducted under aerobic conditions. In certain embodiments, a two-stage process may include two more organisms, where one organism generates an intermediate product in one stage and another organism processes the intermediate product into a target fatty dicarboxylic acid product (e.g., sebacic or dodecanedioic acid) in another stage, for example.

A variety of fermentation processes may be applied for commercial biological production of a target fatty dicarboxylic acid product. In some embodiments, commercial production of a target fatty dicarboxylic acid product from a recombinant microbial host is conducted using a batch, fed-batch or continuous fermentation process, for example.

A batch fermentation process often is a closed system where the media composition is fixed at the beginning of the process and not subject to further additions beyond those required for maintenance of pH and oxygen level during the process. At the beginning of the culturing process the media is inoculated with the desired organism and growth or metabolic activity is permitted to occur without adding additional sources (i.e., carbon and nitrogen sources) to the medium. In batch processes the metabolite and biomass compositions of the system change constantly up to the time the culture is terminated. In a typical batch process, cells proceed through a static lag phase to a high-growth log phase and finally to a stationary phase, wherein the growth rate is diminished or halted. Left untreated, cells in the stationary phase will eventually die.

A variation of the standard batch process is the fed-batch process, where the carbon source is continually added to the fermenter over the course of the fermentation process. Fed-batch processes are useful when catabolite repression is apt to inhibit the metabolism of the cells or where it is desirable to have limited amounts of carbon source in the media at any one time. Measurement of the carbon source concentration in fed-batch systems may be estimated on the basis of the changes of measurable factors such as pH, dissolved oxygen and the partial pressure of waste gases (e.g., $CO_2$).

Batch and fed-batch culturing methods are known in the art. Examples of such methods may be found in Thomas D. Brock in Biotechnology: A Textbook of Industrial Microbiology, 2nd ed., (1989) Sinauer Associates Sunderland, Mass. and Deshpande, Mukund V., Appl. Biochem. Biotechnol., 36:227 (1992).

In continuous fermentation process a defined media often is continuously added to a bioreactor while an equal amount of culture volume is removed simultaneously for product recovery. Continuous cultures generally maintain cells in the log phase of growth at a constant cell density. Continuous or semi-continuous culture methods permit the modulation of one factor or any number of factors that affect cell growth or end product concentration. For example, an approach may limit the carbon source and allow all other parameters to moderate metabolism. In some systems, a number of factors affecting growth may be altered continuously while the cell concentration, measured by media turbidity, is kept constant. Continuous systems often maintain steady state growth and thus the cell growth rate often is balanced against cell loss due to media being drawn off the culture. Methods of modulating nutrients and growth factors for continuous culture processes, as well as techniques for maximizing the rate of product formation, are known and a variety of methods are detailed by Brock, supra.

In some embodiments involving fermentation, the fermentation can be carried out using two or more microorganisms (e.g., host microorganism, engineered microorganism, isolated naturally occurring microorganism, the like and combinations thereof), where a feedstock is partially or completely utilized by one or more organisms in the fermentation (e.g., mixed fermentation), and the products of cellular respiration or metabolism of one or more organisms can be further metabolized by one or more other organisms to produce a desired target product (e.g., sebacic acid, dodecanedioic acid, hexanoic acid). In certain embodiments, each organism can be fermented independently and the products of cellular respiration or metabolism purified and contacted with another organism to produce a desired target product. In some embodiments, one or more organisms are partially or completely blocked in a metabolic pathway (e.g., beta oxidation, omega oxidation, the like or combinations thereof), thereby producing a desired product that can be used as a feedstock for one or more other organisms. Any suitable combination of microorganisms can be utilized to carry out mixed fermentation or sequential fermentation.

Target Product Production, Isolation and Yield

In various embodiments a fatty dicarboxylic acid (e.g., octanedioic acid, decanedioic acid, dodecanedioic acid, tetradecanedioic acid, hexadecanedioic acid, octadecanedioic acid, eicosanedioic acid) is isolated or purified from the culture media or extracted from the engineered microorganisms. In some embodiments, fermentation of feedstocks by methods described herein can produce a target fatty dicarboxylic acid product (e.g., sebacic or dodecanedioic acid) at a level of about 10% to about 100% of theoretical yield (e.g., about 15%, about 20%, about 25% or more of theoretical yield (e.g., 25% or more, 26% or more, 27% or more, 28% or more, 29% or more, 30% or more, 31% or more, 32% or more, 33% or more, 34% or more, 35% or more, 36% or more, 37% or more, 38% or more, 39% or more, 40% or more, 41% or more, 42% or more, 43% or more, 44% or more, 45% or more, 46% or more, 47% or more, 48% or more, 49% or more, 50% or more, 51% or more, 52% or more, 53% or more, 54% or more, 55% or more, 56% or more, 57% or more, 58% or more, 59% or more, 60% or more, 61% or more, 62% or more, 63% or more, 64% or more, 65% or more, 66% or more, 67% or more, 68% or more, 69% or more, 70% or more, 71% or more, 72% or more, 73% or more, 74% or more, 75% or more, 76% or more, 77% or more, 78% or more, 79% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more of theoretical yield). The term "theoretical yield" as used herein refers to the amount of product that could be made from a starting material if the reaction is 100% complete. Theoretical yield is based on the stoichiometry of a reaction and ideal conditions in which starting material is completely consumed, undesired side reactions do not occur, the reverse reaction does not occur, and there are no losses in the work-up procedure. Culture media may be tested for target product (e.g., sebacic or dodecanedioic acid) concentration and drawn off when the concentration reaches a predetermined level. Detection methods are known in the art, including but not limited to chromatographic methods (e.g., gas chromatography) or combined chromatographic/mass spectrometry (e.g., GC-MS) methods. Target product (e.g., sebacic or dodecanedioic acid) may be present at a range of levels as described herein.

A target fatty dicarboxylic acid product sometimes is retained within an engineered microorganism after a culture process is completed, and in certain embodiments, the target product is secreted out of the microorganism into the culture medium. For the latter embodiments, (i) culture media may be drawn from the culture system and fresh medium may be supplemented, and/or (ii) target product may be extracted from the culture media during or after the culture process is completed. Engineered microorganisms may be cultured on or in solid, semi-solid or liquid media. In some embodiments media is drained from cells adhering to a plate. In certain embodiments, a liquid-cell mixture is centrifuged at a speed sufficient to pellet the cells but not disrupt the cells and allow extraction of the media, as known in the art. The cells may then be resuspended in fresh media. Target product may be purified from culture media according to known methods know in the art.

Provided herein are non-limiting examples of methods useful for recovering target product from fermentation broth and/or isolating/partially purifying a target fatty dicarboxylic acid product from non-target products when utilizing mixed chain length feedstocks. Recovery of a fatty dicarboxylic acid (e.g., octanedioic acid, decanedioic acid, dodecanedioic acid, tetradecanedioic acid, hexadecanedioic acid, octadecanedioic acid, eicosanedioic acid) from fermentation broth can be accomplished using a variety of methods. Optionally, one can first employ a centrifugation step to separate cell mass and a fatty dicarboxylic acid (e.g., octanedioic acid, decanedioic acid, dodecanedioic acid, tetradecanedioic acid, hexadecanedioic acid, octadecanedioic acid, eicosanedioic acid) from the aqueous phase. A fatty dicarboxylic acid (e.g., octanedioic acid, decanedioic acid, dodecanedioic acid, tetradecanedioic acid, hexadecanedioic acid, octadecanedioic acid, eicosanedioic acid) has limited solubility in water under fermentation conditions, and has a density similar to that of water. Upon centrifugation, the majority of fatty dicarboxylic acid (e.g., octanedioic acid, decanedioic acid, dodecanedioic acid, tetradecanedioic acid, hexadecanedioic acid, octadecanedioic acid, eicosanedioic acid) will be pulled away from the water stream, and be concentrated in the cell mass stream. The concentrated fatty dicarboxylic acid stream will then be further concentrated via filtration steps (e.g., solid dodecanedioic acid will be retained on a filter, allowing water to pass through, concentrating the product). Once the fatty dicarboxylic acid (e.g., octanedioic acid, decanedioic acid, dodecanedioic acid, tetradecanedioic acid, hexadecanedioic acid, octadecanedioic acid, eicosanedioic acid) is concentrated to the desired level, the temperature will be increased to above its melting point of 130 C. After the fatty dicarboxylic acid is melted, the remaining impurities are removed via filtration; the final product is recovered by decreasing the temperature, allowing the fatty dicarboxylic acid to solidify, and collecting the solid product. Alternatively, a fatty dicarboxylic acid (e.g., octanedioic acid, decanedioic acid, dodecanedioic acid, tetradecanedioic acid, hexadecanedioic acid, octadecanedioic acid, eicosanedioic acid) can be recovered from fermentation broth by first extracting the broth with an organic solvent in which a fatty dicarboxylic acid (e.g., octanedioic acid, decanedioic acid, dodecanedioic acid, tetradecanedioic acid, hexadecanedioic acid, octadecanedioic acid, eicosanedioic acid) is soluble (e.g., ethanol). The organic solvent phase can then be filtered through various membranes to further purify the fatty dicarboxylic acid. Subsequent extractions with the same or a different organic solvent can then be performed and each round of extraction can be followed by membrane filtration to further concentrate the fatty dicarboxylic acid. The organic solvent can be evaporated, leaving the fatty dicarboxylic acid behind as a residue and the residue can be dried to provide the fatty dicarboxylic acid (e.g., octanedioic acid, decanedioic acid, dodecanedioic acid, tetradecanedioic acid, hexadecanedioic acid, octadecanedioic acid, eicosanedioic acid) in solid form.

In certain embodiments, target product is extracted from the cultured engineered microorganisms. The microorganism cells may be concentrated through centrifugation at a speed sufficient to shear the cell membranes. In some embodiments, the cells may be physically disrupted (e.g., shear force, sonication) or chemically disrupted (e.g., contacted with detergent or other lysing agent). The phases may be separated by centrifugation or other method known in the art and target product may be isolated according to known methods.

Commercial grade target product sometimes is provided in substantially pure form (e.g., 90% pure or greater, 95% pure or greater, 99% pure or greater or 99.5% pure or greater). In some embodiments, target product may be modified into any one of a number of downstream products. For example, a fatty dicarboxylic acid (e.g., octanedioic acid, decanedioic acid, dodecanedioic acid, tetradecanedioic acid, hexadecanedioic acid, octadecanedioic acid, eicosanedioic acid) may be polycondensed with hexamethylenediamine to produce nylon. Nylon may be further processed into fibers for applications in carpeting, automobile tire cord and clothing. A fatty dicarboxylic acid (e.g., octanedioic acid, decanedioic acid, dodecanedioic acid, tetradecanedioic acid, hexadecanedioic acid, octadecanedioic acid, eicosanedioic acid) is also used for manufacturing plasticizers, lubricant components and polyester polyols for polyurethane systems. Various esters of food grade fatty dicarboxylic acids (e.g., octanedioic acid, decanedioic acid, dodecanedioic acid, tetradecanedioic acid, hexadecanedioic acid, octadecanedioic acid, eicosanedioic acid) are used as components in fragrance manufacture, gelling aids, flavorings, acidulant, leavening and buffering agent. A fatty dicarboxylic acid (e.g., octanedioic acid, decanedioic acid, dodecanedioic acid, tetradecanedioic acid, hexadecanedioic acid, octadecanedioic acid, eicosanedioic acid) has two carboxylic acid (—COOH) groups, which can yield two kinds of salts. Its derivatives, acyl halides, anhydrides, esters, amides and nitriles, are used in making a variety of downstream products through further reactions of substitution, catalytic reduction, metal hydride reduction, diborane reduction, keto formation with organometallic reagents, electrophile bonding at oxygen, and condensation.

Target product may be provided within cultured microbes containing target product, and cultured microbes may be supplied fresh or frozen in a liquid media or dried. Fresh or frozen microbes may be contained in appropriate moisture-proof containers that may also be temperature controlled as necessary. Target product sometimes is provided in culture medium that is substantially cell-free. In some embodiments target product or modified target product purified from microbes is provided, and target product sometimes is provided in substantially pure form. In certain embodiments crystallized or powdered target product is provided. Dodecanedioic acid (1,12 dodecanedioic acid; DDDA) is a white powder or crystal with a melting point of between 260° F. and 266° F. Sebacic acid (1,8 ocatanedicarboxylic acid) is also a white powder or crystal with a melting point of between 268° F. and 274° F. A crystallized or powdered fatty dicarboxylic acid (e.g., octanedioic acid, decanedioic acid, dodecanedioic acid, tetradecanedioic acid, hexadecanedioic acid, octadecanedioic acid, eicosanedioic acid) may be transported in a variety of containers including one ton cartons, drums, 50 pound bags and the like.

In certain embodiments, a fatty dicarboxylic acid target product (e.g., dodecanedioic acid or sebacic acid) is produced with a yield of about 0.50 grams of target product per gram of feedstock added, or greater; 0.51 grams of target product per gram of feedstock added, or greater; 0.52 grams of target product per gram of feedstock added, or greater; 0.53 grams of target product per gram of feedstock added, or greater; 0.54 grams of target product per gram of feedstock added, or greater; 0.55 grams of target product per gram of feedstock added, or greater; 0.56 grams of target product per gram of feedstock added, or greater; 0.57 grams of target product per gram of feedstock added, or greater; 0.58 grams of target product per gram of feedstock added, or greater; 0.59 grams of target product per gram of feedstock added, or greater; 0.60 grams of target product per gram of feedstock added, or greater; 0.61 grams of target product per gram of feedstock added, or greater; 0.62 grams of target product per gram of feedstock added, or greater; 0.63 grams of target product per gram of feedstock added, or greater; 0.64 grams of target product per gram of feedstock added, or greater; 0.65 grams of target product per gram of feedstock added, or greater; 0.66 grams of target product per gram of feedstock added, or greater; 0.67 grams of target product per gram of feedstock added, or greater; 0.68 grams of target product per gram of feedstock added, or greater; 0.69 grams of target product per gram of feedstock added, or greater; 0.70 grams of target product per gram of feedstock added or greater; 0.71 grams of target product per gram of feedstock added, or greater; 0.72 grams of target product per gram of feedstock added, or greater; 0.73 grams of target product per gram of feedstock added, or greater; 0.74 grams of target product per gram of feedstock added, or greater; 0.75 grams of target product per gram of feedstock added, or greater; 0.76 grams of target product per gram of feedstock added, or greater; 0.77 grams of target product per gram of feedstock added, or greater; 0.78 grams of target product per gram of feedstock added, or greater; 0.79 grams of target product per gram of feedstock added, or greater; 0.80 grams of target product per gram of feedstock added, or greater; 0.81 grams of target product per gram of feedstock added, or greater; 0.82 grams of target product per gram of feedstock added, or greater; 0.83 grams of target product per gram of feedstock added, or greater; 0.84 grams of target product per gram of feedstock added, or greater; 0.85 grams of target product per gram of feedstock added, or greater; 0.86 grams of target product per gram of feedstock added, or greater; 0.87 grams of target product per gram of feedstock added, or greater; 0.88 grams of target product per gram of feedstock added, or greater; 0.89 grams of target product per gram of feedstock added, or greater; 0.90 grams of target product per gram of feedstock added, or greater; 0.91 grams of target product per gram of feedstock added, or greater; 0.92 grams of target product per gram of feedstock added, or greater; 0.93 grams of target product per gram of feedstock added, or greater; 0.94 grams of target product per gram of feedstock added, or greater; 0.95 grams of target product per gram of feedstock added, or greater; 0.96 grams of target product per gram of feedstock added, or greater; 0.97 grams of target product per gram of feedstock added, or greater; 0.98 grams of target product per gram of feedstock added, or greater; 0.99 grams of target product per gram of feedstock added, or greater; 1.0 grams of target product per gram of feedstock added, or greater; 1.1 grams of target product per gram of feedstock added, or greater; 1.2 grams of target product per gram of feedstock added, or greater; 1.3 grams of target product per gram of feedstock added, or greater; 1.4 grams of target product per gram of feedstock added, or greater; or about 1.5 grams of target product per gram of feedstock added, or greater.

In certain embodiments, a fatty dicarboxylic acid (e.g., octanedioic acid, decanedioic acid, dodecanedioic acid, tetradecanedioic acid, hexadecanedioic acid, octadecanedioic acid, eicosanedioic acid) is produced with a yield of greater than about 0.15 grams per gram of the feedstock (e.g., dodecane, mixed chain length alkanes, lauric acid, mixed chain length fatty acids, oil, the like or combinations of the foregoing). In some embodiments, a fatty dicarboxylic acid (e.g., octanedioic acid, decanedioic acid, dodecanedioic acid, tetradecanedioic acid, hexadecanedioic acid, octadecanedioic acid, eicosanedioic acid) is produced at between about 10% and about 100% of maximum theoretical yield of any introduced feedstock ((e.g., about 15%, about 20%, about 25% or more of theoretical yield (e.g., 25% or more, 26% or more, 27% or more, 28% or more, 29% or more, 30% or more, 31% or more, 32% or more, 33% or more, 34% or more, 35% or more, 36% or more, 37% or more, 38% or more, 39% or more, 40% or more, 41% or more, 42% or more, 43% or more, 44% or more, 45% or more, 46% or more, 47% or more, 48% or more, 49% or more, 50% or more, 51% or more, 52% or more, 53% or more, 54% or more, 55% or more, 56% or more, 57% or more, 58% or more, 59% or more, 60% or more, 61% or more, 62% or more, 63% or more, 64% or more, 65% or more, 66% or more, 67% or more, 68% or more, 69% or more, 70% or more, 71% or more, 72% or more, 73% or more, 74% or more, 75% or more, 76% or more, 77% or more, 78% or more, 79% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more of theoretical maximum yield). In certain embodiments, a fatty dicarboxylic acid (e.g., octanedioic acid, decanedioic acid, dodecanedioic acid, tetradecanedioic acid, hexadecanedioic acid, octadecanedioic acid, eicosanedioic acid) is produced in a concentration range of between about 50 g/L to about 1000 g/L of culture media (e.g., about 50 g/L, about 55 g/L, about 60 g/L, about 65 g/L, about 70 g/L, about 75 g/L, about 80 g/L, about 85 g/L, about 90 g/L, about 95 g/L, about 100 g/L, about 110 g/L, about 120 g/L, about 130 g/L, about 140 g/L, about 150 g/L, about 160 g/L, about 170 g/L, about 180 g/L, about 190 g/L, about 200 g/L, about 225 g/L, about 250 g/L, about 275 g/L, about 300 g/L, about 325 g/L, about 350 g/L, about 375 g/L, about 400 g/L, about 425 g/L, about 450 g/L, about 475 g/L, about 500 g/L, about 550 g/L, about 600 g/L, about 650 g/L, about 700 g/L, about 750 g/L, about 800 g/L, about 850 g/L, about 900 g/L, about 950 g/L, or about 1000 g/L).

In some embodiments, a fatty dicarboxylic acid (e.g., octanedioic acid, decanedioic acid, dodecanedioic acid, tetradecanedioic acid, hexadecanedioic acid, octadecanedioic acid, eicosanedioic acid) is produced at a rate of between about 0.5 g/L/hour to about 5 g/L/hour (e.g., about 0.5 g/L/hour, about 0.6 g/L/hour, about 0.7 g/L/hour, about 0.8 g/L/hour, about 0.9 g/L/hour, about 1.0 g/L/hour, about 1.1 g/L/hour, about 1.2 g/L/hour, about 1.3 g/L/hour, about 1.4 g/L/hour, about 1.5 g/L/hour, about 1.6 g/L/hour, about 1.7 g/L/hour, about 1.8 g/L/hour, about 1.9 g/L/hour, about 2.0 g/L/hour, about 2.25 g/L/hour, about 2.5 g/L/hour, about 2.75 g/L/hour, about 3.0 g/L/hour, about 3.25 g/L/hour, about 3.5 g/L/hour, about 3.75 g/L/hour, about 4.0 g/L/hour, about 4.25 g/L/hour, about 4.5 g/L/hour, about 4.75 g/L/hour, or about 5.0 g/L/hour.) In certain, embodiments, the engineered organism comprises between about a 5-fold to about a 500-fold increase in a fatty dicarboxylic acid (e.g., octanedioic acid, decanedioic acid, dodecanedioic acid, tetradecanedioic acid, hexadecanedioic acid, octadecanedioic acid, eicosanedioic acid) production when compared to wild-type or partially engineered organisms of the same strain, under identical fermentation conditions (e.g., about a 5-fold increase, about a 10-fold increase, about a 15-fold increase, about a 20-fold increase, about a 25-fold increase, about a 30-fold increase, about a 35-fold increase, about a 40-fold increase, about a 45-fold increase, about a 50-fold increase, about a 55-fold increase, about a 60-fold increase, about a 65-fold increase, about a 70-fold increase, about a 75-fold increase, about a 80-fold increase, about a 85-fold increase, about a 90-fold increase, about a 95-fold increase, about a 100-fold increase, about a 125-fold increase, about a 150-fold increase, about a 175-fold increase, about a 200-fold increase, about a 250-fold increase, about a 300-fold increase, about a 350-fold increase, about a 400-fold increase, about a 450-fold increase, or about a 500-fold increase).

In certain embodiments, the maximum theoretical yield ($Y_{max}$) of dodecanedioic acid in a fully beta-oxidation blocked engineered microorganism is about 1.15 grams of dodecanedioic acid produced per gram of lauric acid added. In some embodiments, the maximum theoretical yield ($Y_{max}$) of dodecanedioic acid in a fully beta-oxidation blocked engineered microorganism is about 1.07 grams of dodecanedioic acid produced per gram of methyl laurate added. In certain embodiments, the maximum theoretical yield ($Y_{max}$) of dodecanedioic acid in a partially beta-oxidation blocked engineered microorganism is about 0.82 grams of dodecanedioic acid produced per gram of oleic acid added. In some embodiments, the maximum theoretical yield ($Y_{max}$) of dodecanedioic acid in a partially beta-oxidation blocked engineered microorganism is about 0.95 grams of dodecanedioic acid produced per gram of coconut oil added. The percentage of $Y_{max}$ for the engineered microorganism under conditions in which dodecanedioic acid is produced is calculated as (% $Y_{max}$)=$Y_{p/s}/Y_{max}$*100, where ($Y_{p/s}$)=[dodecanedioic acid (g/L)]*final volume of culture in flask (L)]/[feedstock added to flask (g)]. In some embodiments, the engineered microorganism produces dodecanedioic acid at about 10% to about 100% of maximum theoretical yield.

In certain embodiments, the maximum theoretical yield ($Y_{max}$) of sebacic acid in a fully beta-oxidation blocked engineered microorganism is about 1.42 grams of sebacic acid produced per gram of decane added. In some embodiments, the maximum theoretical yield ($Y_{max}$) of sebacic acid in a fully beta-oxidation blocked engineered microorganism is about 1.17 grams of sebacic acid produced per gram of capric acid added. In certain embodiments, the maximum theoretical yield (Y) of sebacic acid in a partially beta-oxidation blocked engineered microorganism is about 0.83 grams of sebacic acid produced per gram of coconut oil added. In some embodiments, the maximum theoretical yield ($Y_{max}$) of sebacic acid in a partially beta-oxidation blocked engineered microorganism is about 0.72 grams of sebacic acid produced per gram of oleic acid added. The percentage of $Y_{max}$ for the engineered microorganism under conditions in which sebacic acid is produced is calculated as (% $Y_{max}$)=$Y_{p/s}/Y_{max}$*100, where ($Y_{p/s}$)=[sebacic acid (g/L)]*final volume of culture in flask (L)]/[feedstock added to flask (g)]. In some embodiments, the engineered microorganism produces sebacic acid at about 10% to about 100% of maximum theoretical yield.

EXAMPLES

The examples set forth below illustrate certain embodiments and do not limit the technology. Certain examples set forth below utilize standard recombinant DNA and other biotechnology protocols known in the art. Many such techniques are described in detail in Maniatis, T., E. F. Fritsch and J. Sambrook (1982) *Molecular Cloning: a Laboratory Manual*; Cold Spring Harbor Laboratory, Cold Spring Harbor, N.Y. DNA mutagenesis can be accomplished using the Stratagene (San Diego, Calif.) "QuickChange" kit according to the manufacturer's instructions.

Non-limiting examples of recombinant DNA techniques and genetic manipulation of microorganisms are described herein. In some embodiments, strains of engineered organisms described herein are mated to combine genetic backgrounds to further enhance carbon flux management through native and/or engineered pathways described herein, for the production of a desired target product (e.g., sebacic or dodecanedioic acid).

Figure 9:
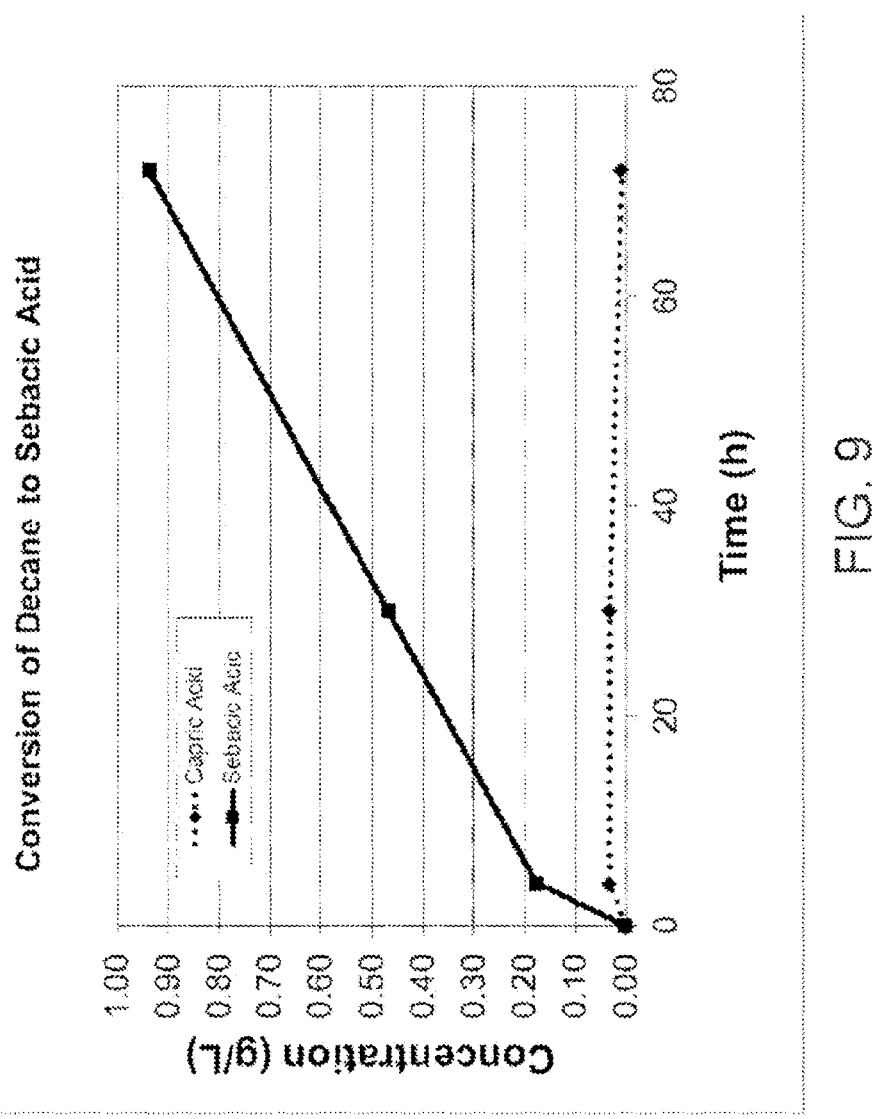
FIG. 9 graphically illustrates the conversion of decane to sebacic acid in a fully beta-oxidation blocked *Candida* yeast strain. After incubation for the times shown in the graph, the media was subjected to gas chromatography. The results indicate that greater than 99% of the decane was converted into sebacic acid, with a minimal amount of capric acid also detected by gas chromatography. No significant accumulation of any other monoacid or diacid was detected by gas chromatography. Experimental details and results are given in Example 1.

Example 1: Conversion of Decane to Sebacic Acid in Shake Flask Fermentation 50 mL of SP92 medium (6.7 g/L yeast nitrogen base, 3.0 g/L yeast extract, 3.0 g/L (NH$_4$)$_2$SO$_4$, 1.0 g/L K$_2$HPO$_4$, 1.0 g/L KH$_2$PO$_4$, 75 g/L dextrose) was inoculated with a single colony of a completely beta-oxidation blocked strain of Candida tropicalis (ATCC20962) and the culture was grown overnight at 30° C., with shaking at about 300 rpm. Cells were pelleted by centrifugation for 10 minutes at 4° C. and 1,050×g and the supernatant discarded. Cells were resuspended in 20 mL TB-low nitrogen (low-N) media (1.7 g/L yeast nitrogen base without ammonium sulfate, 3.0 g/L yeast extract, 1.0 g/L K$_2$HPO$_4$, 1.0 g/L KH$_2$PO$_4$) and transferred to a new sterile 250 mL glass baffled flask and incubated at 30 C, with shaking at about 250 rpm, utilizing the following feeding schedule: dextrose fed to 0.1% at 0, 1, 2, 3, 4, and 5 hours, dextrose fed to 5% at 30 hours, decane fed to 0.7% at 0, 5, 30, and 48 hours. Samples were removed for gas chromatographic (GC) analysis at 0, 4, 30, and 72 hours. The GC profile showed that the culture accumulated the C10 dicarboxylic acid (sebacic acid) with very little accumulation of the C10 monocarboxylic acid (capric acid), as shown in FIG. 9. After 72 hours of incubation the concentration of sebacic acid was 0.94 g/L and the capric acid concentration was 0.01 g/L. There was no significant accumulation of any other monoacid or diacid.

Figure 10:
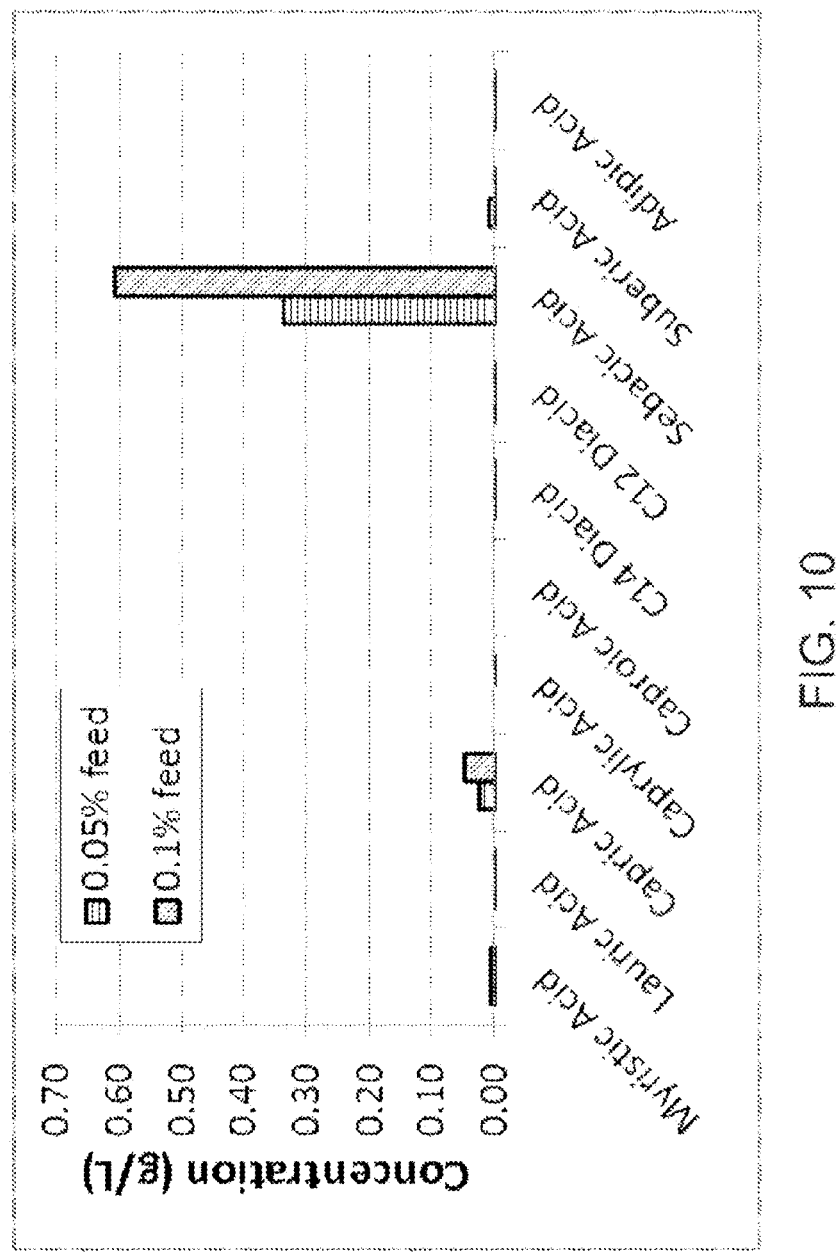
FIG. 10 graphically illustrates the conversion of capric acid to sebacic acid in a *Candida* yeast strain. GC analysis was performed after a predetermined period of growth. Nearly all the capric acid added was converted to sebacic acid using a starting concentration of capric acid. Experimental details and results are given in Example 2.

Example 2: Conversion of Capric Acid to Sebacic Acid in Shake Flask Fermentation 5 mL of SP92-glycerol medium (6.7 g/L yeast nitrogen base, 3.0 g/L yeast extract, 3.0 g/L (NH4)2SO4, 1.0 g/L K2HPO4, 1.0 g/L KH2PO4, 75 g/L glycerol) was inoculated with a single colony of Candida tropicalis (ATCC20962) and the starter culture was grown overnight at 30° C., with shaking at about 250 rpm. Variations of SP92 media recipes are known, non-limiting examples of which include the addition of dextrose and/or glycerol, the like or combinations thereof. SP92 media, as referred to herein, can include dextrose and/or glycerol. The starter culture was then used to inoculate 25 mL cultures in the same medium to an initial OD$_{600nm}$ of 0.4 and grown overnight at 30° C., with shaking at about 300 rpm. Cells were pelleted by centrifugation for 10 minutes at 4° C. and 1,050×g and the supernatant discarded. Cells were resuspended in 12.5 mL TB-lowN media+glycerol (1.7 g/L yeast nitrogen base without ammonium sulfate, 3.0 g/L yeast extract, 1.0 g/L K2HPO4, 1.0 g/L KH2PO4, 75 g/L glycerol) and transferred to a new sterile 250 mL glass baffled flask. Cultures were fed 0.05% or 0.1% capric acid and incubated at 30° C., with shaking at about 300 rpm. After 24 hours incubation cultures were fed glycerol to 75 g/L and incubation continued before sampling for GC at 48 hours. GC analysis showed that nearly all capric acid was converted to sebacic acid under both starting concentrations of capric acid, as shown in FIG. 10.

Example 3: Fermentation Procedure for Conversion of Decane to Sebacic Acid

Filter sterilized modified SP92-glycerol fermentation medium (6.7 g/L yeast nitrogen base, 3.0 g/L yeast extract, 3.0 g/L (NH4)2SO4, 1.0 g/L K2HPO4, 1.0 g/L KH2PO4, 20 g/L glycerol) is transferred to a sterile fermentation vessel. Growth of Candida tropicalis (ATCC20962) is innoculated to an initial OD$_{600nm}$ of about 1.0 with a 5% inoculum and growth carried out under the following conditions: 30° C. with shaking at about 1000 rpm, 1 volume per volume per minute aeration (vvm), pH 5.8 and initial volume of 0.3 L. Growth proceeds for approximately 8 hours and the conversion phase is initiated by the addition of decane to 2 g/L. Continuous feeds for decane (1 g/L-h) and glucose (1.5 g/L-h) are initiated at the same time as the addition of the decane bolus. Fermentation conditions are maintained at 30° C., 1000 rpm, 1 vvm, and pH 5.8 for 44 hours.

Figure 16:
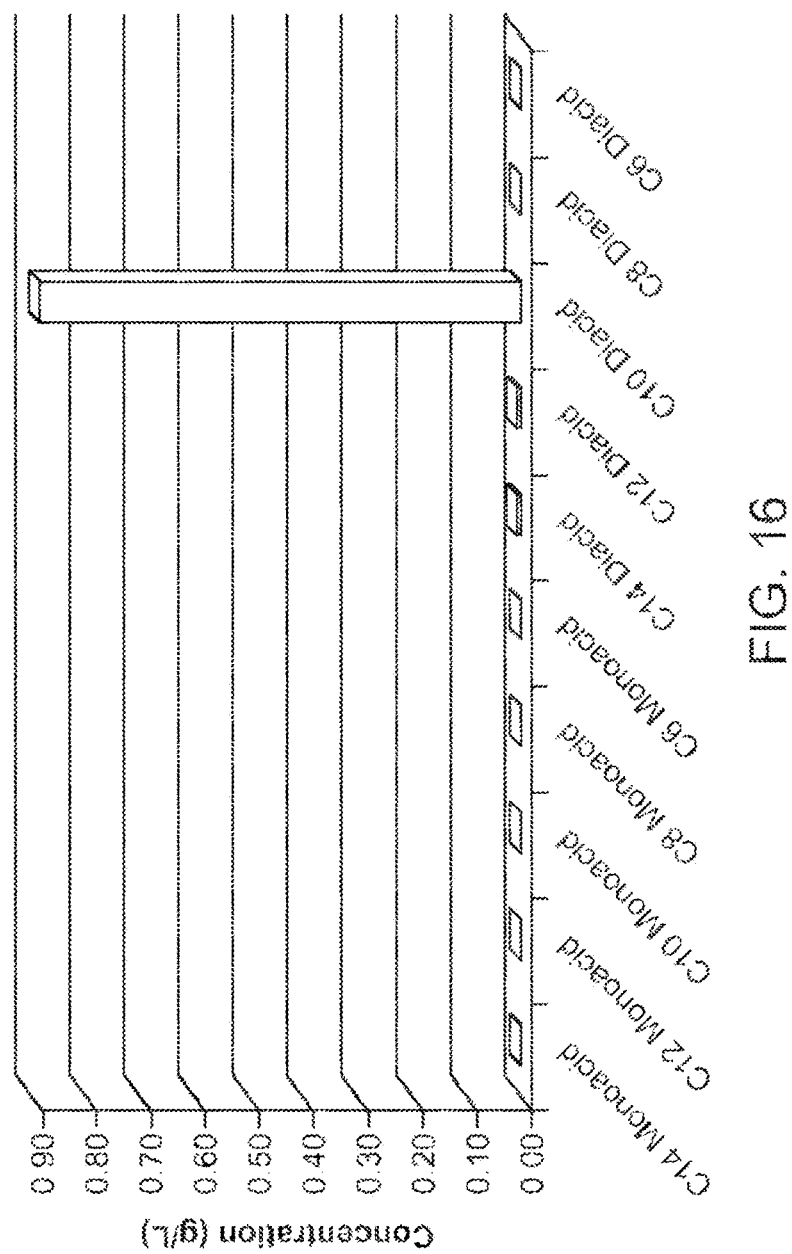
FIG. 16 graphically illustrates the results of engineered microorganisms described herein converting decane to sebacic acid under fermentation conditions using different amounts of decane as the feedstock. Experimental details and results are given in Example 3.

Samples were collected for GC analysis at 44 hours after initiating the conversion phase. The data, presented in FIG. 16, show that the decane was converted exclusively to the C10 dicarboxylic acid, sebacic acid. Significant evaporative losses from the decane feed bottles prevented an accurate determination of product yield.

Example 4: Conversion of Mixed Fatty Acid Feedstock to Mixed Diacid Products Containing Sebacic Acid in Shake Flask Fermentation 5 mL of SP92-glycerol medium (6.7 g/L yeast nitrogen base, 3.0 g/L yeast extract, 3.0 g/L (NH4)2SO4, 1.0 g/L K2HPO4, 1.0 g/L KH2PO4, 75 g/L glycerol) is inoculated with a single colony of Candida tropicalis (ATCC20962) and grown as described in Example 2. 25 mL of the same media is inoculated using overnight cultures to an initial OD$_{600nm}$ of 0.4 and grown overnight at 30° C., with shaking at about 300 rpm. Cells are pelleted by centrifugation for 10 minutes at 4° C. and 1,050×g and the supernatant discarded. Cells are resuspended in 12.5 mL TB-lowN media without carbon source (1.7 g/L yeast nitrogen base without ammonium sulfate, 3.0 g/L yeast extract, 1.0 g/L K2HPO4, 1.0 g/L KH2PO4) and transferred to a new sterile 250 mL glass baffled flask. Cultures are fed 0.05% capric acid, 0.05% methyl laurate, and 30 g/L glycerol and incubated at 30° C., 300 rpm. After 24 hours of incubation cultures are sampled for GC analysis.

Figure 17:
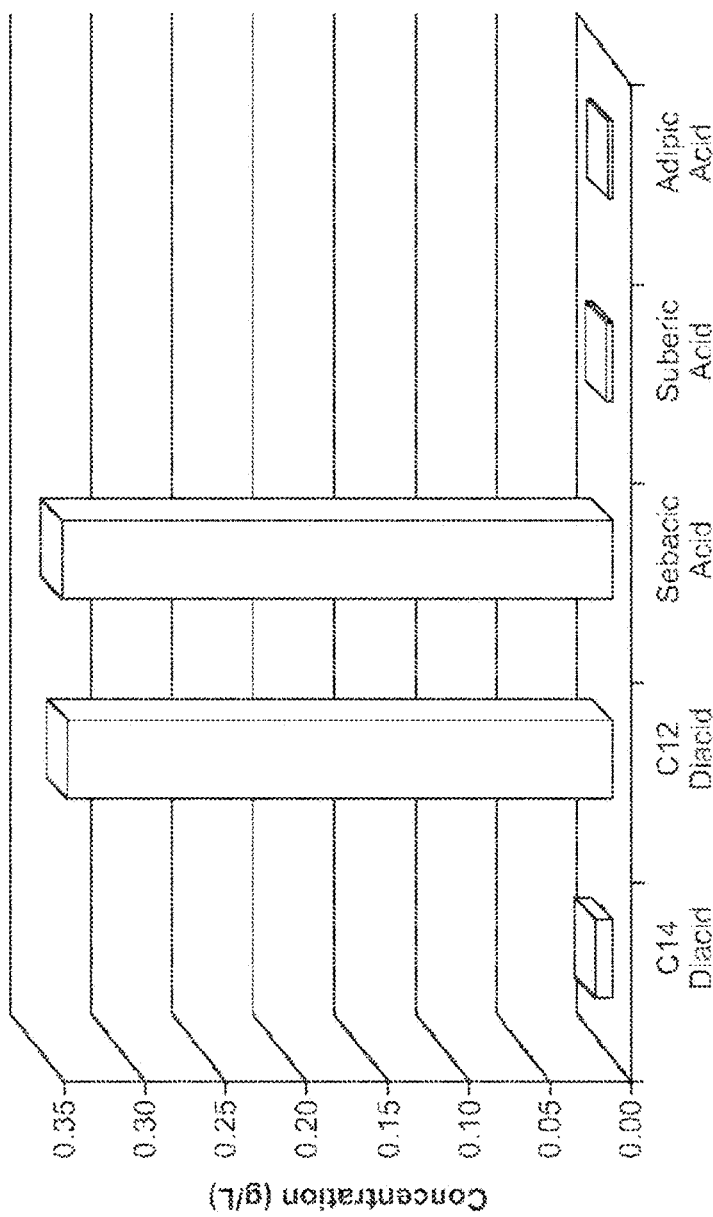
FIG. 17 graphically illustrates the results of engineered microorganisms described herein converting a mixed fatty acid feedstock (e.g., mixed chain-length fatty acids) to sebacic acid under fermentation conditions. Experimental details and results are given in Example 4.

The results, presented in FIG. 17, show that the C12 and C10 fatty acids were converted to dicarboxylic acids of the same chain length (e.g., C12 and C10 dicarboxylic acids), with no evidence of chain shortening of the diacids (e.g., no significant levels of monocarboxylic acids were detected).

Example 5: Conversion of Long Chain Fatty Acids to Mixed Diacids

Figure 11:
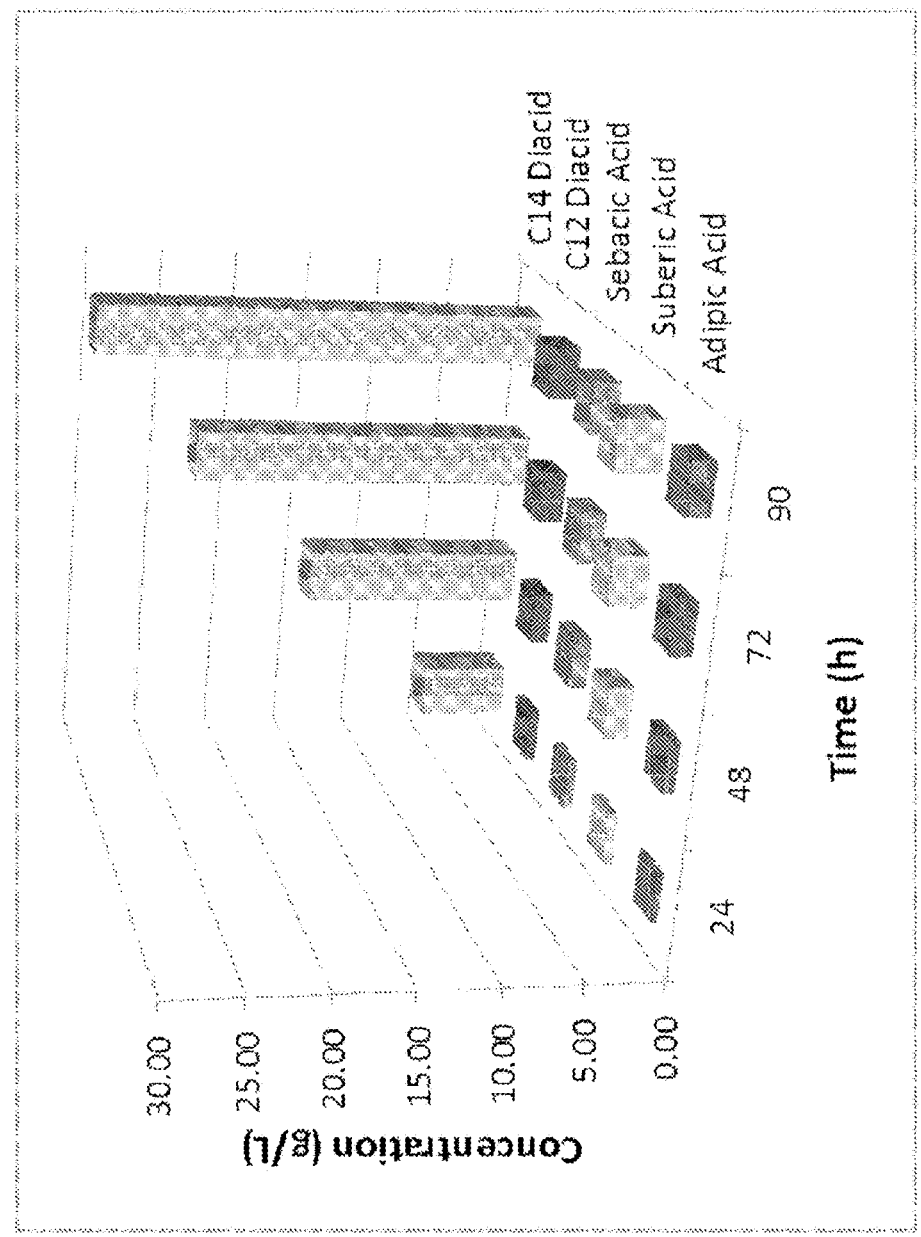
FIG. 11 graphically illustrates the distribution of diacids produced during the conversion of long-chain fatty acids to mixed diacids under fermentation conditions using a partially beta-oxidation blocked *Candida tropicalis* strain (e.g., sAA106). Experimental details and results are given in Example 5.

SP92 fermentation medium was filter sterilized and transferred to a sterile fermentation vessel. Growth of a partially beta-oxidation blocked strain of Candida tropicalis (sAA106) was initiated with a 10% inoculum (initial OD$_{600nm}$=3.0) and grown under the following conditions: of 30° C. with shaking at about 1200 rpm, 1 vvm, pH 6.1 and initial volume of 0.3 L. Growth continued until the glucose concentration dropped to less than 2 g/L at which time the conversion phase was initiated by increasing the pH to 8.0 by the addition of 6N KOH and by the addition of methyl myristate to 30 g/L. Immediately following the methyl myristate bolus a continuous feed of glucose was initiated at a rate of 1.5 g/L-h. Fermentation conditions were maintained at 30° C., 1200 rpm, 1 vvm, and pH 8.0 for 90 hours with boluses of 30 g/L methyl myristate at 24, 48, and 72 hours after initiation of conversion. Samples for GC were collected at 24, 48, 72, and 90 hours. The diacid profile graphically illustrated in FIG. 11 shows an accumulation of dicarboxylic acids ranging in chain-length from 6 to 14 carbons long, including sebacic acid. The methyl myristate substrate (methyl ester of myristic acid) is first converted to the C14 dicarboxylic acid via the β-oxidation pathway before being shortened by two carbon increments via the cyclic β-oxidation pathway. The glucose co-feed employed during the fermentation represses the β-oxidation pathway such that all chain-lengths of diacid accumulate. Manipulation of diacid chain-length distribution is being investigated by altering the glucose co-feed rate in the fermentation medium, thereby allowing growth under varying glucose concentrations.

Example 6: Fermentation Procedure for Conversion of Mixed Long-Chain Fatty Acids to Mixed Diacids of Shorter Chain Length SP92 fermentation medium without glycerol was filter sterilized and transferred to a sterile fermentation vessel. Autoclaved virgin coconut oil was added to the vessel to a final concentration of 80 g/L. A partially beta-oxidation blocked Candida tropicalis strain (sAA496) was inoculated to an initial $OD_{600nm}$ of 1.0 with a 5% inoculum and grown under the following conditions: 30° C. with shaking at about 1200 rpm, 1 vvm, initial pH 6.5 and initial volume of 1.0 L. The effect of pH on the distribution of fatty acid chain lengths was determined by manipulating the pH of the fermentation media. The pH of the fermentation was either 1) increased to pH 7.5 and controlled at that pH for the entire run, 2) allowed to drop naturally due to the growth of the culture before controlling at pH 6.0 for the rest of the run, or 3) allowed to drop naturally due to the growth of the culture before controlling at pH 4.5 for the rest of the run. Samples were collected for GC analysis after 140 hours of fermentation time. The product diacid composition was shown to shift to longer chain diacids with increasing pH, as shown in TABLE 1.

TABLE 6

| | Diacid composition (fraction of total diacids) | | | |
|---|---|---|---|---|
| | C12 Diacid | Sebacic Acid | Suberic Acid | Adipic Acid |
| pH 4.5 | 0.00 | 0.00 | 0.68 | 0.32 |
| pH 6.0 | 0.03 | 0.10 | 0.75 | 0.12 |
| pH 7.5 | 0.16 | 0.17 | 0.62 | 0.05 |

Figure 12:
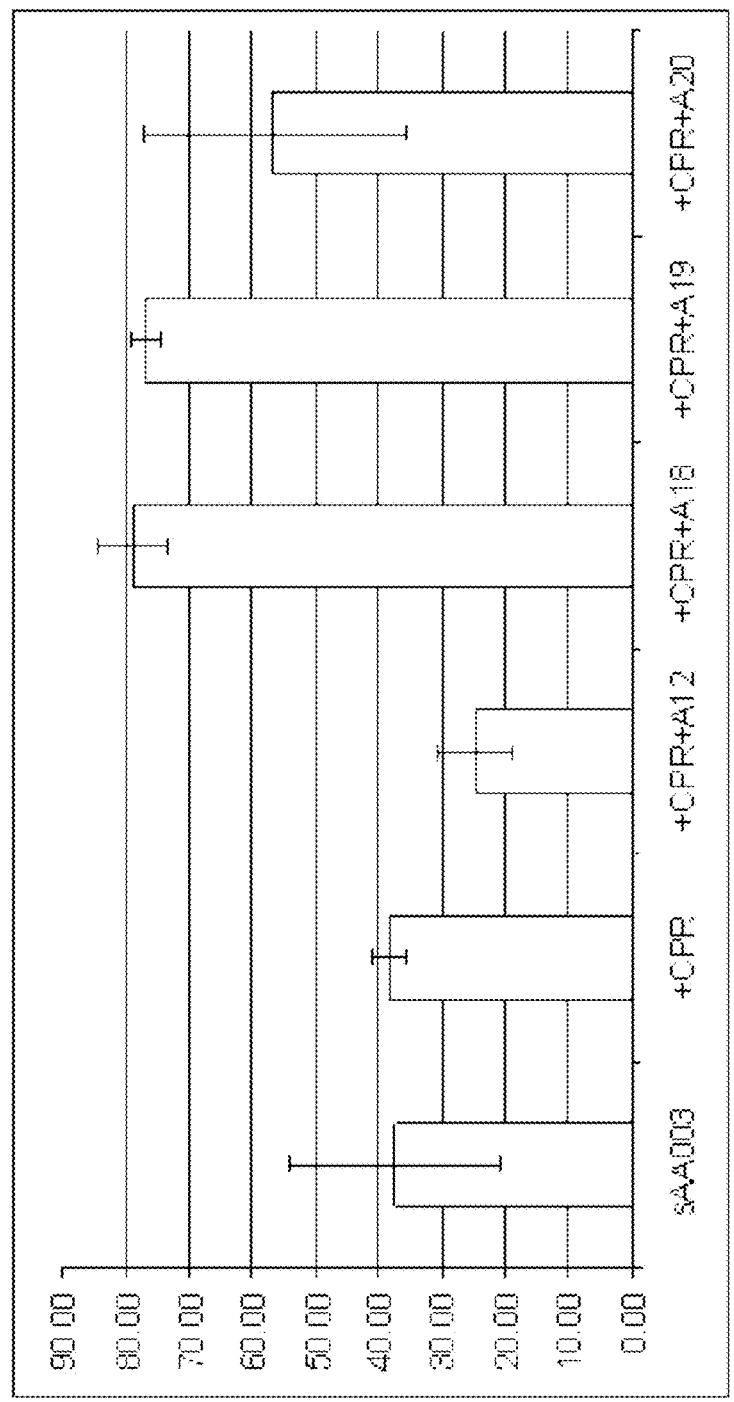
FIG. 12 graphically illustrates the conversion of decane to sebacic acid in a fully beta-oxidation blocked *Candida* yeast strain having additional genetic modifications. Strain sAA003 is the fully beta-oxidation blocked control strain. +CPR indicates the fully beta-oxidation blocked strain also includes an increased number of copies of cytochrome P450 reductase. +CPR+A12 indicates starting strain sAA003 includes the addition genetic modifications of an increased number of copies of cytochrome P450 reductase and also includes an increased number of copies of cytochrome P450 A12 (e.g., CYP52A12). +CPR+A18 indicates starting strain sAA003 includes the addition genetic modifications of an increased number of copies of cytochrome P450 reductase and also includes an increased number of copies of cytochrome P450 A18 (e.g., CYP52A18). +CPR+A19 indicates starting strain sAA003 includes the addition genetic modifications of an increased number of copies of cytochrome P450 reductase and also includes an increased number of copies of cytochrome P450 A19 (e.g., CYP52A19). +CPR+A20 indicates starting strain sAA003 includes the addition genetic modifications of an increased number of copies of cytochrome P450 reductase and also includes an increased number of copies of cytochrome P450 A20 (e.g., CYP52A20). The y-axis of FIG. 12 is percent of theoretical maximum yield. Experimental details and results are given in Example 7.

Example 7: Conversion of Capric Acid to Sebacic Acid in Shake Flask Fermentations Using Fully Beta-Oxidation Blocked Strains Having Additional Genetic Modifications in the Omega Oxidation Pathway Various genetically modified strains of Candida tropicalis were inoculated into 5 mL of SP92 medium (6.7 g/L yeast nitrogen base, 3.0 g/L yeast extract, 3.0 g/L $(NH_4)_2SO_4$, 1.0 g/L $K_2HPO_4$, 1.0 g/L $KH_2PO_4$, 75 g/L glycerol). The strains included a completely beta-oxidation blocked strain of Candida tropicalis (sAA003), as well as derivatives of sAA003 with amplified components of the omega-oxidation pathway (e.g., various cytochrome P450s, cytochrome P450 reductase or combinations thereof) and the cultures grown overnight at 30° C., with shaking at about 250 rpm. These starter cultures were then used to inoculate 25 mL cultures in the same medium and grown overnight at 30° C., with shaking at about 250 rpm. Cells were pelleted by centrifugation for 10 minutes at 4° C. and 1,050×g and the supernatant discarded. Cells were resuspended in 12.5 mL TB-lowN media+glycerol (1.7 g/L yeast nitrogen base without ammonium sulfate, 3.0 g/L yeast extract, 1.0 g/L $K_2HPO_4$, 1.0 g/L $KH_2PO_4$, 75 g/L glycerol) and transferred to a new sterile 250 mL glass baffled flask. Cultures were fed 0.05% from a 5% capric acid solution in ethanol and incubated at 30° C., with shaking at about 300 rpm. After 24 hours incubation cultures were fed glycerol to 30 g/L and an additional bolus of 0.05% capric acid. Incubation continued before sampling for GC at 24, 48, and 72 hours. The results are shown in FIG. 12. GC analysis showed that a greater proportion of capric acid was converted to sebacic acid when particular elements of the omega-oxidation pathway are amplified. The data are presented as % of theoretical maximum yield. Strains which include genetic modifications to CYPA18 and CYPA19 achieve approximately 80% of theoretical maximum yield in conversion of capric acid to sebacic acid. The strain designated +CPR+A18 has about 30 copies of CYPA18, whereas the strain designated +CPR+A19 has about 7 copies of CYPA19.

Figure 13:
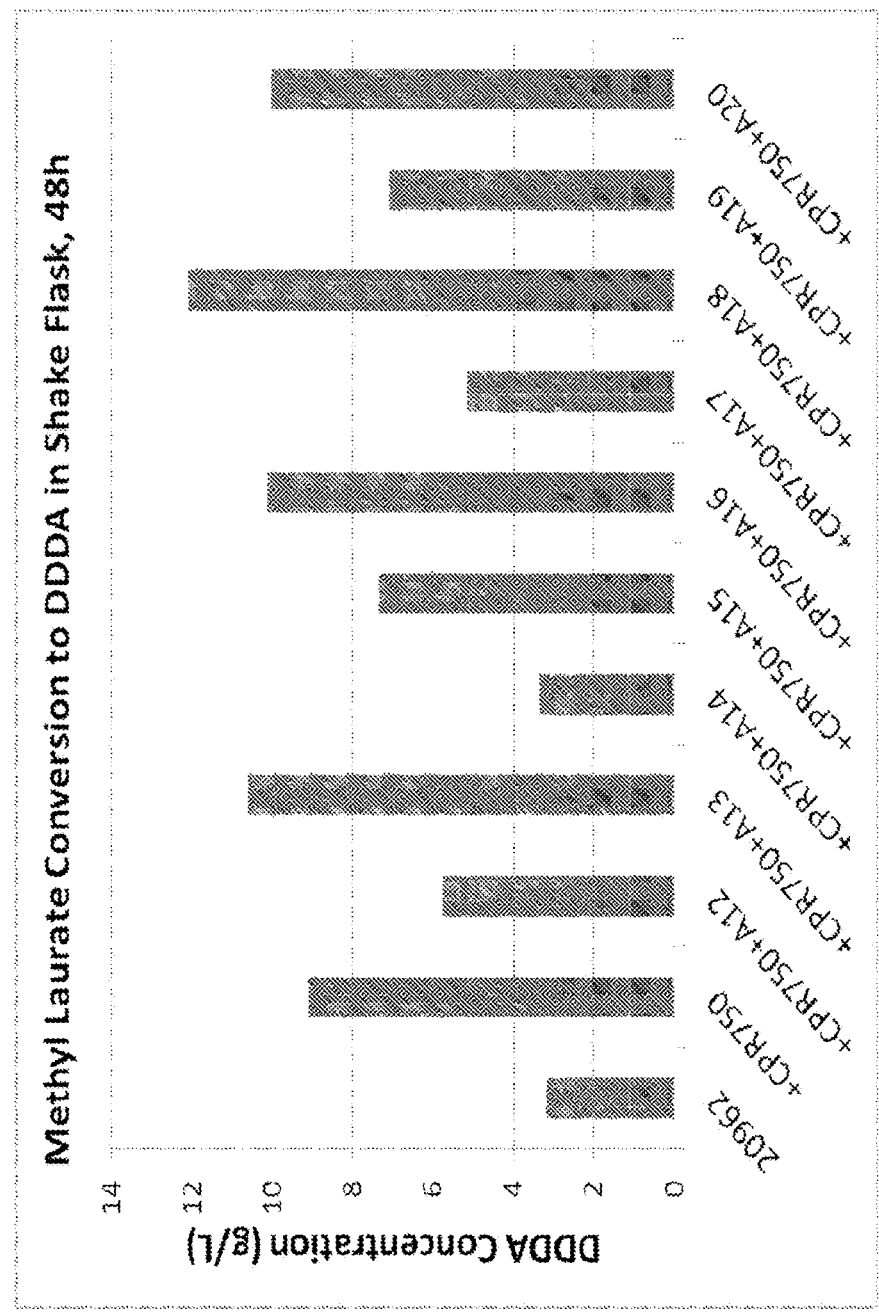
FIG. 13 graphically illustrates the results of conversion of methyl laurate to dodecanedioic acid in a fully beta-oxidation blocked *Candida* yeast strain also contain genetic alterations to a monooxygenase reductase activity, a monooxygenase activity, or a monooxygenase reductase activity and a monooxygenase activity. After 48 hours of incubation the media was subjected to gas chromatography. The results indicate that *Candida* strains containing an increased number of copies of a CYP52A18 monooxygenase activity and an increased number of copies of a monooxygenase reductase activity (e.g., CPR750) gave the highest yield of dodecanedioic acid (e.g., DDDA), in shake flask fermentation experiments. Experimental details and results are given in Example 8.

Example 8: Conversion of Methyl-Laurate to Dodecanedioic Acid in Shake Flask Fermentation 5 mL of SP92 glycerol medium (6.7 g/L yeast nitrogen base, 3.0 g/L yeast extract, 3.0 g/L (NH4)2SO4, 1.0 g/L K2HPO4, 1.0 g/L KH2PO4, 75 g/L glycerol) was inoculated with a single colony of a completely beta-oxidation blocked strain of Candida tropicalis (ATCC20962), as well as, modified derivatives of this strain with amplified components of the omega-oxidation pathway, and the cultures grown overnight at 30° C., with shaking at about 250 rpm. The starter cultures were then used to inoculate 25 mL cultures of the same medium and grown overnight at 30° C., with shaking at about 250 rpm. Cells were pelleted by centrifugation for 10 minutes at 4° C. and 1,050×g and the supernatant discarded. Cells were resuspended in 12.5 mL SP92 glycerol medium and transferred to a sterile 250 mL glass baffled flask. Cultures were fed 2% (v/v) methyl laurate and incubated at 30° C., with shaking at about 300 rpm. After 24 hours incubation, cultures were fed glycerol to 60 g/L and incubation continued before sampling for GC at 48 hours. GC analysis showed that amplification of certain components of the omega oxidation pathway allow for increased conversion to dodecanedioic acid (FIG. 13).

Example 9: Alteration of Acyl CoA Oxidase Substrate Specificity

The substrate specificity of the peroxisomal acyl-CoA oxidase enzymes POX4 and POX5 have been shown to be involved in the control of the diacid product chain-length in fermentations of Candida tropicalis fed a mixed chain-length fatty acid feedstock. Reduction or elimination of POX4 activity, POX5 activity or POX4 activity and POX5 activity, effects the carbon chain-length distribution of dicarboxylic acids produced in Candida spp. Acyl-CoA oxidase is the first enzyme in the cyclic beta-oxidation pathway that shortens a substrate by two carbons each cycle. Thus the acyl-CoA oxidase activity serves as the pathway entry point for substrates entering into the beta-oxidation pathway. Altering the substrate specificity on an acyl-CoA oxidase activity such that it is not active on substrate carbon chains shorter than a desired carbon chain length (e.g., C8, C10, C12, C14 and the like), can inhibit shortening of carbon chains below a chosen threshold, allowing accumulation of a desired target chain length and product (e.g., C12, dodecanedioic acid).

The native acyl-CoA oxidase isozymes in *Candida* strain ATCC20336, Pox4p and Pox5p have different substrate specificities. The Pox4p isozyme has a broad substrate specificity while the Pox5p isozyme has a narrow substrate specificity. In strains that are Pox4$^-$, Pox5$^+$ the chain length of the diacid product is determined by the substrate specificity of the Pox5p isozyme and the main product is adipic acid.

To maximize production of desired diacid products of longer chain lengths (e.g., C12) in fermentations, genetically modified organisms containing an acyl-CoA oxidase activity with a substrate chain-length specificity appropriate for the chain-length of the desired diacid product can be engineered, in some embodiments. The source of the acyl-CoA oxidase activity or the method of engineering the acyl-CoA oxidase activity may vary. Non-limiting examples of organisms which can be used to provide polynucleotide sequences suitable for use in engineering altered substrate specificity acyl-CoA oxidase activities include; plants (e.g., *Arabidopsis, Cucurbita* (e.g., pumpkin, squash), *Oryza* (e.g., rice)); animals (e.g., Bos (e.g., bovine), *Cavia* (e.g., guinea pig), Mus (e.g., mouse), *Rattus* (e.g., rat), Phascolarctos (e.g., Koala), primates (e.g., orangutans)); molds (e.g., Dictyostelium (e.g., slime molds)); insects (e.g., *Drosophila*); Yeast (e.g., *Yarrowia lipolytica, Candida maltosa, Candida glabrata, Ashbya gossypii, Debaryomyces hansenii, Kluyveromyces lactis, Pichia pastoris, Saccharomyces cerevisiae*); bacteria (e.g., *Eschericia coli*); cyanobacteria; nematodes (e.g., *Caenorhabditis*); and humans.

Acyl-CoA oxidase activities with different substrate chain-length specificities can be identified by:
1) Selecting acyl-CoA oxidase genes from heterologous organisms that contain different substrate chain-length specificities. The identified genes can be transferred into a *Candida* strain deleted for all acyl-CoA oxidase activity. The only acyl-CoA oxidase activity detectable in such a genetically modified organism may be that imparted by the heterologous gene.
2) Engineering an acyl-CoA oxidase gene library by domain swapping from multiple acyl-CoA oxidase genes to produce a library of non-native chimeric acyl-CoA oxidase genes. The library of chimeric genes can be transferred into a strain of *Candida* deleted for all acyl-CoA oxidase activity. The only detectable acyl-CoA oxidase activity may be that imparted by an engineered gene from the library of non-native chimeric acyl-CoA oxidase genes.
3) Engineering an acyl-CoA oxidase gene library by random mutagenesis. A naturally occurring or engineered acyl-CoA oxidase activity with a substrate chain-length specificity close to that desired can be used as the basis for random mutagenesis, followed by screening and/or selection in an effort to generate and identify an altered activity with the desired substrate chain-length specificity. The library of genes can be transferred into a *Candida* strain deleted for all acyl-CoA oxidase activity. The only detectable acyl-CoA oxidase activity may be that imparted by the gene from the randomly mutagenized library.
4) Engineering an acyl-CoA oxidase gene by intelligent design and directed mutation using protein structural information to guide the position and identity of the amino acid(s) to be replaced. The engineered gene(s) can be transferred into a *Candida* strain deleted for all acyl-CoA oxidase activity. The only detectable acyl-CoA oxidase activity may be that imparted by the engineered gene(s).

Figure 14:
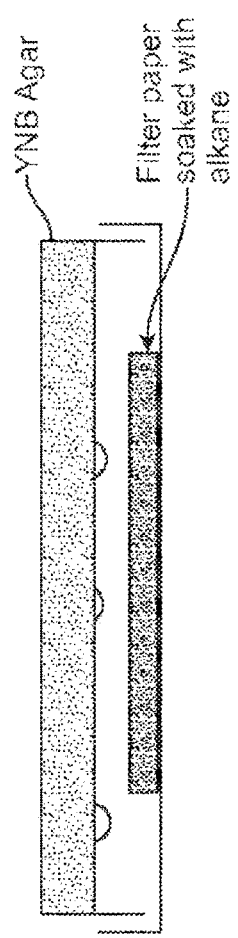
FIG. 14 and FIG. 15 schematically illustrate a screening and/or selection method for identifying acyl-CoA oxidase activities with specific substrate specificities. The method can be utilized in conjunction with generating and/or identifying acyl-CoA oxidase activities with altered chain-length substrate specificities. Screening/selection method details are given in Example 9.
Figure 15:
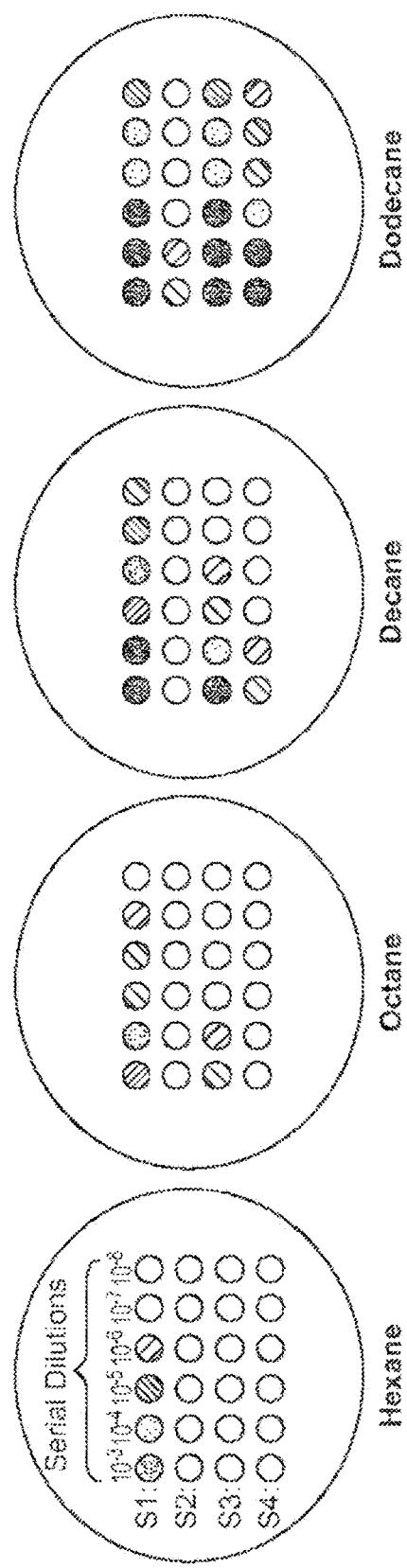

A non-limiting example of a post-engineering method for selecting genes that impart the desired substrate chain-length specificity is provided herein. Selection is performed by growth on substrates of different chain lengths that are provided as the only carbon source. Growth of the cells on certain substrates but not others often reflects the substrate chain-length specificity of the acyl-CoA oxidase enzyme present in the strain. *Candida tropicalis* can utilize alkanes provided in the gas phase as its sole carbon source for growth. Alkanes of different chain lengths are provided by soaking a filter paper in the appropriate alkane, and inverting a solid growth media without a carbon source over the filter paper, with each specific carbon source (e.g., specific chain length alkane) provided in a different petri dish. Serially diluted *Candida* carrying the altered specificity acyl-CoA oxidase genes are spotted on the solid growth media as a growth selection for the chain-length specificity of the acyl-CoA oxidase enzyme in each strain. Shown in FIGS. 14 and 15 are a schematic representation of the selection process, which provides an alkane as a gas phase carbon source, as described herein. The solid growth media is an agar medium containing yeast nitrogen base without amino acids or any other carbon source. The plated cells are inverted over a lid containing a filter paper soaked with an alkane of appropriate chain length that evaporates and provides the carbon source through the gas phase, as shown in FIG. 14.

*Candida* strains containing altered acyl-CoA oxidase activities generated as described herein are selected and/or screened using the method described herein. Strains carrying different altered acyl-CoA oxidase activities (e.g., strain 1 (S1), strain 2 (S2), strain 3 (S3), strain 4 (S4)) are grown overnight in a rich medium (e.g., YPD). Overnight cultures are centrifuged and washed to remove any traces of residual rich medium and serial dilutions of the cells are prepared in a phosphate buffered solution. The serial dilutions of each strain are spotted onto multiple YNB agar plates (growth medium having no amino acids or other carbon sources), the individual plates inverted over filter papers soaked in the appropriate chain length alkane, and the plate incubated at 30° C. The growth of the strains is dependent upon the chain-length specificity of the acyl-CoA oxidase. In order to utilize the particular alkane for growth the provided chain-length must be able to enter the beta-oxidation pathway. The shortest chain-length at which a certain strain is able to grow indicates the shortest chain-length of the acyl-CoA oxidase isozymes substrate specificity. An example is provided in FIG. 15. FIG. 15 illustrates that strain S4 can grow on decane, but is unable to grow on octane. Therefore the modified acyl-CoA oxidase activity of strain S4 has a substrate chain-length specificity that inhibits the utilization of 8 carbon molecules and the diacid product from fermentations with this strain typically result in an 8 carbon diacid. Acyl-CoA oxidase activities with any desired specificity can be selected and/or screened using the method described herein.

It will be understood that the example presented herein is a generalize method used to describe the selection/screening process. The feedstocks used for the selection and screening process are altered to suit the acyl-CoA oxidase activity being sought. For example, for acyl-CoA oxidases having specificity for longer chain substrates, feedstocks having longer carbon chain lengths could be substituted to allow selection and or screening for acyl-CoA oxidase activities with specificities for longer carbon chain lengths.

Example 10: Transformation of *Candida* Spp. Procedure 5 mL YPD start cultures were inoculated with a single colony of *Candida* strain ATCC20336 and incubated overnight at 30° C., with shaking at about 200 rpm. The following day, fresh 25 mL YPD cultures, containing 0.05% Antifoam B, were inoculated to an initial $OD_{600nm}$ of 0.4 and the culture incubated at 30° C., with shaking at about 200 rpm until an $OD_{600nm}$ of 1.0-2.0 was reached. Cells were pelleted by centrifugation at 1,000×g, 4° C. for 10 minutes. Cells were washed by resuspending in 10 mL sterile water, pelleted, resuspended in 1 mL sterile water and transferred to a 1.5 mL microcentrifuge tube. The cells were then washed in 1 mL sterile TE/LiOAC solution, pH 7.5, pelleted, resuspended in 0.25 mL TE/LiOAC solution and incubated with shaking at 30° C. for 30 minutes.

The cell solution was divided into 50 uL aliquots in 1.5 mL tubes to which was added 5-8 ug of linearized DNA and 5 uL of carrier DNA (boiled and cooled salmon sperm DNA, 10 mg/mL). 300 uL of sterile PEG solution (40% PEG 3500, 1× TE, 1×LiOAC) was added, mixed thoroughly and incubated at 30° C. for 60 minutes with gentle mixing every 15 minutes. 40 uL of DMSO was added, mixed thoroughly and the cell solution was incubated at 42° C. for 15 minutes. Cells were then pelleted by centrifugation at 1,000×g 30 seconds, resuspended in 500 uL of YPD media and incubated at 30° C. with shaking at about 200 rpm for 2 hours. Cells were then pelleted by centrifugation and resuspended in 1 mL IX TE, cells were pelleted again, resuspended in 0.2 mL 1×TE and plated on selective media. Plates were incubated at 30° C. for growth of transformants.

Example 11: Procedure for Recycling of the URA3 Marker

The URA3 gene was obtained from genomic DNA of *Candida* yeast culture ATCC20336. *Candida* strain ATCC20336 has a limited number of selectable marker, as compared to *S. cerevisiae*, therefore, the URA3 marker is "recycled" to allow multiple rounds of selection using URA3. To reutilize the URA3 marker for subsequent engineering of *Candida* spp., a single colony having the Ura+ phenotype was inoculated into 3 mL YPD and grown overnight at 30° C. with shaking. The overnight culture was then harvested by centrifugation and resuspended in 1 mL YNB+YE (6.7 g/L Yeast Nitrogen Broth, 3 g/L Yeast Extract). The resuspended cells were then serially diluted in YNB+YE and 100 uL aliquots plated on YPD plates (incubation overnight at 30° C.) to determine titer of the original suspension. Additionally, triplicate 100 uL aliquots of the undiluted suspension were plated on SC Dextrose (Bacto Agar 20 g/L, Uracil 0.3 g/L, Dextrose 20 g/L, Yeast Nitrogen Broth 6.7 g/L, Amino Acid Dropout Mix 2.14 g/L) and 5-FOA. at 3 different concentrations (0.5, 0.75, 1 mg/mL).

Plates were incubated for at least 5 days at 30° C. Colonies arising on the SC Dextrose+5-FOA plates were resuspended in 50 uL sterile, distilled water and 5 uL utilized to streak on to YPD and SC-URA (SC Dextrose medium without Uracil) plates. Colonies growing only on YPD and not on SC-URA plates were then inoculated into 3 mL YPD and grown overnight at 30° C. with shaking. Overnight cultures were harvested by centrifugation and resuspended in 1.5 mL YNB (6.7 g/L Yeast Nitrogen Broth). The resuspended cells were serially diluted in YNB and 100 uL aliquots plated on YPD plates and incubation overnight at 30° C. to determine initial titer. 1 mL of each undiluted cell suspension also was plated on SC-URA and incubated for up to 7 days at 30° C. Colonies on the SC-URA plates are revertants and the isolate with the lowest reversion frequency (<1e) was used for subsequent strain engineering.

Example 12: Cloning and Analysis of *Candida* Fatty Alcohol Oxidase (FAO) Alleles Isolation of Fatty Alcohol Oxidase Genes from *Candida*
*Candida* strain (ATCC20336) fatty alcohol oxidase genes were isolated by PCR amplification using primers generated to amplify the sequence region covering promoter, fatty alcohol oxidase gene (FAO) and terminator of the FAO1 sequence (GenBank accession number of FAO1 AY538780). The primers used to amplify the fatty alcohol oxidase nucleotide sequences from *Candida* strain ATCC20336 strain ATCC20336, are showing in TABLE 2 below.

TABLE 7

| Oligonucleotides for cloning FAO alleles | |
|---|---|
| Oligo | Sequence |
| oAA0144 | AACGACAAGATTAGATTGGTTGAGA |
| oAA0145 | GTCGAGTTTGAAGTGTGTGTCTAAG |
| oAA0268 | AGATCTCATATGGCTCCATTTTTGCCCGACCAGG TCGACTACAAACACGTC |
| oAA0269 | ATCTGGATCCTCATTACTACAACTTGGCTTTGGTCTTCAAGG AGTCTGCCAAACCTAAC |
| oAA0282 | ACATCTGGATCCTCATTACTACAACTTGGCCTTGGTCT |
| oAA0421 | CACACAGCTCTTCTAGAATGGCTCCATTTTTGCCCGAC CAGGTCGAC |
| oAA0422 | CACACAGCTCTTCCTTTCTACAACTTGGCTTTGGTCTTC AAGGAGTCTGC |
| oAA0429 | GTCTACTGATTCCCCTTTGTC |
| oAA0281 | TTCTCGTTGTACCCGTCGCA |

PCR reactions contained 25 uL 2×master mix, 1.5 uL of oAA0144 and oAA0145 (10 uM), 3.0 uL genomic DNA, and 19 uL sterile H₂0. Thermocycling parameters used were 98° C. for 2 minutes, 35 cycles of 98° C. 20 seconds, 52° C. 20 seconds, 72° C. 1 minute, followed by 72° C. 5 minutes and a 4° C. hold. PCR products of the correct size were gel purified, ligated into pCR-Blunt II-TOPO (Invitrogen) and transformed into competent TOP10 *E. coli* cells (Invitrogen). Clones containing PCR inserts were sequenced to confirm correct DNA sequence. Four FAO alleles were identified from sequence analysis and designated as FAO-13, FAO-17, FAO-18 and FAO-20. The sequence of the clone designated FAO-18 had a sequence that was substantially identical to the sequence of FAO1 from GenBank. The resulting plasmids of the four alleles were designated pAA083, pAA084, pAA059 and pAA085, respectively. Sequence identity comparisons of FAO genes isolated as described herein are shown in the tables below.

DNA sequence identity

| | FAO1 | FAO-18 | FAO-17 | FAO-13 | FAO-20 | FAO2a | FAO2b |
|---|---|---|---|---|---|---|---|
| FAO1 | 100 | 100 | 98 | 96 | 95 | 83 | 82 |
| FAO-18 | | 100 | 98 | 96 | 95 | 83 | 82 |
| FAO-17 | | | 100 | 98 | 98 | 83 | 82 |
| FAO-13 | | | | 100 | 99 | 83 | 83 |
| FAO-20 | | | | | 100 | 83 | 83 |
| FAO2a | | | | | | 100 | 96 |
| FAO2b | | | | | | | 100 |

Protein sequence identity

| | FAO1 | FAO-18 | FAO-17 | FAO-13 | FAO-20 | FAO2a | FAO2b |
|---|---|---|---|---|---|---|---|
| FAO1 | 100 | 100 | 99 | 98 | 98 | 81 | 80 |
| FAO-18 | | 100 | 99 | 98 | 98 | 81 | 80 |
| FAO-17 | | | 100 | 99 | 99 | 82 | 81 |
| FAO-13 | | | | 100 | 99 | 82 | 81 |
| FAO-20 | | | | | 100 | 82 | 81 |
| FAO2a | | | | | | 100 | 97 |
| FAO2b | | | | | | | 100 |

Amino acid differences in FAO alleles

| | 32 | 75 | 89 | 179 | 185 | 213 | 226 | 352 | 544 | 590 |
|---|---|---|---|---|---|---|---|---|---|---|
| FAO1 | E | M | G | L | Y | T | R | H | S | P |
| FAO-13 | Q | T | A | L | Y | A | K | Q | A | A |
| FAO-20 | Q | T | A | M | D | A | K | Q | A | A |

Expression of FAO Alleles in *E. coli*

To determine the levels of FAO enzyme activity with respect to various carbon sources, the four isolated FAO alleles were further cloned and over-expressed in *E. coli*. The FAOs were amplified using the plasmids mentioned above as DNA template by PCR with primers oAA0268 and oAA0269 for FAO-13 and FAO-20 and oAA0268 and oAA0282 for FAO-17 and FAO-18, using conditions as described herein. PCR products of the correct size were gel purified and ligated into pET11a vector between NdeI and BamHI sites and transformed into BL21 (DE3) *E. coli* cells. The colonies containing corresponding FAOs were confirmed by DNA sequencing. Unmodified pET11a vector also was transformed into BL21 (DE3) cells, as a control. The resulting strains and plasmids were designated sAA153 (pET11a), sAA154 (pAA079 containing FAO-13), sAA155 (pAA080 containing FAO-17), sAA156 (pAA081 containing FAO-18) and sAA157 (pAA082 containing FAO-20), respectively. The strains and plasmids were used for FAO over-expression in *E. coli*. One colony of each strain was transferred into 5 mL of LB medium containing 100 µg/mL ampicillin and grown overnight at 37° C., 200 rpm. The overnight culture was used to inoculate a new culture to $OD_{600nm}$ 0.2 in 25 ml LB containing 100 µg/ml ampicillin. Cells were induced at $OD_{600nm}$ 0.8 with 0.3 mM IPTG for 3 hours and harvested by centrifugation at 4° C. 1,050×g for 10 minutes. The cell pellet was stored at −20° C.

Expression of FAOs in a *Candida* Strain

Two alleles, FAO-13 and FAO-20, were chosen for amplification in *Candida* based on their substrate specificity profile, as determined from enzyme assays of soluble cell extracts of *E. coli* with over expressed FAOs. DNA fragments containing FAO-13 and FAO-20 were amplified using plasmids pAA079 and pAA082 as DNA templates, respectively, by PCR with primers oAA0421 and oAA0422. PCR products of the correct sizes were gel purified and ligated into pCR-Blunt II-TOPO (Invitrogen), transformed into competent TOP10 *E. coli* cells (Invitrogen) and clones containing FAO inserts were sequenced to confirm correct DNA sequence. Plasmids containing FAO-13 and FAO-20 were digested with SapI and ligated into vector pAA105, which includes the *Candida* strain ATCC20336 PGK promoter and terminator. The resulting plasmids were confirmed by restriction digestion and DNA sequencing and designated as pAA115 (FAO-13) and pAA116 (FAO-20), respectively. Plasmids pAA115 and pAA116 were linearized with SpeI, transformed into competent *Candida* spp. Ura⁻ strains sAA002 (SU-2, ATCC20913) and sAA103. The integration of FAO-13 and FAO-20 was confirmed by colony PCR using primers oAA0429 and oAA0281. The resulting strains were designated as sAA278 (pAA115 integrated in strain sAA002), sAA280 (pAA116 integrated in sAA002), sAA282 (pAA115 integrated in sAA103), and sAA284 (pAA116 integrated in sAA103), and were used for fatty alcohol oxidase over-expression in *Candida* spp.

One colony of each strain was inoculated into 5 ml YPD and grown overnight as described herein. The overnight culture was used to inoculate a new 25 mL YPD culture to about $OD_{600nm}$ 0.5. FAO over-expression was regulated by the PGK promoter/terminator, induced with glucose in the medium and expressed constitutively. Strains sAA002 and sAA103 (e.g., untransformed starting strains) were included as negative controls for FAO over-expression. Cells were harvested at early log phase ($OD_{600nm}$=in the range of between about 3 to about 5) by centrifugation at 4° C. for 10 minutes at 1,050×g. Cell pellets were stored at −20° C.

Cell Extract Preparation from *E. coli*

Cell pellets from 25 mL of FAO expressing *E. coli* cultures were resuspended in 10 mL phosphate-glycerol buffer containing 50 mM potassium phosphate buffer (pH7.6), 20% glycerol, 1 mM Phenylmethylsulfonyl fluoride (PMSF), 2 uL Benzonase 25U/uL, 20 uL 10 mg/mL lysozyme. The cells were then lysed by incubation at room temperature for 50 minutes on a rotating shaker, and the cell suspension centrifuged for 30 minutes at 4° C. using 15,000×g for. The supernatant was aliquoted in 1.5 ml microcentrifuge tubes and stored at −20° C. for FAO enzyme activity assays.

Cell Extract Preparation from *Candida*

Frozen *C. tropicalis* cell pellets were resuspended in 1.2 ml of phosphate-glycerol buffer containing 50 mM potassium phosphate buffer (pH7.6), 20% glycerol, 1 mM Phenylmethylsulfonyl fluoride (PMSF). Resuspended cells were transferred to 1.5 mL screw-cap tubes containing about 500 uL of zirconia beads on ice. The cells were lysed with a Bead Beater (Biospec) using 2 minute pulses and 1 minute rest intervals on ice. The process was repeated 3 times. The whole cell extract was then transferred to a new 1.5 ml tube and centrifuged at 16,000×g for 15 minutes at 4° C. The supernatant was transferred into a new tube and used for FAO enzyme activity assays.

Protein Concentration Determination

Protein concentration of the cell extracts was determined using the Bradford Reagent following manufacturers' recommendations (Cat#23238, Thermo scientific).

FAO Enzyme Activity Assay

FAO enzyme activity assays were performed using a modification of Eirich et al., 2004). The assay utilizes a two-enzyme coupled reaction (e.g., FAO and horse radish peroxidase (HRP)) and can be monitored by spectrophotometry. 1-Dodecanol was used as a standard substrate for fatty alcohol oxidase enzymatic activity assays. FAO oxidizes the dodecanol to dodecanal while reducing molecular oxygen to hydrogen peroxide simultaneously. HRP reduces (2,2′-azino-bis 3-ethylbenzthiazoline-6-sulfonic acid; ABTS) in the two-enzyme coupled reaction, where the electron obtained from oxidizing hydrogen peroxide to ABTS, which can be measured by spectrometry at 405 nm. The assay was modified using aminotriazole (AT) to prevent the destruction of $H_2O_2$ by endogenous catalase, thus eliminating the need for microsomal fractionation. The final reaction mixture (1.0 mL) for FAO enzyme assay consisted of 500 µL of 200 mM HEPES buffer, pH 7.6; 50 µL of a 10 mg/mL ABTS solution in deionized water; 10 µL of 5 mM solution of dodecanol in acetone; 40 µL of 1M AT and 5 µL of a 2 mg/mL horseradish peroxidase solution in 50 mM potassium phosphate buffer, pH 7.6. Reaction activity was measured by measuring light absorbance at 405 nm for 10 minutes at room temperature after adding the extract. The amount of extract added to the reaction mixture was varied so that the activity fell within the range of 0.2 to 1.0 $\Delta A_{405nm}$/min. The actual amounts of extract used were about 1.69 U/mg for E. coli expressed FAO-13, 0.018U/mg for E. coli expressed FAO-17, 0.35U/mg for E. coli expressed FAO-18 (e.g., FAO1), 0.47 U/mg E. coli expressed FAO-20, 0.036U/mg Candida (strain sAA278) expressed FAO-13, 0.016U/mg Candida (strain sAA282) expressed FAO-13, 0.032U/mg Candida (strain sAA280) expressed FAO-20 and 0.029 U/mg Candida (strain sAA284) expressed FAO-20. FAO activity was reported as activity units/mg of total protein (1 unit=1 □mole substrate oxidized/min). An extinction coefficient at 405 nm of 18.4 was used for ABTS and was equivalent to 0.5 mM oxidized substrate. The results of the activity assays are shown in the tables below.

| FAO activity (units/mg total protein) on primary alcohols | | | | | | | |
|---|---|---|---|---|---|---|---|
| | 1-Butanol | 1-Pentanol | 1-Hexanol | 1-Octanol | 1-Decanol | 1-Dodecanol | 1-Tetradecanol | 1-Hexadecanol |
| FAO-13 | 0.01 | 0.09 | 1.17 | 82.67 | 70.94 | 100 | 79.35 | 58.88 |
| FAO-17 | 0.72 | 0.26 | 1.06 | 66.23 | 22.00 | 100 | 47.86 | 60.98 |
| FAO-18 | 0.07 | 0.11 | 0.26 | 60.56 | 54.56 | 100 | 114.47 | 50.65 |
| FAO-20 | 0.07 | 0.11 | 0.91 | 55.96 | 74.57 | 100 | 89.52 | 42.59 |

| FAO activity (units/mg total protein) on omega hydroxy fatty acids | | | | | |
|---|---|---|---|---|---|
| | 1-Dodecanol | 6-OH-HA | 10-OH-DA | 12-OH-DDA | 16-OH-HDA |
| FAO-13 | 100 | 4.18 | 4.14 | 6.87 | 8.57 |
| FAO-17 | 100 | 1.18 | 0.00 | 0.59 | 0.94 |
| FAO-18 | 100 | 0.00 | 0.00 | 4.87 | 2.94 |
| FAO-20 | 100 | 0.03 | 0.04 | 2.25 | 7.46 |

Example 13: Construction of Candida Shuttle Vector pAA061

Vector pAA061 was constructed from a pUC19 backbone to harbor the selectable marker URA3 from Candida strain ATCC20336 as well as modifications to allow insertion of Candida promoters and terminators. A 1,507 bp DNA fragment containing the promoter, ORF, and terminator of URA3 from Candida ATCC20336 was amplified using primers oAA0124 and oAA0125, shown in TABLE 3 below. The URA3 PCR product was digested with NdeI/MluI and ligated into the 2,505 bp fragment of pUC19 digested with NdeI/BsmBI (an MluI compatible overhang was produced by BsmBI). In order to replace the lac promoter with a short 21 bp linker sequence, the resulting plasmid was digested with SphI/SapI and filled in with a linker produced by annealing oligos oAA0173 and oAA0174. The resulting plasmid was designated pAA061.

TABLE 8

Oligonucleotides for construction of pAA061

| Oligos | Sequence | PCR product (bp) |
|---|---|---|
| oAA0124 | cacacacatatgCGACGGGTACAACGAGAATT | 1507 |
| oAA0125 | cacacaacgcgtAGACGAAGCCGTTCTTCAAG | |
| oAA0173 | ATGATCTGCCATGCCGAACTC | 21 (linker) |
| oAA0174 | AGCGAGTTCGGCATGGCAGATCATCATG | |

Example 14: Cloning of Candida PGK Promoter and Terminator

Vector pAA105 was constructed from base vector pAA061 to include the phosphoglycerate kinase (PGK) promoter and terminator regions from Candida ATCC20336 with an intervening multiple cloning site (MCS) for insertion of open reading frames (ORF's). The PGK promoter region was amplified by PCR using primers oAA0347 and oAA0348, shown in TABLE 4. The 1,029 bp DNA fragment containing the PGK promoter was digested with restriction enzymes PstI/XmaI. The PGK terminator region was amplified by PCR using primers oAA0351 and oAA0352, also shown in TABLE 4. The 396 bp DNA fragment containing the PGK terminator was digested with restriction enzymes XmaI/EcoRI. The 3,728 bp PstI/EcoRI DNA fragment from pAA061 was used in a three piece ligation reaction with the PGK promoter and terminator regions to produce pAA105. The sequence between the PGK promoter and terminator contains restriction sites for incorporating ORF's to be controlled by the functionally linked constitutive PGK promoter.

TABLE 9

Oligonucleotides for cloning Candida PGK promoter and terminator

| Oligos | Sequence | PCR product (bp) |
|---|---|---|
| oAA0347 | CACACACTGCAGTTGTCCAATGTAATAATTTT | 1028 |
| oAA0348 | CACACATCTAGACCCGGGCTCTTCTTCTGAATAGGCAATTGATAAACTTACTTATC | |
| oAA0351 | GAGCCCGGGTCTAGATGTGTGCTCTTCCAAAGTACGGTGTTGTTGACA | 396 |
| oAA0352 | CACACACATATGAATTCTGTACTGGTAGAGCTAAATT | |

Example 15: Cloning of the POX4 Locus

Primers oAA0138 and oAA0141 (TABLE 5) were generated to amplify the entire sequence of NCBI accession number M12160 for the YSAPDX4 locus from genomic DNA prepared from Candida strain ATCC20336. The 2,845 bp PCR product was cloned into the vector, pCR-BluntII-TOPO (Invitrogen), sequenced and designated pAA052.

TABLE 10

Oligonucleotides for cloning of POX4

| Oligos | Sequence | PCR product (bp) |
|---|---|---|
| oAA0138 | GAGCTCCAATTGTAATATTTCGGG | 2845 |
| oAA0141 | GTCGACCTAAATTCGCAACTATCAA | |

Example 16: Cloning of the POX5 Locus

Primers oAA0179 and oAA0182 (TABLE 6) were generated to amplify the entire sequence of NCBI accession number M12161 for the YSAPDX5 locus from genomic DNA prepared from Candida strain ATCC20336. The 2,624 bp PCR product was cloned into the vector, pCR-BluntII-TOPO (Invitrogen), sequenced and designated pAA049.

TABLE 11

Oligonucleotides for cloning of POX5

| Oligos | Sequence | PCR product (bp) |
|---|---|---|
| oAA0179 | GAATTCACATGGCTAATTTGGCCTCGGTTCCACAACGCACTCAGCATTAAAAA | 2624 |
| oAA0182 | GAGCTCCCCTGCAAACAGGGAAACACTTGTCATCTGATTT | |

Example 17: Construction of Strains with Amplified CPR and CYP52 Genes

Strains having an increased number of copies of cytochrome P450 reductase (CPR) and/or for cytochrome P450 monooxygenase (CYP52) genes were constructed to determine how over expression of CPR and CYP52 affected diacid production.

Cloning and Integration of the CPR Gene

A 3,019 bp DNA fragment encoding the CPR promoter, ORF, and terminator from Candida ATCC750 was amplified by PCR using primers oAA0171 and oAA0172 (TABLE 7) incorporating unique SapI and SphI sites. The amplified DNA fragment was cut with the indicated restriction enzymes and ligated into plasmid pAA061, (described in Example 13) to produce plasmid pAA067. Plasmid pAA067 was linearized with ClaI and transformed into Candida Ura$^-$ strain sAA103 (ura3/ura3, pox4::ura3/pox4::ura3, pox5::ura3/pox5::ura3). Transformations were performed with plasmid pAA067 alone and in combination with plasmids harboring the CYP52A15 or CYP52A16 genes, described below.

Cloning and Integration of CYP52A 15 Gene

A 2,842 bp DNA fragment encoding the CYP52A15 promoter, ORF, and terminator from Candida ATCC20336 was amplified by PCR using primers oAA0175 and oAA0178 (see Table 7 below) and cloned into pCR-BluntII-TOPO for DNA sequence verification. The cloned CYP52A15 DNA fragment was isolated by restriction digest with XbaI/BamHI (2,742 bp) and ligated into plasmid pAA061, (described in Example 13), to produce plasmid pAA077. Plasmid pAA077 was linearized with PmlI and transformed into Candida Ura$^-$ strain sAA103 (ura3/ura3, pox4::ura3/pox4::ura3, pox5::ura3/pox5::ura3). pAA077 was cotransformed with plasmid pAA067 harboring the CPR gene.

Cloning and Integration of CYP52A16 Gene

A 2,728 bp DNA fragment encoding the CYP52A16 promoter, ORF, and terminator from Candida ATCC20336 was amplified by PCR using primers oAA0177 and oAA0178 (TABLE 7) and cloned into pCR-BluntII-TOPO for DNA sequence verification. The cloned CYP52A16 DNA fragment was amplified with primers oAA0260 and oAA0261(TABLE 7) which incorporated unique SacI/XbaI restriction sites. The amplified DNA fragment was digested with SacI and XbaI restriction enzymes and ligated into plasmid pAA061 to produce plasmid pAA078. Plasmid pAA078 was linearized with ClaI and transformed into Candida Ura$^-$ strain sAA103 (ura3/ura3, pox4::ura3/pox4::ura3, pox5::ura3/pox5::ura3). pAA078 was cotransformed with plasmid pAA067 harboring the CPR gene.

TABLE 12

Oligonucleotides for cloning of CPR, CYP52A15 and CYP52A16

| Oligos | Sequence | PCR product (bp) |
|---|---|---|
| oAA0171 | cacctcgctcttccAGCTGTCATGTCTATTCAATGCTTCGA | 3019 |

TABLE 12-continued

Oligonucleotides for cloning of CPR, CYP52A15 and CYP52A16

| Oligos | Sequence | PCR product (bp) |
|---|---|---|
| oAA0172 | cacacagcatgcTAATGTTTATATCGTTGACGGTGAAA | |
| oAA0175 | cacaaagcggaagagcAAATTTTGTATTCTCAGTAGGATTTCATC | 2842 |
| oAA0178 | cacacagcatgCAAACTTAAGGGTGTTGTAGATATCCC | |
| oAA0177 | cacacacccgggATCGACAGTCGATTACGTAATCCATATTATTT | 2772 |
| oAA0178 | cacacagcatgCAAACTTAAGGGTGTTGTAGATATCCC | |
| oAA0260 | cacacagagctcACAGTCGATTACGTAATCCAT | 2772 |
| oAA0261 | cacatctagaGCATGCAAACTTAAGGGTGTTGTA | |

Preparation of Genomic DNA

Genomic DNA was prepared from transformants for PCR verification and for Southern blot analysis. Isolated colonies were inoculated into 3 mL YPD and grown overnight at 30° C. with shaking. Cells were pelleted by centrifugation. To each pellet, 200 uL Breaking Buffer (2% Triton X-100, 1% SDS, 100 mM NaCl, 10 mM Tris pH 8 and, 1 mM EDTA) was added, and the pellet resuspended and transferred to a fresh tube containing 200 uL 0.5 mm Zirconia/Silica Beads. 200 uL Phenol:Chloroform:Isoamyl Alcohol (25:24:1) was added to each tube, followed by vortexing for 1 minute. Sterile distilled water was added (200 uL) to each tube and the tubes were centrifuged at 13000 rpm for 10 minutes. The aqueous layer was ethanol precipitated and washed with 70% ethanol. The pellet was resuspended in 100-200 □l 10 mM Tris, after drying. Genomic DNA preparation for southern blot analysis was performed using the same procedure on 25 mL cultures for each colony tested.

Characterization of Strains with Amplified CPR and CYP52 Genes

Verification of integrated genes and/or sequences was performed by PCR using primers oAA0252 and oAA0256 (CPR), oAA0231 and oAA0281 (CYP52A15), and oAA0242 and oAA0257 (CYP52A16). The primers used for verification are shown in TABLE 8.

TABLE 13

Oligonucleotides for PCR verification of CPR, CYP52A15 and CYP52A16

| Oligos | Sequence | PCR product (bp) |
|---|---|---|
| oAA0252 | TTAATGCCTTCTCAAGACAA | 743 |
| oAA0256 | GGTTTTCCCAGTCACGACGT | |
| oAA0231 | CCTTGCTAATTTTCTTCTGTATAGC | 584 |
| oAA0281 | TTCTCGTTGTACCCGTCGCA | |
| oAA0242 | CACACAACTTCAGAGTTGCC | 974 |
| oAA0257 | TCGCCACCTCTGACTTGAGC | |

Southern blot analysis was used to determine the copy number of the CPR, CYP52A15 and CYP52A16 genes. Biotinylated DNA probes were prepared with gene specific oligonucleotides using the NEBlot Phototope Kit from New England BioLabs (Catalog #N7550S) on PCR products generated from each gene target as specified in TABLE 9 below. Southern Hybridizations were performed using standard methods (e.g., Sambrook, J. and Russell, D. W. (2001) Molecular Cloning: A Laboratory Manual, (3$^{rd}$ ed.), pp. 6.33-6.64. Cold Spring Harbor Laboratory Press). Detection of hybridized probe was performed using the Phototope-Star Detection Kit from New England BioLabs (Catalog #N7020S). Copy number was determined by densitometry of the resulting bands.

TABLE 14

Oligonucleotides for Probe Template PCR of CPR, CYP52A15 and CYP52A16

| Oligos | Sequence | Gene | Template | PCR product (bp) |
|---|---|---|---|---|
| oAA0250 | AATTGAACATCAGAAGAGGA | CPR | pAA067 | 1313 |
| oAA0254 | CCTGAAATTTCCAAATGGTGTCTAA | | | |
| oAA0227 | TTTTTTGTGCGCAAGTACAC | CYP52A15 | pAA077 | 905 |
| oAA0235 | CAACTTGACGTGAGAAACCT | | | |
| oAA0239 | AGATGCTCGTTTTACACCCT | CYP52A16 | pAA078 | 672 |
| oAA0247 | ACACAGCTTTGATGTTCTCT | | | |

Example 18: Addition and/or Amplification of Monooxygenase and Monooxygenase Reductase Activities Cytochrome P450's often catalyze a monooxygenase reaction, e.g., insertion of one atom of oxygen into an organic substrate (RH) while the other oxygen atom is reduced to water:

$$RH + O_2 + 2H^+ + 2e^- \rightarrow ROH + H_2O$$

The substrates sometimes are of a homogeneous carbon chain length. Enzymes with monooxygenase activity sometimes recognize substrates of specific carbon chain lengths, or a subgroup of carbon chain lengths with respect to organic substrates of homogenous carbon chain length. Addition of novel cytochrome activities (e.g., *B. megaterium* BM3) and/or amplification of certain or all endogenous or heterologous monooxygenase activities (e.g., CYP52A12 polynucleotide, CYP52A13 polynucleotide, CYP52A14 polynucleotide, CYP52A15 polynucleotide, CYP52A16 polynucleotide, CYP52A17 polynucleotide, CYP52A18 polynucleotide, CYP52A19 polynucleotide, CYP52A20 polynucleotide, CYP52D2 polynucleotide, BM3 polynucleotide) can contribute to an overall increase in carbon flux through native and/or engineered metabolic pathways, in some embodiments. In certain embodiments, adding a novel monooxygenase or increasing certain or all endogenous or heterologous monooxygenase activities can increase the flux of substrates of specific carbon chain length or subgroups of substrates with mixtures of specific carbon chain lengths. In some embodiments, the selection of a monooxygenase activity for amplification in an engineered strain is related to the feedstock utilized for growth of the engineered strain, pathways for metabolism of the chosen feedstock and the desire end product (e.g., dodecanedioic acid). Strains engineered to utilize plant-based oils for conversion to dodecanedioic acid can benefit by having one or more monooxygenase activities with substrate specificity that matches the fatty acid chain-length distribution of the oil. For example, the most prevalent fatty acid in coconut oil is lauric acid (12 carbons long), therefore, the monooxygenase activity chosen for a coconut oil-utilizing strain can have a substrate preference for C12 fatty acids. For strains engineered to utilize other plant based oils with different fatty acid chain-length distributions it may be desirable to amplify a monooxygenase activity that has a matching substrate preference. In some embodiments, a genetic modification that alters monooxygenase activity increases the activity of one or more monooxygenase activities with a substrate preference for feedstocks having carbon chain lengths of between about 12 and about 24 carbons (e.g., mixed chain length alkanes, mixed chain length fatty acids, soapstocks, the like and combinations thereof). In certain embodiments, the genetic modification increases the activity of a monooxygenase activity with a preference for fatty acids having a carbon chain-length distribution of between about 10 carbons and about 16 carbons.

As mentioned previously, the enzymes that carry out the monooxygenase activity are reduced by the activity of monooxygenase reductase, thereby regenerating the enzyme. Selection of a CPR for amplification in an engineered strain depends upon which P450 is amplified, in some embodiments. A particular CPR may interact preferentially with one or more monooxygenase activities, in some embodiments, but not well with other monooxygenases. A monooxygenase reductase from *Candida* strain ATCC750, two monooxygenase reductase activities from *Candida* strain ATCC20336 and a monooxygenase reductase activity from *Bacillus megaterium* are being evaluated for activity with the added and/or amplified monooxygenases described herein. Provided in the tables below are nucleotide sequences used to add or amplify monooxygenase and monooxygenase reductase activities.

Example 19: Amplification of Selected Beta Oxidation Activities

Described herein are methods of amplifying a POX5 beta oxidation activity. Substantially similar methods can be utilized to amplify different beta oxidation activities including non-PDX (e.g., acyl-CoA oxidase) activities and/or acyl-CoA oxidase activities with altered substrate specificities, as described herein.

Construction of POX5 Amplified Strains

Plasmid pAA166 ($P_{POX4}$POX5$T_{POX4}$)

A PCR product containing the nucleotide sequence of POX5 was amplified from *Candida* 20336 genomic DNA using primers oAA540 and oAA541. The PCR product was gel purified and ligated into pCR-Blunt II-TOPO (Invitrogen), transformed into competent TOP10 *E. coli* cells (Invitrogen) and clones containing PCR inserts were sequenced to confirm correct DNA sequence. One such plasmid was designated, pAA165. Plasmid pAA165 was digested with BspQI and a 2-kb fragment was isolated. Plasmid pAA073 which contained a POX4 promoter and POX4 terminator was also digested with BspQI and gel purified. The isolated fragments were ligated together to generate plasmid pAA166. Plasmid pAA166 contains a $P_{POX4}$POX5$T_{POX4}$ fragment.

Plasmid pAA204 (Thiolase Deletion Construct)

A PCR product containing the nucleotide sequence of a short-chain thiolase (e.g., acetyl-CoA acetyltransferase) was amplified from *Candida* 20336 genomic DNA using primers oAA640 and oAA641. The PCR product was gel purified and ligated into pCR-Blunt II-TOPO (Invitrogen), transformed into competent TOP10 *E. coli* cells (Invitrogen) and clones containing PCR inserts were sequenced to confirm correct DNA sequence. One such plasmid was designated, pAA184. A URA3 PCR product was amplified from pAA061 using primers oAA660 and oAA661. The PCR product was gel purified and ligated into pCR-Blunt II-TOPO (Invitrogen), transformed as described and clones containing PCR inserts were sequenced to confirm the correct DNA sequence. One such plasmid was designated pAA192. Plasmid pAA184 was digested with BglII/SalI and gel purified. Plasmid pAA192 was digested with BglII/SalI and a 1.5 kb fragment was gel purified. The isolate fragments were ligated together to generate pAA199. An alternative $P_{URA3}$ PCR product was amplified from plasmid pAA061 using primers oAA684 and oAA685. The PCR product was gel purified and ligated into pCR-Blunt II-TOPO (Invitrogen), transformed as described and clones containing PCR inserts were sequenced. One such plasmid was designated, pAA201. Plasmid pAA199 was digested with SalI and gel purified. Plasmid pAA201 was digested with SalI and a 0.43 kb $P_{URA3}$ was gel purified. The isolated fragments were ligated to generate plasmid pAA204 that contains a direct repeat of $P_{URA3}$.

Plasmid pAA221 ($P_{POX4}$POX5$T_{POX4}$ in Thiolase Deletion Construct)

A PCR product containing the nucleotide sequence of $P_{POX4}$POX5$T_{POX4}$ was amplified from plasmid pAA166 DNA using primers oAA728 and oAA729. The PCR product was gel purified and ligated into pCR-Blunt II-TOPO, transformed as described and clones containing PCR inserts were sequenced to confirm the sequence of the insert. One such plasmid was designated, pAA220. Plasmid pAA204 was digested with BglII, treated with shrimp alkaline phosphatase (SAP), and a 6.5 kb fragment was gel purified. Plasmid pAA220 was digested with BglII and a 2.7 kb fragment containing $P_{POX4}POX5T_{POX4}$ was gel purified. The isolated fragments were ligated to generate plasmid pAA221.

Strain sAA617 ($P_{POX4}POX5T_{POX4}$ in sAA451)

Strain sAA451 is a ura–, partially β-oxidation blocked strain (ura3/ura3 pox4a::ura3/pox4b::ura3 PDX5/PDX5). Plasmid pAA221 was digested with EcoRI to release a DNA fragment containing $P_{POX4}POX5T_{POX4}$ in a thiolase deletion construct. The DNA was column purified and transformed to strain sAA451 to plate on SCD-ura plate. After two days, colonies were streaked out on YPD plates, single colonies selected and again streaked out on YPD plates. Single colonies were selected from the second YPD plates and characterized by colony PCR. The insertion of $P_{POX4}POX5T_{POX4}$ in strain sAA451, disrupting the short-chain thiolase gene, was confirmed by PCR and one such strain was designated sAA617.

Strain sAA620

Strain sAA617 was grown overnight on YPD medium and plated on SCD+URA+5-FOA, to select for loop-out of URA3. Colonies were streaked out onto YPD plates twice as described for strain sAA617, and single colonies characterized by colony PCR. The loop-out of URA3 by direct repeats of PURA3 was confirmed by PCR. One such strain was designated sAA620. Strain sAA620 has one additional copy of POX5 under control of the POX4 promoter.

Plasmid pAA156

A PCR product containing the nucleotide sequence of CYP52A19 was amplified from Candida strain 20336 genomic DNA, using primers oAA525 and oAA526. The PCR product was gel purified and ligated into pCR-Blunt II-TOPO, transformed as described, and clones containing PCR inserts were sequenced to confirm correct DNA sequence. One such plasmid was designated, pAA144. Plasmid pAA144 was digested with BspQI and a 1.7-kb fragment was isolated. Plasmid pAA073, which includes a POX4 promoter and POX4 terminator, also was digested with BspQI and gel purified. The isolated fragments were ligated together to generate plasmid, pAA156. Plasmid pAA156 included $P_{POX4}CYP52A19T_{POX4}$ fragment and URA3.

Strain sAA496

Plasmid pAA156 was digested with ClaI and column purified. Strain sAA451 was transformed with this linearized DNA and plated on SCD-ura plate. Colonies were checked for CYP52A19 integration. Colonies positive for plasmid integration were further analyzed by qPCR to determine the number of copies of CYP52A19 integrated. One such strain, designated sAA496 contained about 13 copies of the monooxygenase activity encoded by CYP52A19.

Strains sAA632 and sAA635

Strain sAA620 was transformed with linearized pAA156 DNA and plated on SCD-ura plates. Several colonies were checked for CYP52A19 integration. Colonies positive for plasmid integration were further analyzed by qPCR to determine the number of copies of CYP52A19 integrated. One such strain, designated sAA632 contained about 27 copies of the monooxygenase activity encoded by CYP52A19. Another strain, designated sAA635, contained about 12 copies of the monooxygenase activity encoded by CYP52A19.

Example 20: Cloning of Candida ACH Genes

ACH PCR product was amplified from Candida strain ATCC20336 genomic DNA using primers oAA1095 and oAA1096, shown in TABLE 10. The PCR product was gel purified and ligated into pCR-Blunt II-TOPO (Invitrogen), transformed into competent TOP10 E. coli cells (Invitrogen) and clones containing PCR inserts were sequenced to confirm correct DNA sequence.

Sequence analysis of multiple transformants revealed the presence of allelic sequences for the ACH gene, which were designated ACHA and ACHB. A vector containing the DNA sequence for the ACHA allele was generated and designated pAA310. A vector containing the DNA sequence for the ACHB allele was generated and designated pAA311.

TABLE 15

| Primer | sequence |
|---|---|
| oAA1095 | CACACACCCGGGATGATCAGAACCGTCCGTTATCAAT |
| oAA1096 | CACACATCTAGACTCTCTTCTATTCTTAATTGCCGCTTCCACTAAACGGCAAAGTCTCCACG |

Example 21: Cloning of Candida FAT1 Gene

FAT1 PCR product was amplified from Candida 20336 genomic DNA using primers oAA1023 and oAA1024, shown in TABLE 11 below. The PCR product was gel purified and ligated into pCR-Blunt II-TOPO (Invitrogen), transformed into competent TOP10 E. coli cells (Invitrogen) and clones containing PCR inserts were sequenced to confirm correct DNA sequence. A vector containing the DNA sequence for the FAT1 gene was designated pAA296.

TABLE 16

| Primer | sequence |
|---|---|
| oAA1023 | GATATTATTCCACCTTCCCTTCATT |
| oAA1024 | CCGTTAAACAAAAATCAGTCTGTAAA |

Example 22: Cloning of Candida ARE1 and ARE2 Genes

ARE1 and ARE2 PCR products were amplified from Candida 20336 genomic DNA using primers oAA2006/oAA2007 and oAA1012/oAA1018, respectively, shown in TABLE 12 below. The PCR products were gel purified and ligated into pCR-Blunt II-TOPO (Invitrogen), transformed into competent TOP10 E. coli cells (Invitrogen) and clones containing PCR inserts were sequenced to confirm correct DNA sequence. A vector containing the DNA sequence for the ARE1 gene was designated pAA318. A vector containing the DNA sequence for the ARE2 gene was designated pAA301.

TABLE 17

| Primer | sequence |
|---|---|
| oAA1012 | ATGTCCGACGACGAGATAGCAGGAATAGTCAT |
| oAA1018 | TCAGAAGAGTAAATACAACGCACTAACCAAGCT |

TABLE 17-continued

| Primer | sequence |
|---|---|
| oAA2006 | ATGCTGAAGAGAAAGAGACAACTCGACAAG |
| oAA2007 | GTGGTTATCGGACTCTACATAATGTCAACG |

Example 23: Construction of an Optimized TESA Gene for Expression in Candida The gene sequence for the E. coli TESA gene was optimized for expression in Candida by codon replacement. A new TESA gene sequence was constructed using codons from Candida with similar usage frequency for each of the codons in the native E. coli TESA gene (avoiding the use of the CTG codon due to the alternative yeast nuclear genetic code utilized by Candida). The optimized TESA gene was synthesized with flanking BspQI restriction sites and provided in vector pIDTSMART-Kan (Integrated DNA Technologies). The vector was designated as pAA287. Plasmid pAA287 was cut with BspQI and the 555 bp DNA fragment was gel purified. Plasmid pAA073 also was cut with BspQI and the linear DNA fragment was gel purified. The two DNA fragments were ligated together to place the optimized TESA gene under the control of the Candida POX4 promoter. The resulting plasmid was designated pAA294.

Example 24: Cloning of Candida DGA I Gene

DGA1 PCR product was amplified from Candida 20336 genomic DNA using primers oAA996 and oAA997, shown in TABLE 13 below. The PCR product was gel purified and ligated into pCR-Blunt II-TOPO (Invitrogen), transformed into competent TOP10 E. coli cells (Invitrogen) and clones containing PCR inserts were sequenced to confirm correct DNA sequence. A vector containing the DNA sequence of the DGA1 gene was designated pAA299.

TABLE 18

| Primer | Sequence |
|---|---|
| oAA996 | ATGACTCAGGACTATAAAGACGATAGTCCTACGTCCACTGAGTTG |
| oAA997 | CTATTCTACAATGTTTAATTCAACATCACCGTAGCCAAACCT |

Example 25: Cloning of Candida LRO1 Gene

LRO1 PCR product was amplified from Candida 20336 genomic DNA using primers oAA998 and oAA999, shown in TABLE 14 below. The PCR product was gel purified and ligated into pCR-Blunt II-TOPO (Invitrogen), transformed into competent TOP10 E. coli cells (Invitrogen) and clones containing PCR inserts were sequenced to confirm correct DNA sequence. A vector containing the DNA sequence of the LRO1 gene was designated pAA300.

TABLE 19

| Primer | sequence |
|---|---|
| oAA998 | ATGTCGTCTTTAAAGAACAGAAAATC |
| oAA999 | TTATAAATTTATGGCCTCTACTATTTCT |

Example 26: Cloning of Candida ACS1 Gene and Construction of Deletion Cassette ACS1 PCR product was amplified from Candida 20336 genomic DNA using primers oAA951 and oAA952, shown in TABLE 15 below. The PCR product was gel purified and ligated into pCR-Blunt II-TOPO (Invitrogen), transformed into competent TOP10 E. coli cells (Invitrogen) and clones containing PCR inserts were sequenced to confirm the DNA sequence. One such plasmid was designated pAA275. Plasmid pAA280 was digested with BamHI to release a 2.0 kb $P_{URA3}URA3T_{URA3}P_{URA3}$ cassette. Plasmid pAA275 was digested with BglII and gel purified. The two pieces were ligated together to generate plasmid pAA276 and pAA282. Plasmid pAA276 and pAA282 have the $P_{URA3}URA3T_{URA3}P_{URA3}$ cassette inserted into the ACS gene in opposite orientations.

TABLE 20

| Primer | sequence |
|---|---|
| oAA951 | CCTACTTCCACAGCTTTAATCTACTATCAT |
| oAA952 | TTTAAGAAAACAACTAAGAGAAGCCAC |

Example 27: Construction of Strain sAA722 (pox4a::ura3/pox4b::ura3 POX5/POX5 ACS1/acs1::$P_{URA3}URA3T_{URA3}P_{URA3}$)

Plasmid pAA276 was digested with BamHI/XhoI and column purified. Strain sAA329 (ura3/ura3 pox4a::ura3/pox4b: ura3 POX5/POX5) was transformed with the linearized DNA and plated on SCD-ura plate. Several colonies were checked for ACS1 disruption. One such strain was designated sAA722.

Example 28: Construction of Strain sAA741 (pox4a::ura3/pox4b::ura3 POX5/PDX5 ACS1/acs1::$P_{URA3}$)

Strain sAA722 was grown in YPD media overnight and plated on 5-FOA plate. Colonies that grew in the presence of 5-FOA were PCR screened for the looping out of the URA3 gene leaving behind only the URA3 promoter ($P_{URA3}$) in the ACS1 site. Out of 30 colonies analyzed, only one strain showed the correct genetic modification. The strain was designated sAA741.

Example 29: Construction of Strain sAA776 (pox4a::ura3/pox4b::ura3 POX5/POX5 acs1::$P_{URA3}URA3T_{URA3}P_{URA3}$/acS1::$P_{URA3}$)

Plasmid pAA282 was digested with BamHI/XhoI and column purified. Strain sAA741 (see Example 28) was transformed with the linearized DNA and plated on SCD-ura plate. Several colonies were checked for double ACS1 knockout by insertional inactivation. One such strain was designated sAA776.

Example 30: Construction of Strain sAA779 (pox4a::ura3/pox4b::ura3 POX5/POX5 acs1::$P_{URA3}$/acs1::$P_{URA3}$)

Strain sAA776 (see Example 29) was grown in YPD media overnight and plated on 5-FOA plates. Colonies that grew in the presence of 5-FOA were PCR screened for the looping out of the URA3 gene leaving behind only the URA3 promoter ($P_{URA3}$) in both ACS1 copies. One such strain was designated sAA779.

Example 31: Construction of Strain sAA811 (pox4a::ura3/pox4b::ura3 POX5/POX5 acs1::$P_{URA3}$/ acs1::$P_{URA3}$ ura3::3x$P_{POX4}$P450A19)

Plasmid pAA156 containing a P450A19 integration cassette was digested with ClaI and column purified. Strain sAA779 (see Example 30) was transformed with the linearized DNA and plated on SCD-ura plate. Several colonies were checked for P450A19 integration. From those colonies, qPCR was performed to check the copy number of P450A19 integration. One strain, designated sAA811, contained 3 copies of P450A19.

Example 32: Construction of Strain sAA810 (pox4a::ura3;pox4b::ura3 POX5/POX5 acs1::$P_{URA3}$/ acs1::$P_{URA3}$ ura3::5x$P_{POX4}$P450A19 ura3:: 8x$P_{POX4}$TESA)

Plasmid pAA156 containing a P450-A19 integration cassette was digested with ClaI and column purified. Plasmid pAA294 containing a TESA integration cassette also was digested with ClaI and column purified. Strain sAA779 was cotransformed with both linearized DNAs and plated on SCD-ura plate. Several colonies were checked for both P450A19 integration and TESA integration. Colonies that were positive for both TESA and P450A19 were further analyzed by qPCR. qPCR was performed to check the copy number of the P450A19 and TESA integration events. One strain, designated sAA810, contained 5 copies of P450A19 and 8 copies of TESA.

Example 33. General Techniques & Methods

Growth Media, Reagents and Conditions

YPD, ScD-ura media and plates, and 5-FOA containing plates were made as described in Methods in Yeast Genetics: a Cold Spring Harbor Laboratory Manual/David C. Amberg, Daniel J. Burke, Jeffrey Strathern,—2005 ed.).

SP92+glycerol was made by adding 6.7 g of Bacto yeast nitrogen base without amino acids (BD, Franklin Lakes, N.J., USA), 3.0 g of Bacto yeast extract (BD, Franklin Lakes, N.J., USA), 3.0 g of ammonium sulfate, 1.0 g of potassium phosphate monobasic, 1.0 g of potassium phosphate dibasic, and 75 g of glycerol to water to a final volume of one liter. The media was then filtered sterilized.

TB-low N Media was made by adding 1.7 g Bacto yeast nitrogen base without ammonium sulfate, 3 g of Bacto yeast extract, 1 g of potassium phosphate monobasic and 1 g potassium phosphate dibasic per liter of water. The media was filtered sterilized.

Overnight cultures were typically grown in 2 to 5 ml of either ScD-ura media or YPD media in standard culture tubes at 30 C on a shaker at about 250 rpm.

Molecular Methods

Gel purifications of DNA fragments were done as recommended by the manufacturer using either the GeneJET Gel Extraction Kit (Fermentas Inc., Glen Burnie, Md. USA) or the Zymoclean Gel DNA Recovery Kit (ZymoResearch, Irvine, Calif.).

PCR was performed using either PFU Ultra II DNA Polymerase (Agilent Technologies, Santa Clara, Calif.), Taq DNA polymerase (New England Biolabs, Ipswich, Mass., USA), DreamTaq PCR Master Mix (Fermentas Inc, Glen Burnie, Md. USA) or Quick Load Midas Mix (Monserate, San Diego, Calif. USA). Each enzyme was used according to the manufacturer's instructions.

Restriction enzyme digestions were conducted as recommended by each manufacturer (New England Biolabs, Ipswich, Mass., USA or Fermentas Inc, Glen Burnie, Md. USA). DNA ligations were conducted using either the Rapid Ligation Kit (Fermentas Inc, Glen Burnie, Md. USA) or using T4 DNA Ligase (New England Biolabs, Ipswich, Mass., USA) according to the manufacturer's instructions.

Yeast transformations were performed as described in Example 10.

Genomic DNA Preparation

The URA3 gene was obtained from genomic DNA of *Candida* yeast culture ATCC20336.

Genomic DNA from *Candida* strain ATCC20336 was prepared as follows: About 1.5 ml of an overnight culture of cells was and the pellet was resuspended in about 200 µl of a solution containing 2% Triton X-100, 1% SDS, 100 mM NaCl, 10 MM Tris pH 8.0, and 1 mM EDTA. About 200 µl of acid washed glass beads were added with about 200 µl of phenol:chloroform:isoamyl alcohol (25:24:1) at a pH of about 8.0. The sample was vortexed for about 2 minutes after which about 200 µl of water was added. The sample was then centrifuged at 13000 rpm for about 10 minutes. The aqueous layer was transferred to a new microcentrifuge tube and an equal volume of chloroform:isoamyl alcohol (24:1) solution was added. This sample was vortexed for 10 seconds and then centrifuged at 13000 rpm for about 2 minutes. The aqueous layer was transferred to a new microfuge tube and 1 ml of ethanol was added. The tube was then placed at −80° C. for about 15 minutes and then spun at 13000 rpm for 15 minutes to pellet the DNA The DNA was washed with 70% ethanol and air-dried. The DNA was then resuspended in about 500 µl of water.

Genomic DNA for *Klyveromyces lactis* (ATCC8585) was purchased from the American Type Culture Collection (Manassas, Va., USA).

To calculate gene copy number, a qPCR method was used as described by Jin et al (Appl. Environ. Microbiol. January 2003 vol. 69, no. 1, 495-503). qPCR was performed according to the manufacturer's instructions using either the Brilliant III Ultra-Fast SYBR® Green QPCR Master Mix (Agilent Technologies, Englewood, Colo. USA) or the QuantiTect Multiplex PCR NoROX Kit (Qiagen). Genomic DNA from *Candida* strain ATCC20336 or plasmid DNA containing the actin gene from ATCC20336 and the gene of interest were used as standards.

Primers and probes used throughout these Examples were made via standard DNA synthesis techniques by Integrated DNA Technologies (Coralville, Iowa, USA).

Example 34: Construction of Cloning Plasmid AA073

The plasmid pAA073 was designed to contain the POX4 promoter and terminator from *Candida* strain ATCC20336 (this strain is also referred to herein as strain sAA001). This plasmid was derived from the publicly available plasmid pUC19 which contains an ampicillin resistance marker. pAA073 was designed to have two SapI restriction enzyme sites located between the POX4 promoter and terminator which allows unidirectional cloning of any gene of interest in tandem with the POX4 promoter. The *Candida* strain ATCC20336 URA3 gene including the open reading frame and the endogenous regulatory regions was also placed into pAA073 as a selection marker for transformants. Plasmid pAA073 allows the direct integration of multiple copies of any gene of interest by digesting the plasmid with a unique restriction enzyme such as SpeI, ClaI or BstZ17I. These multiple cloning sites for are contained in the URA3 auxotrophic marker region and can be selectively be used to avoid cutting the gene of interest (i.e., the DNA sequence for the gene of interest can be searched for particular restriction enzyme cut sites and those enzymes can be avoided). In addition, this plasmid can serve as a template to generate an antibiotic free-DNA cassette containing the gene of interest and the POX 4 regulatory regions inserted between the 3' and 5' regions of the URA3 gene; this cassette can be PCR amplified using the plasmid as a template, and the isolated PCR product can be inserted into any microorganism strain.

Figure 18:
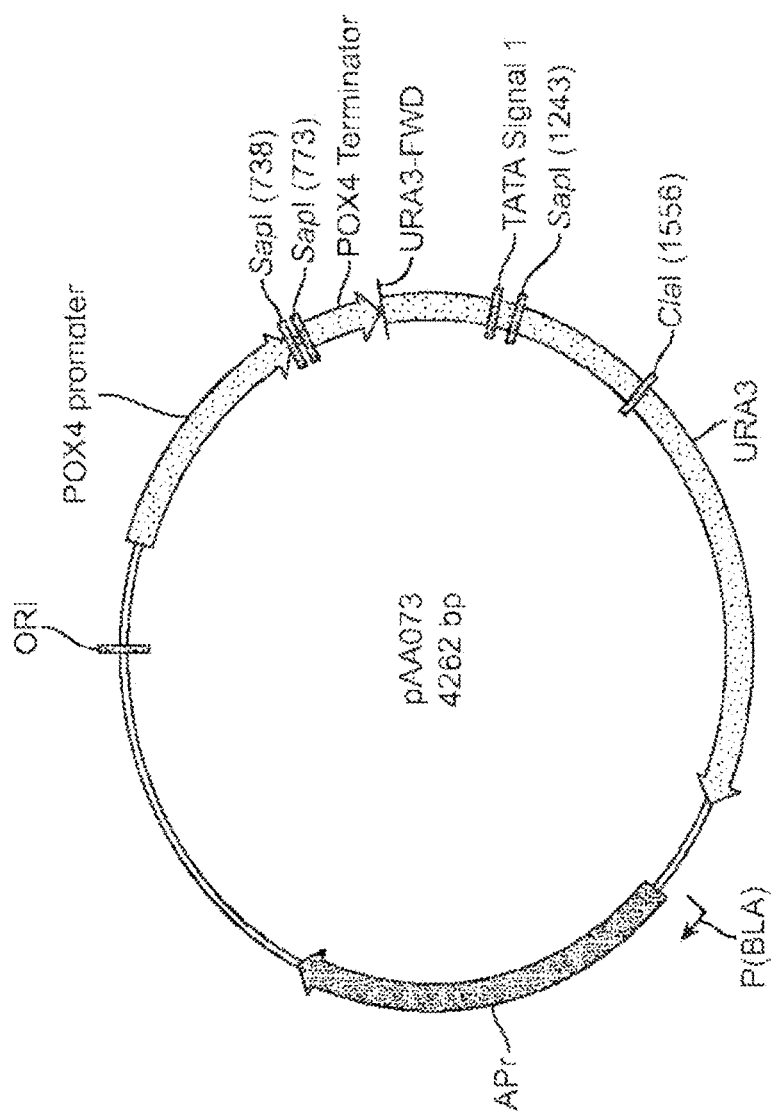
FIG. 18 shows a diagram of a plasmid designated pAA073 containing a POX4 promoter and a POX4 terminator.

A diagram of pAA073 is set forth in FIG. 18 and the sequence of pAA073 is set forth as SEQ ID NO. 3704.

Example 35. Cloning Enoyl-CoA Isomerase (ECI) Genes from ATCC 20336

The amino acid sequence for Eci1 (i.e. Eci) from *S. cerevisiae* S288c (SEQ ID NO. 3705) was used to identify homologs from *Candida* species ATCC MYA-3404 and ATCC20336. The BLAST search revealed two Eci1p homologs in each strain of *Candida*, which have been named Eci1p and Eci2p (TABLE 16). The percent amino acid identities for the homologs are shown below:

TABLE 21

| | Amino acid percent identity | | | | |
|---|---|---|---|---|---|
| | Eci2p_MYA-3404 SEQ ID NO. 3707 | Eci1p_MYA-3404 SEQ ID NO. 3706 | Eci1p_S.c. SEQ ID NO. 3705 | Eci2p_20336 SEQ ID NO. 3709 | Eci1p_20336 SEQ ID NO.3708 |
| Eci2p_MYA-3404 SEQ ID NO. 3707 | | 58 | 36 | 84 | 57 |
| Eci1p_MYA-3404 SEQ ID NO. 3706 | | | 39 | 57 | 92 |
| Eci1p_S.c. SEQ ID NO. 3705 | | | | 37 | 40 |
| Eci2p_20336 SEQ ID NO. 3709 | | | | | 57 |
| Eci1p_20336 SEQ ID NO. 3708 | | | | | |

The ECI1 gene encoding the N-terminal 241 residues of SEQ ID NO. 3708 was amplified from genomic DNA (ATCC 20336) using oligonucleotides oAA2835 (SEQ ID NO. 3712) and oAA2836 (SEQ ID NO. 3713) that also incorporated unique SapI restriction sites. The 770 bp PCR product was gel purified and ligated into pCR-Blunt II-TOPO (Life Technologies), transformed into competent TOP10 *E. coli* cells (Life Technologies) and clones containing PCR inserts were sequenced to confirm the correct DNA sequence. One such plasmid was named pAA574 (SEQ ID NO. 3710).

The full length ECI2 gene encoding Eci2p (SEQ ID NO. 3709) was amplified from genomic DNA (ATCC 20336) using oligonucleotides oAA2837 (SEQ ID NO. 3714) and oAA2838 (SEQ ID NO. 3715) that also incorporated unique SapI restriction sites. The 851 bp PCR product was gel purified and ligated into pCR-Blunt II-TOPO (Life Technologies), transformed into competent TOP10 *E. coli* cells (Life Technologies) and clones containing PCR inserts were sequenced to confirm the correct DNA sequence. One such plasmid was named pAA575 (SEQ ID NO. 3711).

Example 36—Generation of Strain sAA1764 (ura3/ura3 pox4a::ura3/pox4b::ura3 POX5/POX5 acs1::PURA3/acs1::PURA3 fat1-Δ1::PURA3/fat1-Δ2::PURA3 eci1-Δ1::URA3/ECI1)

Figure 19:
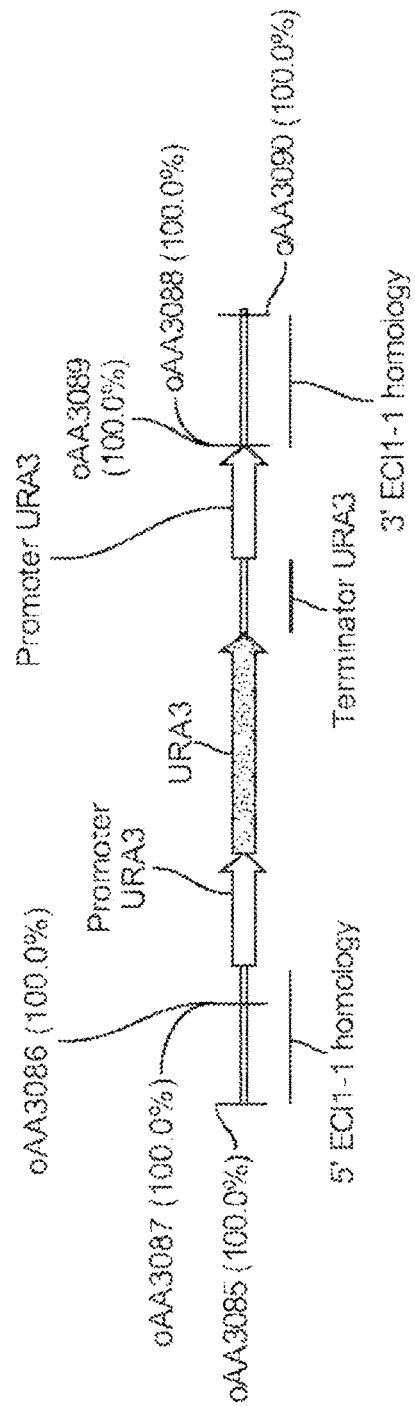
FIG. 19 illustrates the generation of a full-length deletion cassette for ECI1 using PCR overlap extension.
Figure 29:
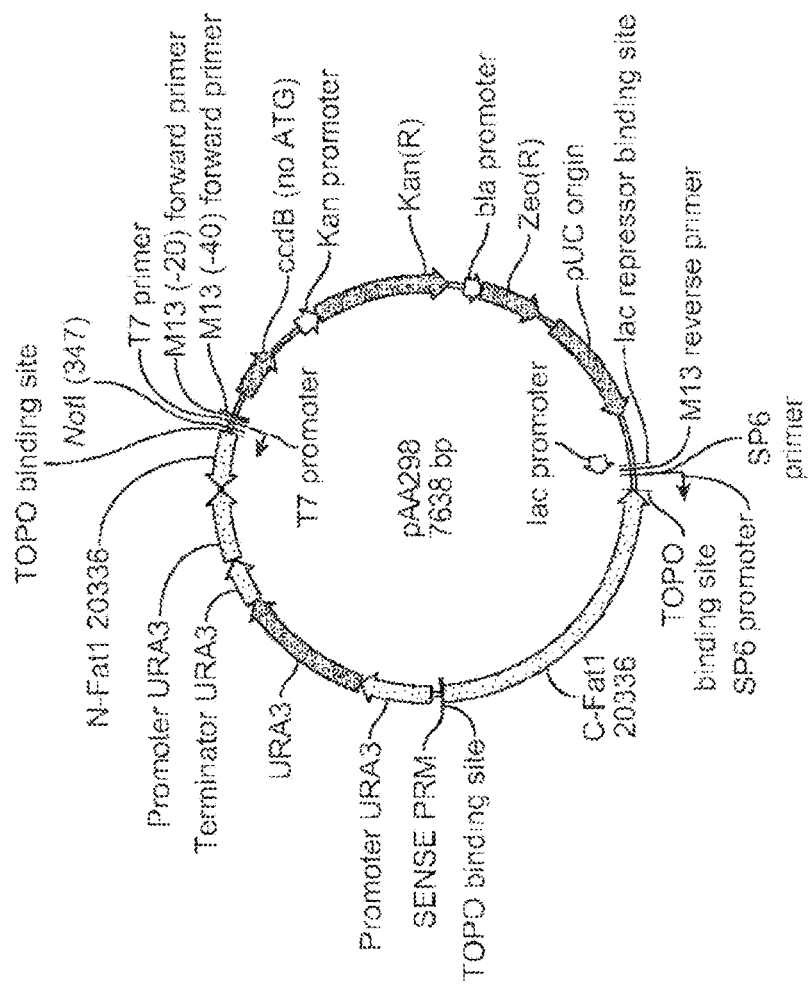
FIG. 29 shows a diagram of a plasmid designated pAA298.

Deletion of the first allele of ECI1 was achieved by transforming cells (strain sAA886 (pox4a::ura3/pox4b::ura3 POX5/POX5 acs1::*PURA3*/acs1::PURA3 fat1-Δ1::PURA3/fat1-Δ2::PURA3 ura3/ura3)) with linear DNA cassettes constructed by overlap extension PCR (OE-PCR). A deletion cassette for the first ECI1 allele in strain sAA886 was generated from three DNA fragments. A first DNA fragment (ECI1 5' homology) was amplified from ATCC20336 gDNA using primers oAA3085 (SEQ ID NO. 3716) and oAA3086 (SEQ ID NO. 3717). A second DNA fragment (PURA3URA3TURA3PURA3) was amplified from plasmid pAA298 (FIG. 29, and SEQ ID NO: 3784) using primers oAA3087 (SEQ ID NO. 3718) and oAA3088 (SEQ ID NO. 3719). The third DNA fragment (ECI1 3' homology) was amplified from ATCC20336 gDNA using primers oAA3089 (SEQ ID NO. 3720) and oAA3090 (SEQ ID NO. 3721). All three DNA fragments were combined in the same reaction to generate the full-length deletion cassette (FIG. 19) by OE-PCR using primers oAA3085 (SEQ ID NO. 3716) and oAA3090 (SEQ ID NO. 3721).

Strain sAA886 was transformed with the full-length deletion cassette and plated on SCD-Ura plate. Several colonies were screened by PCR for integration of the deletion cassette at the first ECI1 allele. One such strain was named sAA1764.

Example 37. Generation of Strain sAA1860 (ura3/ura3 pox4a::ura3/pox4b::ura3 POX5/POX5 acs1::PURA3/acs1::PURA3 fat1-Δ1::PURA3/fat1-Δ2::PURA3 eci1-Δ1::PURA3/ECI1)

Strain sAA1764 was grown in YPD media overnight and plated on 5-FOA plate. Colonies that grew in the presence of 5-FOA were PCR screened for the looping out of the URA3 gene leaving behind only the URA3 promoter (PURA3) in the first ECI1 allele. One such strain was named sAA1860.

Example 38. Construction of a Double ECI1 Knockout Strain (Ura3/Ura3 pox4a::ura3/pox4b::ura3 POX5/POX5 acs1::PURA3/acs1::PURA3 fat1-Δ1::PURA3,fat1-Δ2::PURA3 eci1-Δ1::PURA3/eci1-42::URA3)

Figure 20:
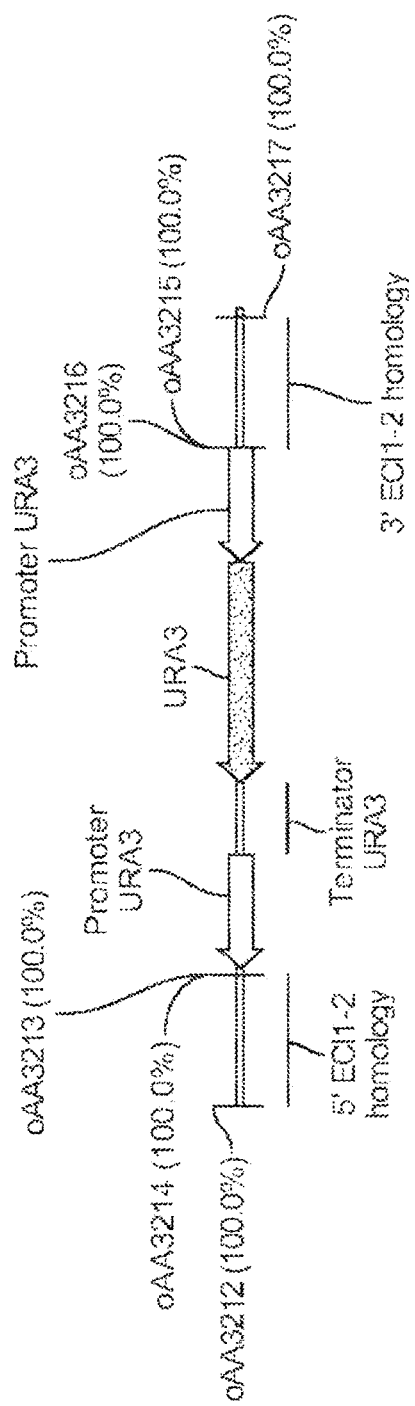
FIG. 20 illustrates the generation of a full-length deletion cassette for the second allele of ECI1 using PCR overlap extension.

Deletion of the second allele of ECI1 is achieved by transforming cells with linear DNA cassettes constructed by overlap extension PCR (OE-PCR). A deletion cassette for the second ECI1 allele in sAA1860 (ura3/ura3 pox4a::ura3/pox4b::ura3 POX5/POX5 acs1::PURA3/acs1::PURA3 fat1-Δ1::PURA3/fat1-Δ2::PURA3 eci1-Δ1::PURA3/ECI1) was generated from three DNA fragments. A first DNA fragment (ECI1 5' homology) was amplified from ATCC20336 gDNA using primers oAA3212 (SEQ ID NO. 3722) and oAA3213 (SEQ ID NO. 3723). A second DNA fragment (PURA3URA3TURA3PURA3) was amplified from plasmid pAA298 (FIG. 29, and SEQ ID NO: 3784) using primers oAA3214 (SEQ ID NO. 3724) and oAA3215 (SEQ ID NO. 3725). A third DNA fragment (ECI1 3' homology) was amplified from ATCC20336 gDNA using primers oAA3216 (SEQ ID NO. 3726) and oAA3217 (SEQ ID NO. 3727). All three DNA fragments were combined in the same reaction to generate the full-length deletion cassette (FIG. 20) by OE-PCR using primers oAA3212 (SEQ ID NO. 3722) and oAA3217 (SEQ ID NO. 3727).

To generate a double ECI1 knockout strain, sAA1860 is transformed with the full-length deletion cassette and plated on SCD-Ura plate. Several colonies are screened by PCR for integration of the deletion cassette at the second ECI1 allele.

Example 39—Cloning of Acyl CoA Oxidase Proteins

Acyl-CoA oxidases from a range of organisms were cloned into the *E. coli* expression vector pET26b (EMD4Biosciences, Darmstadt, Germany), which contains a kanamycin resistance cassette. The source of the acyl-CoA oxidase, the name of the gene, the primers and restriction enzymes used to clone the acyl CoA oxidase coding sequence into pET26b and the coding sequence are described herein. The acyl CoA oxidase coding sequences were amplified by PCR using the appropriate primers designed from cDNA libraries, published cDNA or genomic DNA sequences corresponding to the organism. In the event that a template source was not available, the coding sequences were synthesized as gBlocks (IDT) and stitched together by standard overlap extension PCR. The PCR products were then cloned into pCRII-Blunt TOPO vector (Life Sciences) and the products were sequenced to verify that they did not contain undesired mutations. The coding sequences were released from the TOPO vector using the appropriate restriction enzymes and ligated into pET26b that had been digested with the same restriction enzymes. The resulting expression plasmids were then transformed into Rosetta II BL21 cells (Novagen).

Example 40—Expression of Acyl-CoA Oxidases in *E. coli*

To express an enzyme, a colony from each transformation of Rosetta cells was used to start a 5 ml overnight culture of LB containing the antibiotics kanamycin (to select for pET26b) and chloramphenicol (to select for a second plasmid found in Rosetta II cells that mediates improved translation of eukaryotic proteins expressed in *E. coli*) grown at 37° C. The next morning, the overnight culture was used to seed 30 ml of LB containing kanamycin and chloramphenicol to an $OD_{600}$ reading of 0.1. The 30 ml cultures were grown at 37° C. for 2 hours and then placed on ice for 10 minutes. To induce expression, isopropyl-beta-D-thiogalactopyranoside (IPTG) was added to the culture to a final concentration of 0.1 mM. In some cases induction was performed using Novagen Overnight Express Autoinduction System 1 (CAT#71300-3), The cells were then shaken at 15° C. overnight to express the acyl CoA. oxidase.

Example 41—Acyl-CoA Oxidase Activity Assay

To test the activity of the acyl CoA oxidase, cells from the overnight induction were pelleted at 1046×g at 4° C. in 50 ml conical tubes. The cell pellets were resuspended in 1 ml of 50 mM $KPO_4$, pH 7.6, 50 µM FAD buffer and then transferred to a 2 ml centrifuge tube. A Misonix Sonicator 3000 (QSonica, Newtown, Conn.) was used to lyse the cells, which were sonicated at a power setting of 2 for 2 pulses of 20 seconds each. The lysates were placed on ice for 30 seconds in between each pulse. To obtain a supernatant, cell debris was pelleted at 16,100×g for 10 mins in a 4° C. microcentrifuge. The supernatant was transferred to a 1.5 ml centrifuge tube and Bradford assays (Thermoscientific) were performed on cell lysates according to manufacturer's specifications to determine protein concentration in preparation for the acyl-CoA oxidase assays. A Beckman Coulter DTX-800 Multimode Detector spectrophotometer was used for the assays. The spectrophotometer was set to read for 5 minutes at 500 nm, 30° C. Each reaction was 200 µl in volume and contained 10 µg of cell lysate in 50 mM $KPO_4$, pH 7.6, 200 µg/ml BSA, 0.05% Triton X-100, 250 µM fatty acyl-CoA substrate, 50 µM FAD, IOU horseradish peroxidase, 25 mM p-hydroxybenzoic acid and 1 mM 4-aminoantipyrine. Fatty acyl-CoA substrates covered a range from hexanoyl CoA (six carbon chain length) to oleoyl CoA (eighteen carbon chain length).

In FIG. 41 unshaded blocks indicated the sample was not tested. Dark shading indicates that no activity was detected. Light shading indicates that minimal activity (i.e. poor activity) was detected at less than or equal to 0.1 umol/min/ug (umol substrate/minute/ug total protein). Medium shading indicates that good activity was detected at >0.1 umol/min/ug.

The results in FIG. 41 indicated that several enzymes are not functional when expressed in *E. coli*. Furthermore, the remaining enzymes that are functional when expressed in *E. coli* showed broad substrate specificity or were similar in their substrate specificity to Pox5 from *Candida* strain ATCC20336 (i.e. not very active on a C6 substrate, show peak activity on a C12 substrate and are active from C8 all the way to C18:1).

Example 42—Genetic Modification of *Candida* Pox4, Pox5 and *R. norvegicus* VLCAD The objective was to design mutations in 1) the Pox4 and Pox5 acyl CoA oxidases of *Candida* strain ATCC20336 (Pox4 and Pox5, respectively) to alter their respective substrate specificities and 2) the *R. norvegicus* very long chain acyl-CoA dehydrogenase (VLCAD) to convert it into an acyl CoA oxidase. When introduced into *Candida*, these mutant enzymes may mediate selective conversion of fatty acid substrates to sebacic, dodecanedioic acid or longer chain diacids by beta oxidation.

Site-Directed Mutagenesis of Pox4 and Pox5-Methodology

Figure 23:
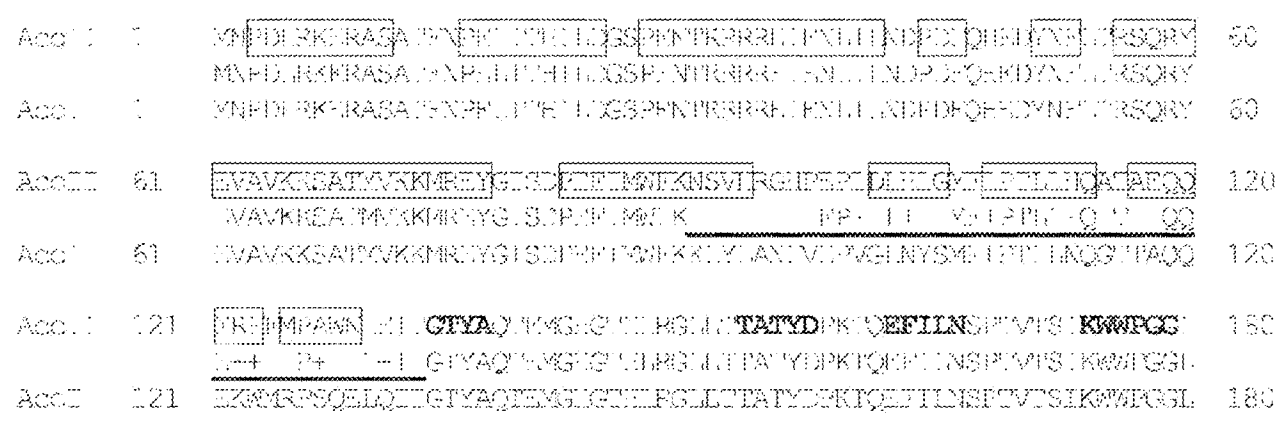

Several approaches were used to identify regions and/or residues of Pox4 and Pox5 of *Candida* strain ATCC20336 that determine the substrate specificities of these enzymes. In rat liver, a single gene with an alternatively spliced third exon produces two splice forms, AcoI (acyl CoA oxidase-I, *R. norvegicus*, RnAcoI) and AcoII (acyl CoA oxidase-II, *R. norvegicus*, RnAcoII), which are identical in amino acid length and differ in amino acid sequence only at the region encoded by the differentially spliced exon (Miyazawa, S., Hayashi, H., Hijikata, M., Ishii, N., Furuta, S., Kagamiyama, H., Osumi, T., Hashimoto, T. (1987) *Complete nucleotide sequence of cDNA and predicted amino acid sequence of rat acyl-CoA oxidase*. J. Biol. Chem. 262(17):8138-43; Osumi, T., Ishii, N., Miyazawa, S., Hashimoto, T. (1987) *Isolation* and structural characterization of the rat acyl-CoA oxidase gene. J. Biol. Chem. 262 (17):8138-43; Setoyama, C., Tamaoki, H., Nishina, Y., Shiga, K., Miura, R. (1995) *Functional expression of two forms of rat acyl-CoA oxidase and their substrate specificities*. Biochem. Biophys. Res. Commun. 217(2):482-7). A comparison of the primary amino acid sequences of AcoI and Awn revealed differences in residues 90 to 133 as a result of the alternatively spliced exon (underlined residues, FIG. 23). The splicing event resulted in two enzymes, AcoI and AcoII, that display different substrate activity profiles. RnAcoI prefers substrates with few carbons (e.g., fatty acids with 8 or 10 carbons). RnAcoII prefers substrates with longer carbon chains (e.g., 14 carbons). The crystal structure of RnAcoII has been solved (PDB: 1IS2 (without substrate); PDB: 2DDH (with dodecanoate substrate)) and the region encoded by the alternatively spliced exon ends at the boundary between the N-terminal alpha helical domain and the subsequent beta sheet domain, both of which are characteristic structural features of acyl CoA oxidases (Acyl-CoA dehydrogenase (ACAD) superfamily, NCBI Conserved Domains Accession c10993) and have been identified as a region that may determine substrate specificity.

Figure 25:
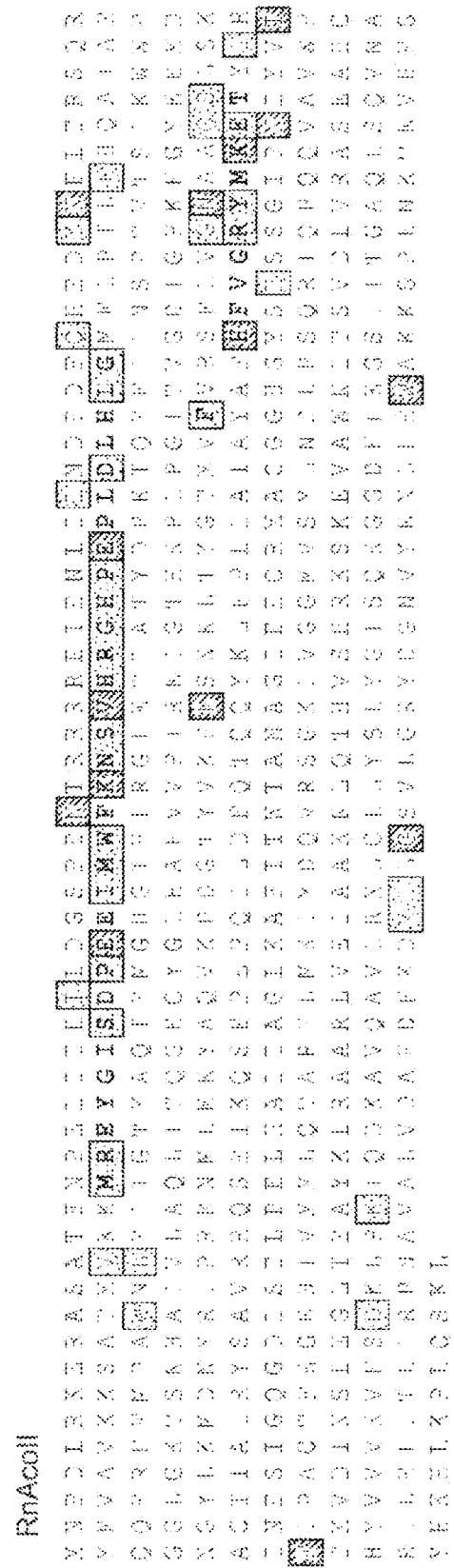
FIG. 25—illustrates a HotSpot Wizard analysis of RnAcoII (SEQ ID NO: 4079). Residues highlighted in dark grey or light grey are mutagenic "hot spots". Dark grey residues show greater variability at that position than light grey residues. Residues in bold are found within or close to the substrate binding pocket.

To verify that this region of an acyl CoA oxidase plays a role in determining substrate specificity, the HotSpot Wizard algorithm was utilized (Pavelka, A., Chovancova, E., Damborsky, J. HotSpot Wizard: a Web Server for Identification of Hot Spots in Protein Engineering, Nucleic Acids Research 37: W376-W383, 2009. http://loschmidt.chemi.muni.cz/hotspotwizard/). HotSpot Wizard is a program that identifies regions of a protein for engineering of substrate specificity or activity. The program utilizes structural, functional and sequence homology data from numerous databases, such as PDB, UniProt and NCBI, to identify regions and/or residues that are "hot spots" for mutagenesis. The search relies on a PDB file corresponding to a crystal structure of the enzyme of interest. In the case of Pox4 or Pox5, no such structure was available. Therefore, the structures of both proteins were determined by modeling with the crystal structure of *R. norvegicus* AcoII as the template (PDB:1IS2). The SWISS-MODEL program was used to generate these models (Arnold K., Bordoli L., Kopp J., and Schwede T. (2006). *The SWISS-MODEL Workspace: A web-based environment for protein structure homology modeling*. Bioinformatics, 22, 195-201; Kiefer F, Arnold K, Künzli M, Bordoli L, Schwede T (2009) The SWISS-MODEL Repository and associated resources. Nucleic Acids Research. 37, D387-D392. Peitsch, M. C. (1995) Protein modeling by E-mail Bio/Technology 13: 658-660; http://swissmodel.expasy.org/). The resulting models, which were PDB files, were entered in HotSpot Wizard as the "Query structure". The results of a HotSpot Wizard analysis are summarized in FIGS. 24A, 24B and 25). Residues highlighted in grey are proposed mutagenic "hot spots". Dark grey shading indicates residues with greater variability than those with light grey shading. Residues shown in bold are found within or close to the substrate binding pocket (discussed below).

Figure 26:
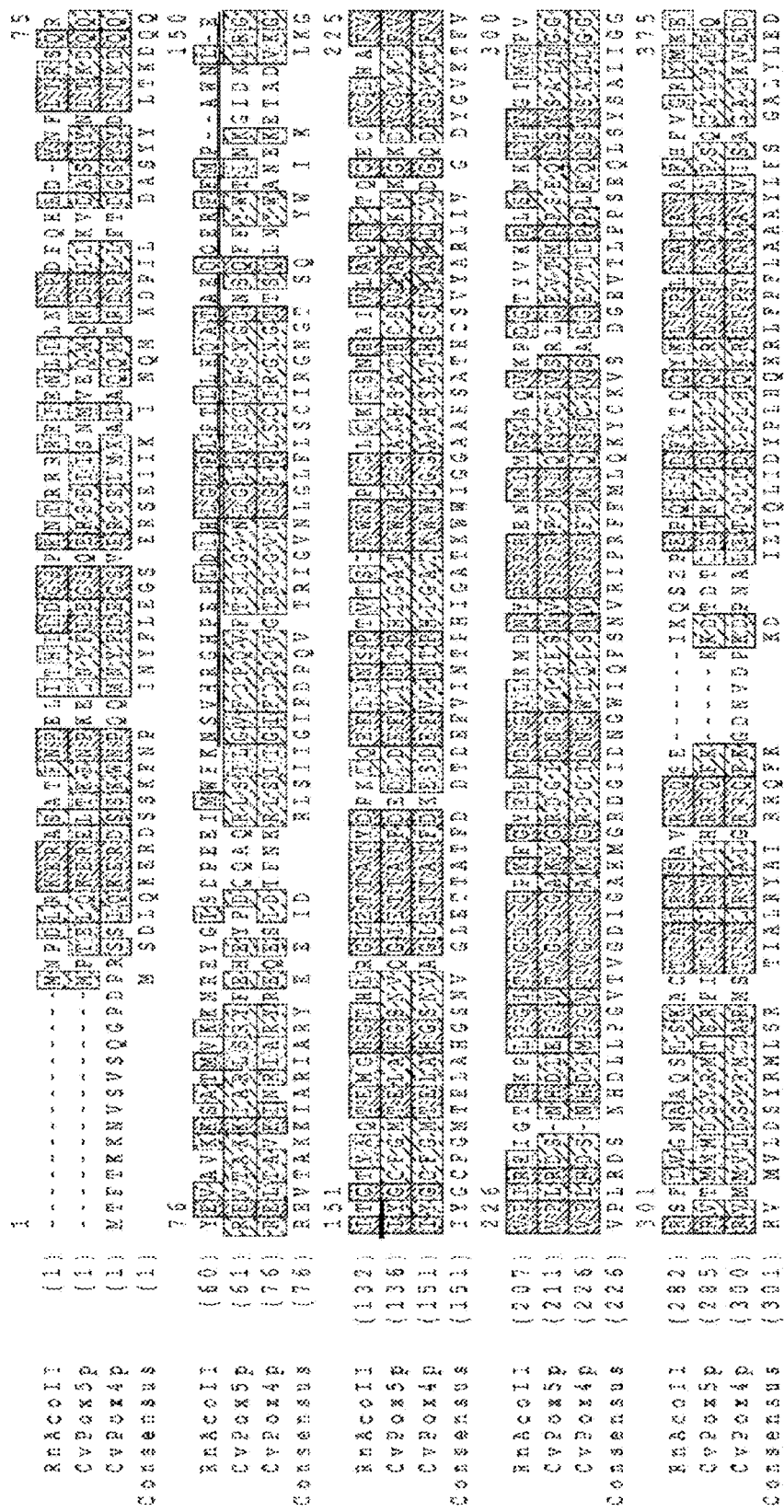
FIG. 26 shows a multiple sequence alignment of all three proteins (SEQ ID NOS 4079, 4077, and 4078, respectively, in order of appearance). The underlined portion of RnAcoII (AcoII from *R. norvegicus*) represents the alternatively spliced exon 3.
Figure 26:
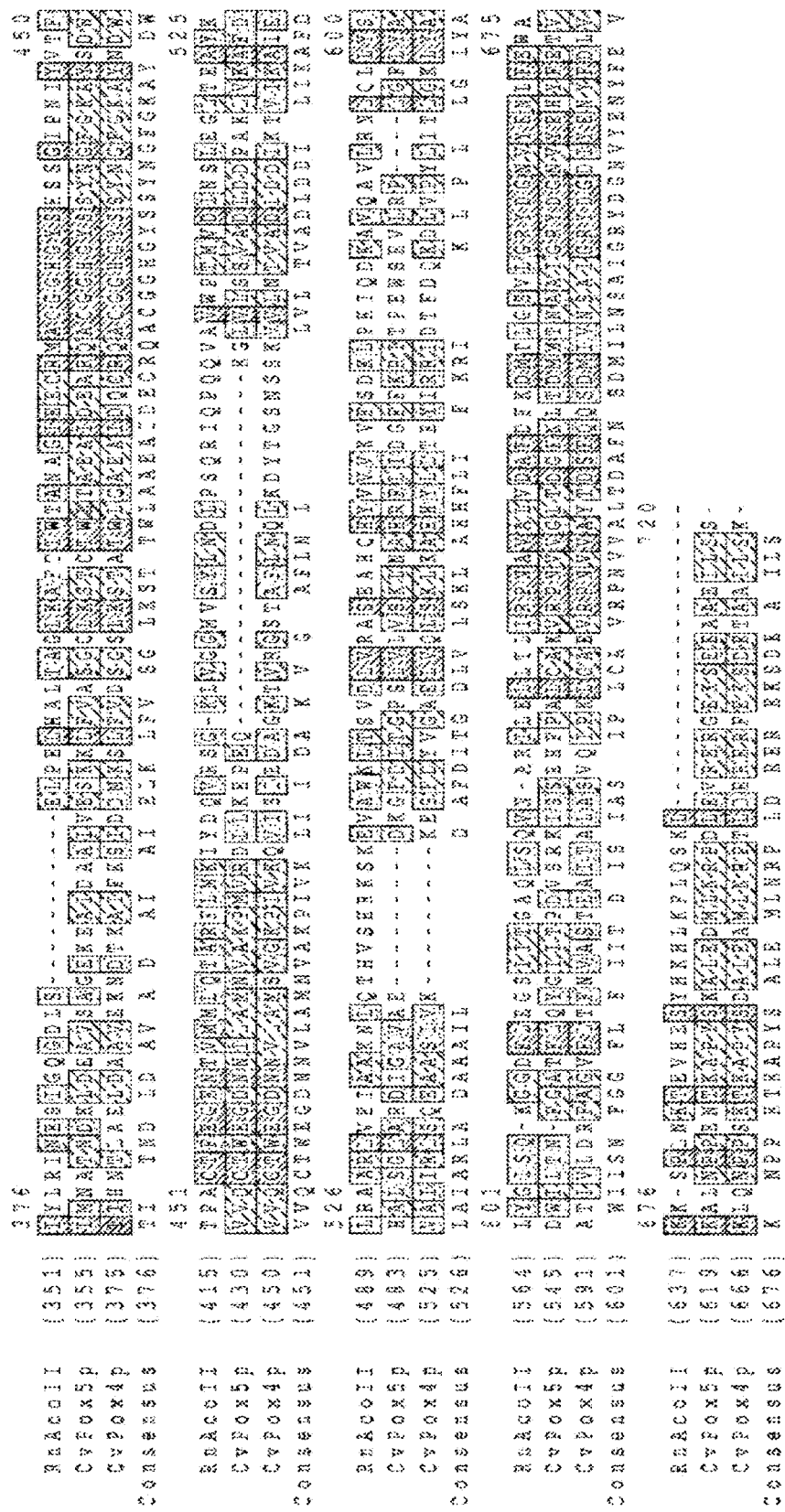

All three enzymes were aligned to show areas of homology (FIG. 26). In FIG. 26 light grey shading indicates identity between all three enzymes. Darker shades of grey indicate partial identity or homology between the three enzymes (e.g., a dark grey shading may indicate identity for two of the three proteins in the alignment). In some cases, dark grey shading indicates sequence similarity (i.e., the residues are similar because they are acidic, basic, polar or non-polar). The underlined region (FIG. 23 and FIG. 26) indicates the alternatively spliced exon of AcoII.

Figures 24A, 24B:
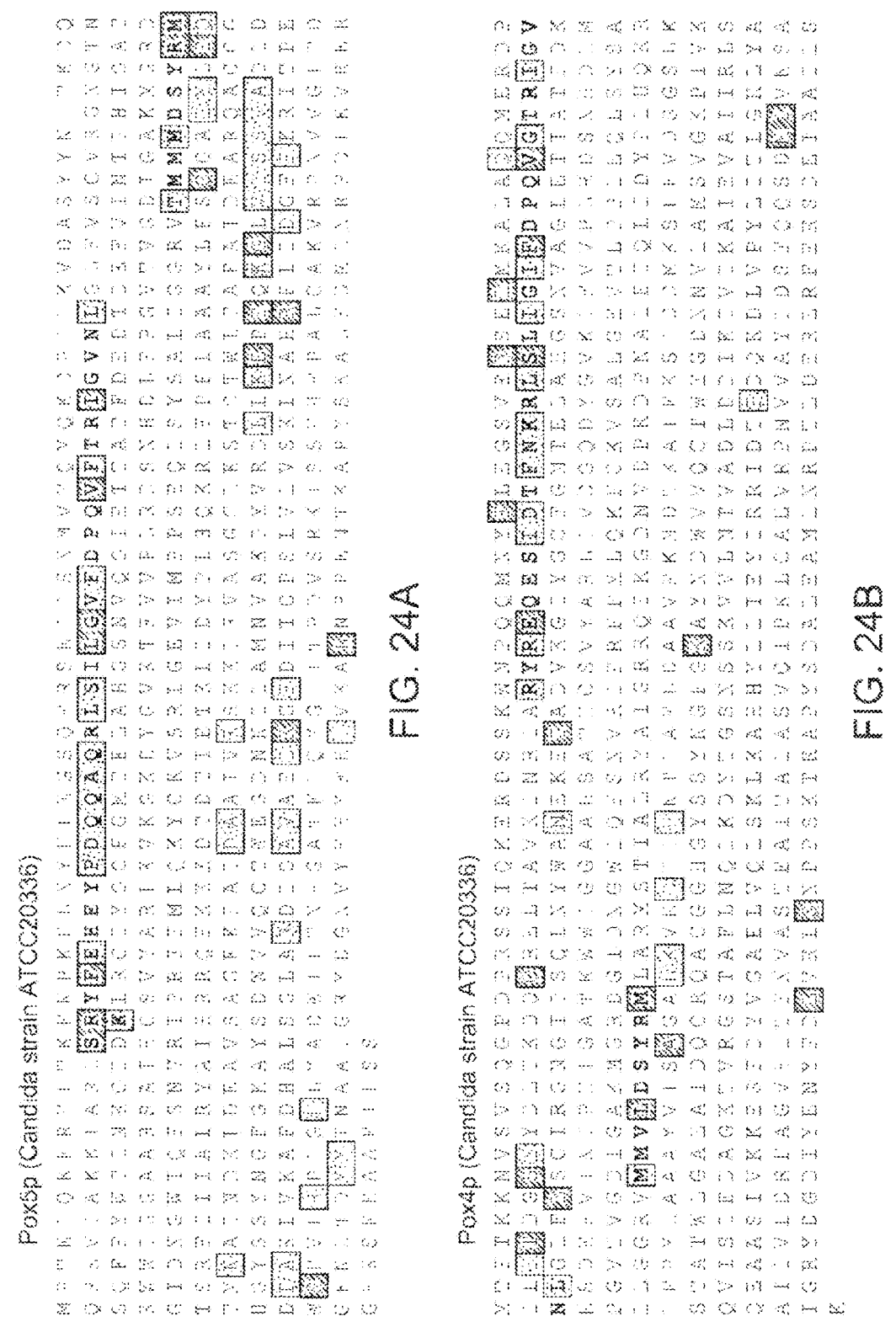

Molecular modeling alignments were used to identify residues in Pox4 and Pox5 that are found within or close to the substrate binding pocket (residues shown in bold, FIGS. 24A and 24B). The molecular structure of AcoII complexed with its substrate dodecanoate (PDB:2DDH) as determined from its crystal structure, was aligned with the predicted molecular models of Pox4 and Pox5. Residues located in the N-terminal loop and first part of alpha helix D (TABLE 17) appear at the surface and lining of the substrate entry/exit channel. In Pox4 these residues correspond to the sequence IDTFNK (SEQ ID NO: 3882) (a.a. 95-100 of Pox4 from *Candida* strain ATCC20336) and PDQQAQ (SEQ ID NO: 3883) (a.a. 80-85 of Pox5 from *Candida* strain ATCC20336). According to HotSpot Wizard this entire sequence is category 9, which means highly variable.

TABLE 23

| N-terminal loop and first part of alpha helix D | | |
|---|---|---|
| Protein | Sequence | Residue(s) |
| 1IS2 (ACOII) | ISDPEE | 79-84 |
| ACOI | ISDPEE | 79-84 |
| Pox4 | IDTFNK | 95-100 |
| Pox5 | PDQQAQ | 80-85 |

Residues located in the loop between alpha helices D and E' form part of the substrate binding pocket. None of these residues were identified as contact residues for the 12 carbon substrate but may be contact residues for longer substrates. This stretch of four amino acids is located within the divergent exon splice site of ACO-I and ACO-II. In Pox4 and Pox5, three of these amino acids are highly conserved (TABLE 18). The fourth amino acid is different (113G in Pox4 & F98 in Pox5). Of the four amino acids in this region, the divergent residue is closest to the substrate and the amino acid character of this residue is drastically different between Pox4 and Pox5. For this reason, this residue is of particular interest. Additionally, according to HotSpot this residue is highly variable.

TABLE 24

| Loop between alpha helices D and E' | | |
|---|---|---|
| Protein | Sequence | Residue(s) |
| 1IS2 (ACOII) | RGHP | 94-97 |
| ACOI | ANFV | 94-97 |
| Pox4 | PQVG | 110-113 |
| Pox5 | PQVF | 95-98 |

The residue D101 is a contact residue for the substrate carbons 6 through 9 in the 2DDH crystal structure of RnACOII. This residue is located at the beginning of alpha helix E' which is part of the substrate binding pocket. Since this is a contact residue and is located in the small region of sequence that differs between ACO-I and ACO-II, the corresponding amino acid in Pox4 and Pox5 (TABLE 19) is of interest. This residue is of interest since it contacts the substrate at carbons 6-9 and ACO-II has lower activity on substrates of chain-length 6-12 compared to ACO-I. If either Pox4 or Pox5 is modified at this position to aspartate, it is expected that there would be a decrease in activity on adipic acid and lead to increases in yield of larger diacids. This residue has a score of 6 from HotSpot.

TABLE 25

Residue making contact with substrate carbons 6-9

| Protein | Sequence | Residue(s) |
|---|---|---|
| 1IS2 (ACOII) | D | 101 |
| ACOI | G | 101 |
| Pox4 | G | 117 |
| Pox5 | G | 102 |

Residue F284 is a contact residue for the substrate carbons 10 through 12 in the 2DDH crystal structure of RnACOII. This residue is conserved between RnAcoI and RnAcoII. The corresponding amino acid in Pox4 and Pox5 (TABLE 20) is one of the very few substrate contact residues that differ between Pox4 and Pox5. The ACOI, ACOII, and Pox4 enzymes all have a large hydrophobic residue at this location whereas the Pox5 enzyme has a small polar residue. The HotSpot score for this residue is 9.

TABLE 26

Residue making contact with substrate carbons 10-12

| Protein | Sequence | Residue(s) |
|---|---|---|
| 1IS2 (ACOII) | F | 284 |
| ACOI | F | 284 |
| Pox4 | M | 302 |
| Pox5 | T | 287 |

The loop C-terminal to alpha helix L is much smaller in Pox5 than it is in Pox4 or ACO-I/ACO-II (TABLE 21). This loop appears to display structural flexibility and may have implications for the structure of the substrate pocket and how much the substrate-binding pocket "breathes". The residues in this region vary in HotSpot analysis, however the residues just downstream of this region in Pox5 are all highly variable (shown next).

TABLE 27

Alpha helix L and loop C-terminal to alpha helix L

| Protein | Sequence | Residue(s) |
|---|---|---|
| 1IS2 (ACOII) | IYDQVRSGKLVGGMVSYLNDLPSQRIQPQQVA | 438-469 |
| ACOI | IYDQVRSGKLVGGMVSYLNDLPSQRIQPQQVA | 438-469 |
| Pox4 | QVISIEDAGKTVRGSTAFLNQLKDYTGSNSSKV | 473-505 |
| Pox5 | DLLKEPEQKGL | 453-463 |

The loop between alpha helix L and M does not appear to be as variable between Pox4 and Pox5 (TABLE 22), although HotSpot analysis assigns this stretch of residues with scores of 9 with high variability. It is expected that this loop, including the previous section mentioned above, is a target for mutagenesis.

TABLE 28

Loop between a-helix L and M

| Protein | Sequence | Residue(s) |
|---|---|---|
| 1IS2 (ACOII) | VWPTMV | 470-475 |
| ACOI | VWPTMV | 470-475 |
| Pox4 | VLNTVA | 506-511 |
| Pox5 | VLSSVA | 464-469 |

For both Pox4 and Pox5, the HotSpot Wizard analyses, combined with molecular modeling alignments, determined that residues within the same approximate regions are good targets for mutagenesis. The multiple sequence alignment shows that the alternatively spliced exon of AcoII overlaps with hot spot residues in all three acyl CoA oxidases (FIG. 26).

Some additional regions in RnACoII, indicated by their secondary structure and position of amino acid residues, are shown in TABLE 23 and corresponding regions in POX5, POX4 and Aco2, Aco3 and Aco5 of *Yarrowia lipolytica* are also shown.

TABLE 29

RnAcoII (1IS2 or 2DDH)

| Secondary Structure | aa residues | Corresponding residues in aox enzymes | | | | |
|---|---|---|---|---|---|---|
| | | POX5 | YlAco2 | POX4 | YlAco3 | YlAco5 |
| Helices 1-6 | 1-76 | 1-77 | 1-97 | 1-92 | 1-98 | 1-96 |
| Helices 7-10 | 82-129 | 83-133 | 103-152 | 98-148 | 104-153 | 102-151 |
| β-sheet domain | 134-268 | 138-271 | 157-291 | 153-286 | 158-292 | 156-290 |
| Helical domain 3 | 278-460 | 281-462 | 301-492 | 296-500 | 302-493 | 300-494 |
| Helical domain 4 | 475-655 | 469-637 | 502-683 | 511-684 | 502-682 | 503-682 |

Figure 27:
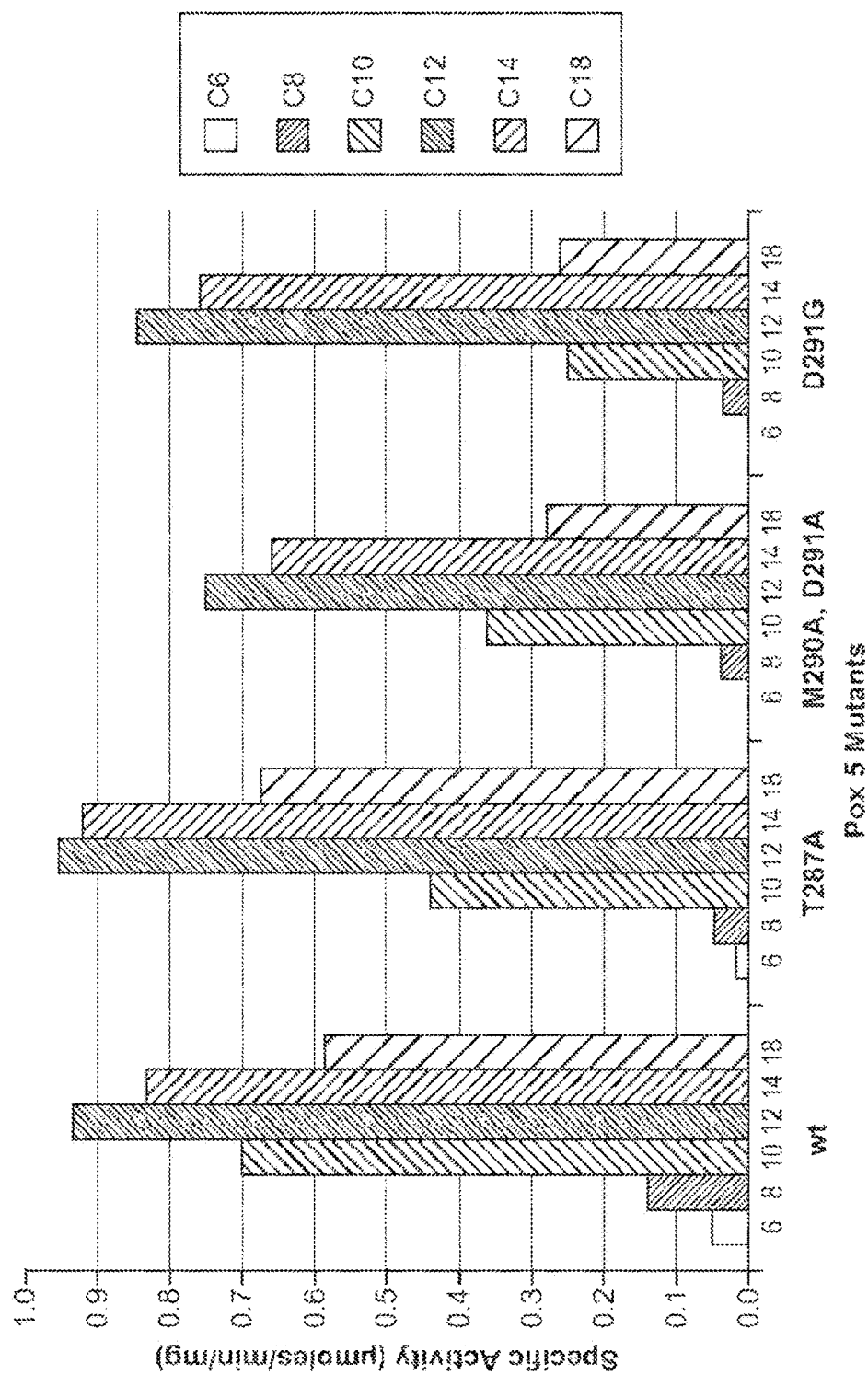
FIG. 27 shows the acyl CoA activity profile associated with Pox5 mutants. The substrate referred to as "C18" is shortened and pertains to a C18:1 substrate.
Figure 28:
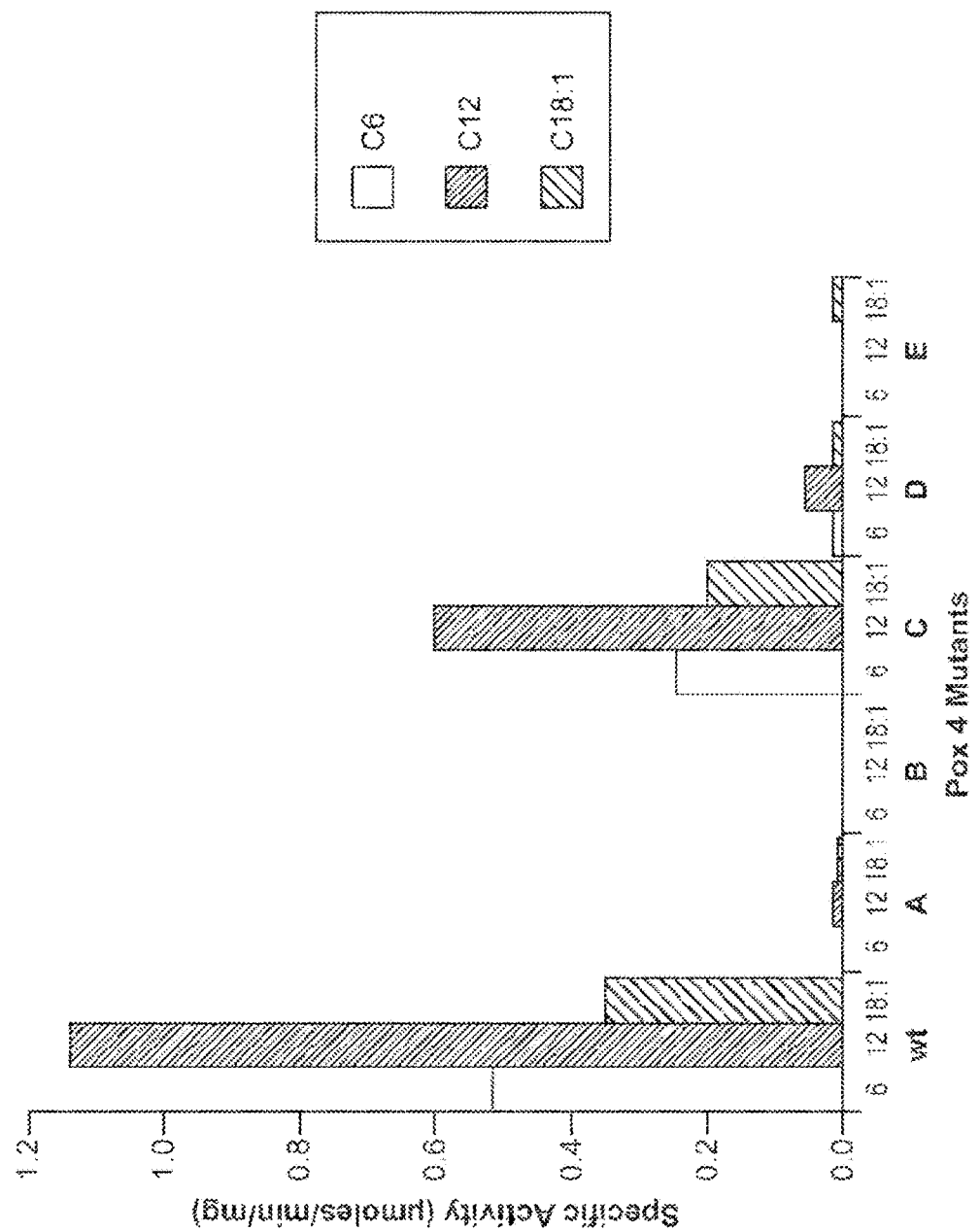
FIG. 28 shows the acyl CoA activity profile associated with Pox4 mutants.

Site-Directed Mutagenesis of *Candida* Pox4 and Pox5 to Alter Substrate Specificity-Method Using the HotSpot Wizard and molecular modeling results as a guide, specific amino acids in Pox4 and Pox5 were mutated (i.e. added, deleted or substituted) by converting primarily polar or charged residues in the hot spot regions to alanine. FIG. 42A and FIG. 42B below show a summary of *Candida* strain ATCC20336 Pox5 and Pox4 mutations that were made and tested. The summary of the acyl CoA activity profile associated with some of the mutants in FIG. 42A and FIG. 42B are shown in FIG. 27 (Pox5) and FIG. 28 (Pox4). The number of carbons in each substrate tested is shown below each bar in FIG. 27 and FIG. 28. Pox5 Mutant I (grey highlight in FIG. 42A) results from "ACAD-based mutagenesis" (see discussion below).

Figure 22:
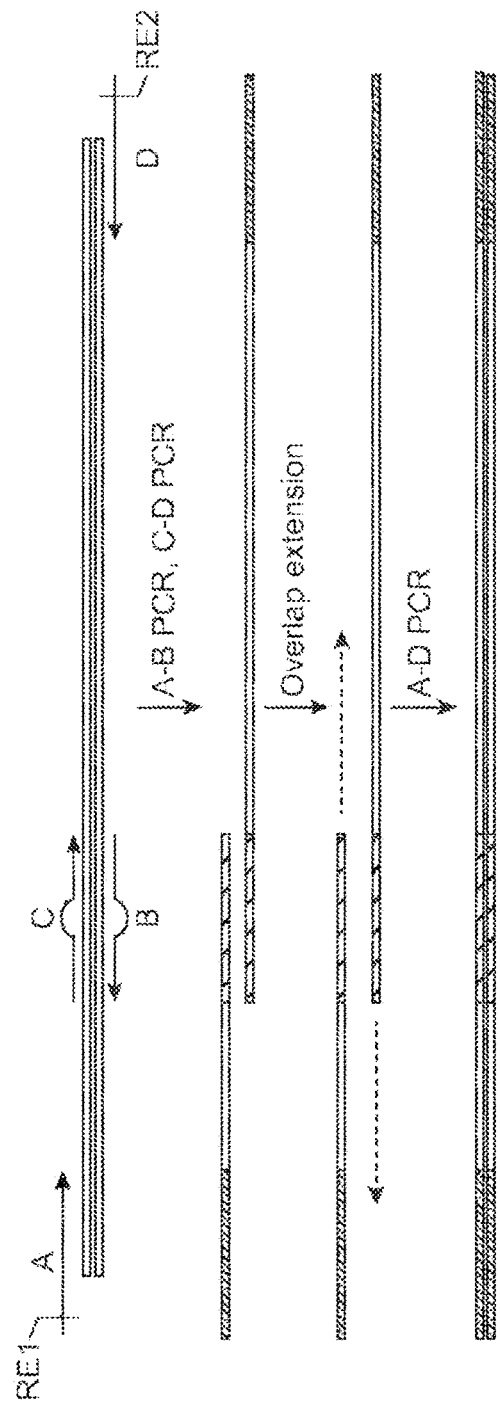
FIG. 22 illustrates a PCR overlap extension method for introducing site-directed point mutations into Acyl-CoA Oxidase genes.

Pox4 and Pox5 from *Candida* strain ATCC20336 were cloned into pET26b for expression in *E. coli* and assayed for acyl CoA oxidase activity in vitro. The activity profiles of the genetically modified Pox4 and Pox5 were compared to the activity profile of the wild type enzymes. To alter their substrate activity profile, site directed mutagenesis was performed on several locations in Pox4 and Pox5. Complementary primers encoding the point mutation(s) were used to amplify the coding sequences of Pox4 or Pox5 generating two to four PCR products that were then "stitched" together to regenerate the entire coding region using overlap extension PCR (FIG. 22). As shown in FIG. 22, overlap extension PCR was performed using primers A, B, C and D. Primers B and C are complementary and contain the introduced genetic modifications (e.g. mutations). PCR was performed using oligonucleotides A and B to produce a product with overlap to a PCR product generated using oligonucleotides C and D. The A-B product was used as a primer for the C-D product, and vice versa, for overlap extension. Several mutagenic primer pairs, for example, like the B-C primer pair, were used to produce mutations at different locations that were "stitched" together, i.e. A-B, C-D, E-F, etc. to generate an intact, full length coding region. To produce more of the final product containing the mutation(s), a PCR using the A primer and the most 3' reverse primer was performed. Primers A and D were used to amplify the entire coding sequence of Pox4 and Pox5 and to incorporate the restriction enzyme sites (RE1 and RE2) for cloning into an *E. coli* expression vector. The primers used for the site-directed mutagenesis for Pox5 (*Candida* strain ATCC20336) are listed in TABLE 24 to TABLE 32. The primers used for the site-directed mutagenesis for Pox4 (*Candida* strain ATCC20336) are listed in TABLE 33 to TABLE 39.

TABLE 31

Pox5 (*Candida* strain ATCC20336)

| Mutant Name | Native Amino Acid Position(s) | Introduced Mutation | Primer | Primer Sequence (5'-3') | Restriction Sites |
|---|---|---|---|---|---|
| A | | | PRIMER A | GTTCACTGCCATATGCCTACCGA ACTTCAAAAAGAAAGAGAACTC | NdeI |
| A | 81, 82 DQ | AA | PRIMER B | GATCGACAATCTCTGGGCCTGAG CAGCTGGGTACTCGTGCTCAAAG | |
| A | 81, 82 DQ | AA | PRIMER C | CTTTGAGCACGAGTACCCAGCTG CTCAGGCCCAGAGATTGTCGATC | |
| A | | | PRIMER D | CTTCGAGATGCGGCCGCTTAACT GGACAAGATTTCAGCAGCTTCTT CG | NotI |
| B | | | PRIMER A | GTTCACTGCCATATGCCTACCGA ACTTCAAAAAGAAAGAGAACTC | NdeI |
| B | 86, 88 RLS | ALA | PRIMER B | GTGGGTCAAAGACACCGAGGAT AGCCAAAGCCTGGGCCTGTTGGT CTGGGTAC | |
| B | 86, 88 RLS | ALA | PRIMER C | GTACCCAGACCAACAGGCCCAGG CTTTGGCTATCCTCGGTGTCTTTG ACCCAC | |
| B | | | PRIMER D | CTTCGAGATGCGGCCGCTTAACT GGACAAGATTTCAGCAGCTTCTT CG | NotI |

TABLE 32

Pox5 (*Candida* strain ATCC20336)

| Mutant Name | Native Amino Acid Position(s) | Introduced Mutation | Primer | Primer Sequence (5'-3') | Restriction Sites |
|---|---|---|---|---|---|
| C | | | PRIMER A | GTTCACTGCCATATGCCTACCGA ACTTCAAAAAGAAAGAGAACTC | NdeI |
| C | 93, 94 FD | AA | PRIMER B | GATTCTGGTGAAGACTTGTGGAG CAGCGACACCGAGGATCGACAA TC | |
| C | 93, 94 FD | AA | PRIMER C | GATTGTCGATCCTCGGTGTCGCT GCTCCACAAGTCTTCACCAGAATC | |
| C | | | PRIMER D | CTTCGAGATGCGGCCGCTTAACT GGACAAGATTTCAGCAGCTTCTT CG | NotI |
| D | | | PRIMER A | GTTCACTGCCATATGCCTACCGA ACTTCAAAAAGAAAGAGAACTC | NdeI |
| D | 291, 292DS | AA | PRIMER B | GAATCTACTGGTCATTCTGTAAG CAGCCATCATCATGGTGACTCTA CC | |

TABLE 32-continued

| | | Pox5 (*Candida* strain ATCC20336) | | | |
|---|---|---|---|---|---|
| Mutant Name | Native Amino Acid Position(s) | Introduced Mutation | Primer | Primer Sequence (5'-3') | Restriction Sites |
| D | 291, 292 DS | AA | PRIMER C | GGTAGAGTCACCATGATGATGGC TGCTTACAGAATGACCAGTAGAT TC | |
| D | | | PRIMER D | CTTCGAGATGCGGCCGCTTAACT GGACAAGATTTCAGCAGCTTCTT CG | NotI |

TABLE 33

| | | Pox5 (*Candida* strain ATCC20336) | | | |
|---|---|---|---|---|---|
| Mutant Name | Native Amino Acid Position(s) | Introduced Mutation | Primer | Primer Sequence (5'-3') | Restriction Sites |
| E | | | PRIMER A | GTTCACTGCCATATGCCTACCGA ACTTCAAAAGAAAGAGAACTC | NdeI |
| E | 95, 96 PQ | AA | PRIMER B | CACCGATTCTGGTGAAGACAGCA GCGTCAAAGACACCGAGGATCG | |
| E | 95, 96 PQ | AA | PRIMER C | CGATCCTCGGTGTCTTTGACGCT GCTGTCTTCACCAGAATCGGTG | |
| E | | | PRIMER D | CTTCGAGATGCGGCCGCTTAACT GGACAAGATTTCAGCAGCTTCTT CG | NotI |
| F | | | PRIMER A | GTTCACTGCCATATGCCTACCGA ACTTCAAAAGAAAGAGAACTC | NdeI |
| F | 294, 295 RM | AA | PRIMER B | GGTGATGAATCTACTGGTCGCGG CGTAGGAGTCCATCATCATG | |
| F | 294, 295 RM | AA | PRIMER C | CATGATGATGGACTCCTACGCCG CGACCAGTAGATTCATCACC | |
| F | | | PRIMER D | CTTCGAGATGCGGCCGCTTAACT GGACAAGATTTCAGCAGCTTCTT CG | NotI |

TABLE 34

| | | Pox5 (*Candida* strain ATCC20336) | | | |
|---|---|---|---|---|---|
| Mutant Name | Native Amino Acid Position(s) | Introduced Mutation | Primer | Primer Sequence (5'-3') | Restriction Sites |
| G | | | PRIMER A | GTTCACTGCCATATGCCTACCGA ACTTCAAAAGAAAGAGAACTC | NdeI |
| G | 287 T | A | PRIMER B | GAGTCCATCATCATGGCGACTCT ACCACCAATC | |
| G | 287 T | A | PRIMER C | GATTGGTGGTAGAGTCGCCATGA TGATGGACTC | |
| G | | | PRIMER D | CTTCGAGATGCGGCCGCTTAACT GGACAAGATTTCAGCAGCTTCTT CG | NotI |
| H | | | PRIMER A | GTTCACTGCCATATGCCTACCGA ACTTCAAAAGAAAGAGAACTC | NdeI |

TABLE 34-continued

Pox5 (Candida strain ATCC20336)

| Mutant Name | Native Amino Acid Position(s) | Introduced Mutation | Primer | Primer Sequence (5'-3') | Restriction Sites |
|---|---|---|---|---|---|
| H | 290, 291 MD | AA | PRIMER B | CTGGTCATTCTGTAGGAGGCTGC CATCATGGTGACTCTACC | |
| H | 290, 291 MD | AA | PRIMER C | GGTAGAGTCACCATGATGGCAGC CTCCTACAGAATGACCAG | |
| H | | | PRIMER D | CTTCGAGATGCGGCCGCTTAACT GGACAAGATTTCAGCAGCTTCTT CG | NotI |

TABLE 35

Pox5 (Candida strain ATCC20336)

| Mutant Name | Native Amino Acid Position(s) | Introduced Mutation | Primer | Primer Sequence (5'-3') | Restriction Sites |
|---|---|---|---|---|---|
| I | | | PRIMER A | GTTCACTGCCATATGCCTACCGA ACTTCAAAAGAAAGAGAACTC | NdeI |
| I | 284/436 GE | EG | PRIMER B | CATCATCATGGTGACTCTTTCAC CAATCAAAGCCGAG | |
| I | 284/436 GE | EG | PRIMER C | CTCGGCTTTGATTGGTGAAAGAG TCACCATGATGATG | |
| I | 284/436 GE | EG | PRIMER D | GTTGTTGTCACCTCCCCAGGTAC ATTGG | |
| I | 284/436 GE | EG | PRIMER E | CCAATGTACCTGGGGAGGTGACA ACAAC | |
| I | | | PRIMER F | CTTCGAGATGCGGCCGCTTAACT GGACAAGATTTCAGCAGCTTCTT CG | NotI |
| J | | | PRIMER A | GTTCACTGCCATATGCCTACCGA ACTTCAAAAGAAAGAGAACTC | NdeI |
| J | 291 D | G | PRIMER B | GGTCATTCTGTAGGAGCCCATCA TCATGGTGAC | |
| J | 291 D | G | PRIMER C | GTCACCATGATGATGGGCTCCTA CAGAATGACC | |
| J | | | PRIMER D | CTTCGAGATGCGGCCGCTTAACT GGACAAGATTTCAGCAGCTTCTT CG | NotI |

TABLE 36

Pox5 (Candida strain ATCC20336)

| Mutant Name | Native Amino Acid Position(s) | Introduced Mutation | Primer | Primer Sequence (5'-3') | Restriction Sites |
|---|---|---|---|---|---|
| K | | | PRIMER A | GTTCACTGCCATATGCCTACCGA ACTTCAAAAGAAAGAGAACTC | NdeI |
| K | 292 S | A | PRIMER B | CTGGTCATTCTGTAGGCGTCCAT CATCATGGTG | |
| K | 292 S | A | PRIMER C | CACCATGATGATGGACGCCTACA GAATGACCAG | |

TABLE 36-continued

Pox5 (Candida strain ATCC20336)

| Mutant Name | Position | Native Amino Acid(s) | Introduced Mutation | Primer | Primer Sequence (5'-3') | Restriction Sites |
|---|---|---|---|---|---|---|
| K | | | | PRIMER D | CTTCGAGATGCGGCCGCTTAACT GGACAAGATTTCAGCAGCTTCTT CG | Not1 |
| L | | | | PRIMER A | GTTCACTGCCATATGCCTACCGA ACTTCAAAAGAAAGAGAACTC | Nde1 |
| L | 93 | F | A | PRIMER B | GTGAAGACTTGTGGGTCTGCGAC ACCGAGGATCGAC | |
| L | 93 | F | A | PRIMER C | GTCGATCCTCGGTGTCGCAGACC CACAAGTCTTCAC | |
| L | | | | PRIMER D | CTTCGAGATGCGGCCGCTTAACT GGACAAGATTTCAGCAGCTTCTT CG | Not1 |

TABLE 38

Pox5 (Candida strain ATCC20336)

| Mutant Name | Position | Native Amino Acid(s) | Introduced Mutation | Primer | Primer Sequence (5'-3') | Restriction Sites |
|---|---|---|---|---|---|---|
| N | | | | PRIMER A | GTTCACTGCCATATGCCTACCGA ACTTCAAAAGAAAGAGAACTC | Nde1 |
| N | 86 | R | A | PRIMER B | CAAAGACACCGAGGATCGACAA AGCCTGGGCCTGTTGGTCTGGGT AC | |
| N | 86 | R | A | PRIMER C | GTACCCAGACCAACAGGCCCAG GCTTTGTCGATCCTCGGTGTCTTTG | |
| N | | | | PRIMER D | CTTCGAGATGCGGCCGCTTAACT GGACAAGATTTCAGCAGCTTCTT CG | Not1 |
| O | | | | PRIMER A | GTTCACTGCCATATGCCTACCGA ACTTCAAAAGAAAGAGAACTC | Nde1 |
| O | 88 | S | A | PRIMER B | CAAAGACACCGAGGATCGCCAA TCTCTGGGCCTGTTG | |
| O | 88 | S | A | PRIMER C | CAACAGGCCCAGAGATTGGCGA TCCTCGGTGTCTTTG | |
| O | | | | PRIMER D | CTTCGAGATGCGGCCGCTTAACT GGACAAGATTTCAGCAGCTTCTT CG | Not1 |

TABLE 39

Pox5 (Candida strain ATCC20336)

| Mutant Name | Position | Native Amino Acid(s) | Introduced Mutation | Primer | Primer Sequence (5'-3') | Restriction Sites |
|---|---|---|---|---|---|---|
| P | | | | PRIMER A | GTTCACTGCCATATGCCTACCGA ACTTCAAAAGAAAGAGAACTC | Nde1 |
| P | 98 | F | G | PRIMER B | GTTGACACCGATTCTGGTTCCGA CTTGTGGGTCAAAGAC | |

TABLE 39-continued

Pox5 (*Candida* strain ATCC20336)

| Mutant Name | Position | Native Amino Acid(s) | Introduced Mutation | Primer | Primer Sequence (5'-3') | Restriction Sites |
|---|---|---|---|---|---|---|
| P | 98 | F | G | PRIMER C | GTCTTTGACCCACAAGTCGGAAC CAGAATCGGTGTCAAC | |
| P | | | | PRIMER D | CTTCGAGATGCGGCCGCTTAACT GGACAAGATTTCAGCAGCTTCTT CG | Not1 |
| Q | | | | PRIMER A | GTTCACTGCCATATGCCTACCGA ACTTCAAAAGAAAGAGAACTC | Nde1 |
| Q | 83, 85 | QAQ | AAA | PRIMER B | CAAAGACACCGAGGATCGACAA TCTAGCCGCAGCTTGGTCTGGGT ACTCGTGCTCAAAG | |
| Q | 83, 85 | QAQ | AAA | PRIMER C | CTTTGAGCACGAGTACCCAGACC AAGCTGCCGCTAGATTGTCGATC CTCGGTGTCTTTG | |
| Q | | | | PRIMER D | CTTCGAGATGCGGCCGCTTAACT GGACAAGATTTCAGCAGCTTCTT CG | Not1 |

TABLE 40

Pox5 (*Candida* strain ATCC20336)

| Mutant Name | Position(s) | Native Amino Acid(s) | Introduced Mutation | Primer | Primer Sequence (5'-3') | Restriction Sites |
|---|---|---|---|---|---|---|
| CT2 | | | | PRIMER A | GTTCACTGCCATATGCCTACCGA ACTTCAAAAGAAAGAGAACTC | Nde1 |
| CT2 | 453-463 | DLL KEP EQK GL | QVISIE DAGKT VRGST AFLNQ LKDYT GSNSS KV | PRIMER B | CGGCATCTTCAATGCTGATAACT TGCTCTAACCATTGGCTTGGCA | |
| CT2 | 453-463 | DLL KEP EQK GL | QVISIE DAGKT VRGST AFLNQ LKDYT GSNSS KV | PRIMER C | TGCCAAGCCAATGGTTAGAGCA AGTTATCAGCATTGAAGATGCC | |
| CT2 | 453-463 | DLL KEP EQK GL | QVISIE DAGKT VRGST AFLNQ LKDYT GSNSS KV | PRIMER D | TCGGCAACGCTGGAGAGAACAA CCTTGGAGCTGTTGGAACCAGT GT | |
| CT2 | 453-463 | DLL KEP EQK GL | QVISIE DAGKT VRGST AFLNQ LKDYT GSNSS KV | PRIMER E | ACACTGGTTCCAACAGCTCCAA GGTTGTTCTCTCCAGCGTTGCCGA | |
| CT2 | | | | PRIMER F | CTTCGAGATGCGGCCGCTTAACT GGACAAGATTTCAGCAGCTTCTT CG | Not1 |

TABLE 41

| Pox4 (Candida strain ATCC20336) | | | | | | |
|---|---|---|---|---|---|---|
| Mutant Name | Position | Native Amino Acid(s) | Introduced Mutation | Primer | Primer Sequence (5'-3') | Restriction Sites |
| A | | | | PRIMER A | GTTCACTGCCATATGACTTTTACAAAGAAAAACGTTAGTGTA | NdeI |
| A | 98, 99, 100 | FNK | AAA | PRIMER B | CAAAGATACCAATCAAGGACAATCTAGCAGCAGCAGTGTCGATGGATTCTTGTTCTCTG | |
| A | 98, 99, 100 | FNK | AAA | PRIMER C | CAGAGAACAAGAATCCATCGACACTGCTGCTGCTAGATTGTCCTTGATTGGTATCTTTG | |
| A | | | | PRIMER D | CTTCGAGATGCGGCCGCTTATTACTTGGACAAGATAGCAGCGGTTTCATCAGA | NotI |
| B | | | | PRIMER A | GTTCACTGCCATATGACTTTTACAAAGAAAAACGTTAGTGTA | NdeI |
| B | 102, 103 | LS | AA | PRIMER B | GTGGGTCAAAGATACCAATCAAAGCAGCTCTCTTGTTGAAAGTGTCGATG | |
| B | 102, 103 | LS | AA | PRIMER C | CATCGACACTTTCAACAAGAGAGCTGCTTTGATTGGTATCTTTGACCCAC | |
| B | | | | PRIMER D | CTTCGAGATGCGGCCGCTTATTACTTGGACAAGATAGCAGCGGTTTCATCAGA | NotI |

TABLE 42

| Pox4 (Candida strain ATCC20336) | | | | | | |
|---|---|---|---|---|---|---|
| Mutant Name | Position | Native Amino Acid(s) | Introduced Mutation | Primer | Primer Sequence (5'-3') | Restriction Sites |
| C | | | | PRIMER A | GTTCACTGCCATATGACTTTTACAAAGAAAAACGTTAGTGTA | NdeI |
| C | 96 | D | A | PRIMER B | GGACAATCTCTTGTTGAAAGTAGCGATGGATTCTTGTTCTCTG | |
| C | 96 | D | A | PRIMER C | CAGAGAACAAGAATCCATCGCTACTTTCAACAAGAGATTGTCC | |
| C | | | | PRIMER D | CTTCGAGATGCGGCCGCTTATTACTTGGACAAGATAGCAGCGGTTTCATCAGA | NotI |
| D | | | | PRIMER A | GTTCACTGCCATATGACTTTTACAAAGAAAAACGTTAGTGTA | NdeI |
| D | 90 | R | A | PRIMER B | GTGTCGATGGATTCTTGTTCAGCGTATCTGGCGATTCTGTTG | |
| D | 90 | R | A | PRIMER C | CAACAGAATCGCCAGATACGCTGAACAAGAATCCATCGACAC | |
| D | | | | PRIMER D | CTTCGAGATGCGGCCGCTTATTACTTGGACAAGATAGCAGCGGTTTCATCAGA | NotI |

TABLE 43

| Pox4 (Candida strain ATCC20336) | | | | | | |
|---|---|---|---|---|---|---|
| Mutant Name | Position | Native Amino Acid(s) | Introduced Mutation | Primer | Primer Sequence (5'-3') | Restriction Sites |
| E | | | | PRIMER A | GTTCACTGCCATATGACTTTTACAAAGAAAAACGTTAGTGTA | NdeI |
| E | 88 | R | A | PRIMER B | GATGGATTCTTGTTCTCTGTAAGCGGCGATTCTGTTGATCTTGAC | |

TABLE 43-continued

Pox4 (Candida strain ATCC20336)

| Mutant Name | Position | Native Amino Acid(s) | Introduced Mutation | Primer | Primer Sequence (5'-3') | Restriction Sites |
|---|---|---|---|---|---|---|
| E | 88 | R | A | PRIMER C | GTCAAGATCAACAGAATCGCC GCTTACAGAGAACAAGAATCC ATC | |
| E | | | | PRIMER D | CTTCGAGATGCGGCCGCTTATT ACTTGGACAAGATAGCAGCGG TTTCATCAGA | Not1 |
| F | | | | PRIMER A | GTTCACTGCCATATGACTTTTA CAAAGAAAAACGTTAGTGTA | Nde1 |
| F | 302 | M | A | PRIMER B | GAGTCCAAAACCATCGCGACT CTACCACCCAAC | |
| F | 302 | M | A | PRIMER C | GTTGGGTGGTAGAGTCGCGAT GGTTTTGGACTC | |
| F | | | | PRIMER D | CTTCGAGATGCGGCCGCTTATT ACTTGGACAAGATAGCAGCGG TTTCATCAGA | Not1 |

TABLE 44

Pox4 (Candida strain ATCC20336)

| Mutant Name | Position | Native Amino Acid(s) | Introduced Mutation | Primer | Primer Sequence (5'-3') | Restriction Sites |
|---|---|---|---|---|---|---|
| G | | | | PRIMER A | GTTCACTGCCATATGACTTTTA CAAAGAAAAACGTTAGTGTA | Nde1 |
| G | 309, 310 | RM | A | PRIMER B | GTGGACATTCTAGCCAACGCG GCGTAGGAGTCCAAAACCATC | |
| G | 309, 310 | RM | A | PRIMER C | GATGGTTTTGGACTCCTACGCC GCGTTGGCTAGAATGTCCAC | |
| G | | | | PRIMER D | CTTCGAGATGCGGCCGCTTATT ACTTGGACAAGATAGCAGCGG TTTCATCAGA | Not1 |
| H | | | | PRIMER A | GTTCACTGCCATATGACTTTTA CAAAGAAAAACGTTAGTGTA | Nde1 |
| H | 98 | F | A | PRIMER B | CAAGGACAATCTCTTGTTGGC AGTGTCGATGGATTCTTG | |
| H | 98 | F | A | PRIMER C | CAAGAATCCATCGACACTGCC AACAAGAGATTGTCCTTG | |
| H | | | | PRIMER D | CTTCGAGATGCGGCCGCTTATT ACTTGGACAAGATAGCAGCGG TTTCATCAGA | Not1 |

TABLE 45

Pox4 (Candida strain ATCC20336)

| Mutant Name | Position | Native Amino Acid(s) | Introduced Mutation | Primer | Primer Sequence (5'-3') | Restriction Sites |
|---|---|---|---|---|---|---|
| I | | | | PRIMER A | GTTCACTGCCATATGACTTTTA CAAAGAAAAACGTTAGTGTA | Nde1 |

TABLE 45-continued

Pox4 (*Candida* strain ATCC20336)

| Mutant Name | Position | Native Amino Acid(s) | Introduced Mutation | Primer | Primer Sequence (5'-3') | Restriction Sites |
|---|---|---|---|---|---|---|
| I | 99 | N | A | PRIMER B | CAATCAAGGACAATCTCTTCG CGAAAGTGTCGATGGATTC | |
| I | 99 | N | A | PRIMER C | GAATCCATCGACACTTTCGCG AAGAGATTGTCCTTGATTG | |
| I | | | | PRIMER D | CTTCGAGATGCGGCCGCTTATT ACTTGGACAAGATAGCAGCGG TTTCATCAGA | Not1 |
| J | | | | PRIMER A | GTTCACTGCCATATGACTTTTA CAAAGAAAAACGTTAGTGTA | Nde1 |
| J | 100 | K | A | PRIMER B | CAATCAAGGACAATCTCGCGT TGAAAGTGTCGATG | |
| J | 100 | K | A | PRIMER C | CATCGACACTTTCAACGCGAG ATTGTCCTTGATTG | |
| J | | | | PRIMER D | CTTCGAGATGCGGCCGCTTATT ACTTGGACAAGATAGCAGCGG TTTCATCAGA | Not1 |

TABLE 46

Pox4 (*Candida* strain ATCC20336)

| Mutant Name | Position | Native Amino Acid(s) | Introduced Mutation | Primer | Primer Sequence (5'-3') | Restriction Sites |
|---|---|---|---|---|---|---|
| K | | | | PRIMER A | GTTCACTGCCATATGACTTTTA CAAAGAAAAACGTTAGTGTA | Nde1 |
| K | 102 | L | A | PRIMER B | CAAAGATACCAATCAAGGAGG CTCTCTTGTTGAAAGTGTCG | |
| K | 102 | L | A | PRIMER C | CGACACTTTCAACAAGAGAGC CTCCTTGATTGGTATCTTTG | |
| K | | | | PRIMER D | CTTCGAGATGCGGCCGCTTATT ACTTGGACAAGATAGCAGCGG TTTCATCAGA | Not1 |
| L | | | | PRIMER A | GTTCACTGCCATATGACTTTTA CAAAGAAAAACGTTAGTGTA | Nde1 |
| L | 103 | S | A | PRIMER B | GTCAAAGATACCAATCAAGGC CAATCTCTTGTTGAAAGTG | |
| L | 103 | S | A | PRIMER C | CACTTTCAACAAGAGATTGGC CTTGATTGGTATCTTTGAC | |
| L | | | | PRIMER D | CTTCGAGATGCGGCCGCTTATT ACTTGGACAAGATAGCAGCGG TTTCATCAGA | Not1 |

TABLE 47

Pox4 (*Candida* strain ATCC20336)

| Mutant Name | Position(s) | Native Amino Acid(s) | Introduced Mutation | Primer | Primer Sequence (5'-3') | Restriction Sites |
|---|---|---|---|---|---|---|
| CT3 | | | | PRIMER A | GTTCACTGCCATATGACTTTTA CAAAGAAAAACGTTAGTGTA | Nde1 |

TABLE 47-continued

Pox4 (Candida strain ATCC20336)

| Mutant Name | Native Amino Acid Position(s) | Introduced Mutation | Primer | Primer Sequence (5'-3') | Restriction Sites |
|---|---|---|---|---|---|
| CT3 | 473-505 | QVIS IEDA GKT VRG STA FLN QLK DYT GSN SSKV | DLLKE PEQKGL | PRIMER B | CAATCCCTTTTGTTCTGGCTCC TTCAACAAGTCCTTGACAATTG GCTTACCAA | |
| CT3 | 473-505 | QVIS IEDA GKT VRG STA FLN QLK DYT GSN SSKV | DLLKE PEQKGL | PRIMER C | GACTTGTTGAAGGAGCCAGAA CAAAAGGGATTGGTTTTGAAC ACTGTTGCTGA | |
| CT3 | | | | PRIMER D | CTTCGAGATGCGGCCGCTTATT ACTTGGACAAGATAGCAGCGG TTTCATCAGA | NotI |

In Vitro Acyl CoA Oxidase Assay

E. coli lysates were tested for acyl CoA oxidase activity as described in Example 41.

In Vitro Activity Assay for Pox4 Mutants

Figures 45, 46:
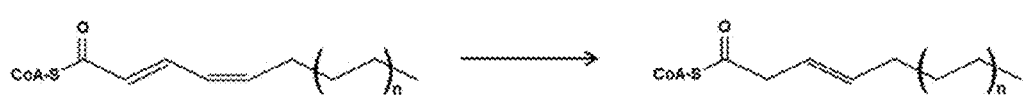
FIG. 45 shows the acyl CoA oxidase activity profile associated with Pox5 mutants.
FIG. 46 shows a mechanism for the reduction of an exemplary diacid by Dienyoyl-CoA Reductase.

FIG. 44 shows the acyl CoA oxidase activity profile associated with Pox4 mutants and FIG. 45 shows the acyl CoA oxidase activity profile associated with Pox5 mutants. The carbon length of the substrates tested is indicated above the data as C6 (6 carbons), C8 (8 carbons), C10 (10 carbons), C12 (twelve carbons), C14 (fourteen carbons), C16 (sixteen carbons) and C18.1 (eighteen carbons). In FIG. 44 and FIG. 45, unshaded blocks indicated the sample was not tested. Dark shading indicates that no activity was detected. Light shading indicates that minimal activity (i.e. poor activity) was detected at less than or equal to 0.1 umol/min/ug (umol substrate/minute/ug total protein). Medium shading indicates that good activity was detected at >0.1 umol/min/ug.

The Pox4 Mutant C, although displaying good activity across all substrates tested, demonstrated reduced overall activity for all substrates (FIG. 44). Pox4 Mutant D showed a similar result. Activity on C12 and C18:1 substrates was abolished in Pox4 Mutants B, A, E and G (FIG. 44) and CT3 (not shown).

In Vitro Activity Assay for Pox5 Mutants—Results

Acyl CoA oxidase activity was abolished in Pox5 Mutants B, C, F and M at least on substrates C6, C12 and C18:1 (FIG. 45). Mutants CT1 and CT2 were also inactive (not shown). Mutants A, E and I showed no change when compared to the activity of the wild type protein. However, Pox5 Mutants D, H, G, and J displayed altered substrate specificity when compared to wild type Pox5. Pox5 mutants D, H and J demonstrated reduced activity on C6 and/or C8 substrates. Pox5 mutant G displayed increased activity on C18:1 substrates.

Acyl-CoA Dehydrogenase-Based Mutagenesis

Acyl-CoA oxidases and acyl-CoA dehydrogenases (ACAD) both utilize similar but distinct mechanisms to catalyze dehydrogenation of an acyl-CoA substrate to produce a 2-trans-enoyl-CoA, the first step in β-oxidation (Arent, S., Pye, V. E., Henriksen, A. (2008). Structure and function of plant acyl CoA oxidases. Plant Phys. Biochem. 46:292-301). There are acyl-CoA dehydrogenases of different classes and they are grouped according to their substrate specificities: very long, long, medium and short chain (VL-CAD, LCAD, MCAD, SCAD, respectively) (Kim, J. J., Miura, R. (2004). Acyl-CoA dehydrogenases and acyl CoA oxidases. Structural basis for mechanistic similarities and differences. Eur. J. Biochem., 271(3):483-93.). The crystal structures of several of these enzymes have been solved and these data show structural differences that very likely contribute to their respective differences in substrate specificity. The crystal structure of VLCAD (PDB: 3B96) has revealed regions and amino acid residues of the protein that make it structurally, and more than likely functionally, different from MCAD (PDB: 3MDE) (McAndrew, R. P., Wang, Y., Mohsen, A. W., He, M., Vockley, J., Kim, J. J. (2008). Structural basis for substrate fatty acyl chain specificity: crystal structure of human very-long-chain acyl-CoA dehydrogenase. J. Biol. Chem. 283(14):9435-43). In some cases, a more significant difference is the location of the catalytic residue. In MCAD, the catalytic glutamate is located at position 376 on the loop connecting helix J and K while in LCAD, the catalytic glutamate is at position 255 on the adjacent helix G (Nandy, A., Kieweg, V., Kräutle, F. G., Vock, P., Ktiehler, B., Bross, P., Kim, J. J., Rasched, I., Ghisla, S. (1996). *Medium-long-chain chimeric human Acyl-CoA dehydrogenase: medium-chain enzyme with the active center base arrangement of long-chain Acyl-CoA dehydrogenase.* Biochemistry, 35(38):12402-11; Lee, H. J., Wang, M., Paschke, R., Nandy, A., Ghisla, S., Kim, J. J. (1996). *Crystal structures of the wild type and the Glu376Gly/Thr255Glu mutant of human medium-chain acyl-CoA dehydrogenase: influence of the location of the catalytic base on substrate specificity.* Biochemistry, 35(38): 12412-20).

The crystal structure of VLCAD (PDB: 3B96) has also revealed regions and amino acid residues of the protein that make it structurally, and more than likely functionally, different from MCAD (PDB: 3MDE) (McAndrew et al., 2008). VLCAD is larger than other acyl-CoA dehydrogenase proteins and forms a dimer, like a typical acyl CoA oxidase. Its substrate binding cavity is larger compared to other acyl-CoA dehydrogenase proteins and resembles an acyl CoA oxidase substrate binding pocket. The larger and more spacious pocket is necessary for accommodating the longer fatty acyl-CoA substrates that it acts upon. However, the crystal structures of rat AcoII and *Arabidopsis thaliana* ACX1 (PDB ID: 1W07) also reveal large substrate binding pockets and this feature does not necessarily explain the substrate specificities of each enzyme (Arent et al., 2008). Structural differences between MCAD and VLCAD offer some insight. At the base of the MCAD substrate binding pocket, there are two polar/charged residues (Q95 and E99) that are different from the analogous residues in VLCAD (G175 and G178). The increased hydrophobicity of the base of the VLCAD substrate binding pocket may be a factor, in addition to pocket size and depth, which contributes to substrate specificity. The corresponding residues in *Candida* strain ATCC20336 Pox5 are F98 and G102. Mutant P (F98G) is the mutation that should more closely reproduce the base of the VLCAD substrate binding pocket.

A double mutation in MCAD (e.g., E376G, T255E) can change its substrate specificity profile. This double mutation produced somewhat of a chimeric enzyme (MLCAD) (Nandy, et. al. 1996). MCAD has a broad substrate profile (C4-C18) with peak activity at C6 and C8. LCAD has a similarly broad profile with peak activity at C10 and C12. MLCAD has a more defined substrate profile (C10-C18) compared to MCAD or LCAD with peak activity at C12. However, the overall enzymatic activity of the MLCAD was also reduced ($V_{max}$ of MLCAD for C12 substrate is approximately 25% of $V_{max}$ of LCAD for C12 substrate).

Based in part on the results of the above studies, Pox5 was mutated as described in FIG. 42A (Mutant I) to shift its substrate profile to preferentially act on longer chain substrates.

VLCAD Mutagenesis

VLCAD has a substrate profile that is appropriate for production of longer chain diacids, such as sebacic or dodecanedioic acid. Activity of the enzyme ranges from acyl substrates that are 10 carbons to 22 carbons long and peak activity is on a C16 substrate. However, the enzymatic mechanism of VLCAD differs from that of a typical acyl CoA oxidase with respect to the final electron acceptor; in VLCAD, the enzyme is reoxidized by electron transfer ferroprotein (ETF) and AOXs are reoxidized by oxygen to produce hydrogen peroxide (Arent et al., 2008; Kim and Miura, 2004). To accommodate the difference in mechanisms, the substrate binding pocket of an acyl CoA oxidase, such as *A. thaliana* ACX1, is more spacious than that of VLCAD to allow oxygen into the pocket to act as the final electron acceptor and reoxidize the flavine adenine dinucleotide, or FAD, cofactor required for dehydrogenation of the acyl-CoA substrate. ETF performs this function in a typical acad and reoxidation of FAD by oxygen is inhibited while substrate is bound (Kumar, N. R., Srivastava, D. K. (1995). Facile and restricted pathways for the dissociation of octenoyl-CoA from the medium-chain fatty acyl-CoA dehydrogenase (MCAD)-FADH2-octenoyl-CoA charge-transfer complex: energetics and mechanism of suppression of the enzyme's oxidase activity. Biochemistry, 34(29): 9434-43). This is reflected in the shape of the substrate binding pocket with respect to FAD. In an acyl CoA oxidase, FAD is more solvent exposed, but in MCAD, the entire flavin ring is embedded in the protein and is only accessible to solvent when substrate is not present (Kim and Miura, 2004). In order for an acad to have oxidase activity, the substrate binding pocket must become more solvent accessible and permit oxidation of the reduced FAD cofactor by oxygen. Mutagenesis studies of MCAD have identified a residue that can achieve this result. Tyrosine 375 in MCAD, when changed to a lysine, confers significantly increased (~200-fold increase relative to wild type MCAD) acyl CoA oxidase activity (Zeng, J., Liu, Y., Wu, L., Li, D. (2007). Mutation of Tyr375 to Lys375 allows medium-chain acyl-CoA dehydrogenase to acquire acyl CoA oxidase activity. Biochim. Biophys. Acta, 1774(12): 1628-34).

Molecular modeling suggests that the mutation increases solvent accessibility near the FAD moiety in the active site. In order for VLCAD to function as an acyl CoA oxidase with the appropriate substrate specificity profile, an analogous mutation in VLCAD is made. Tyrosine 375 in MCAD corresponds to phenylalanine 461 in human and rat VLCAD. A F461K mutation in VLCAD is tested to see if it will now have acyl CoA oxidase activity.

Example 43: Generation of Strain sAA 2220

A DNA fragment encoding the ECI1 second allele was amplified from strain sAA1764 genomic DNA using primers oAA3091 and oAA3092. The PCR product was gel purified and ligated into pCR-Blunt II-TOPO (Invitrogen), transformed into competent TOP10 *E. coli* cells (Invitrogen) and clones containing PCR inserts were sequenced to confirm correct DNA sequence. One such plasmid was named pAA756.

The deletion of the second ECI1 allele in sAA1860 was created by a PCR based nested strategy. The second ECI1 deletion cassette was PCR amplified from three pieces using primer oAA3212 and oAA3217. The first piece (ECI1_N_Nested2) was amplified from pAA756 using primer oAA3212 and oAA3213. The second piece (URA3 cassette with direct repeat) was amplified from plasmid pAA298 using primer oAA3214 and oAA3215. The third piece (ECI1_C_Nested 2) was amplified from pAA756 using primer oAA3216 and oAA3217.

Strain sAA1860 was transformed with the second ECI1 deletion cassette described above and plated on a SCD-ura plate. Several colonies were checked for double ECI1 deletion. One such positive strain was named sAA2220

TABLE 50

Primer List

| Primer | sequence |
|---|---|
| oAA3085 | ATCGTTACCACCATCCCTACAAT |
| oAA3086 | CCGAAACAACCGTAGATACCTTTAAGCTACAACACTATACACGATAATTCCC |
| oAA3087 | GGGAATTATCGTGTATAGTGTTGTAGCTTAAAGGTATCTACGGTTGTTTCGG |
| oAA3088 | CTTGGACATTTCGACCTTGGCGGTACCGAGCTCTGCGAATT |
| oAA3089 | AATTCGCAGAGCTCGGTACCGCCAAGGTCGAAATGTCCAAG |
| oAA3090 | GCTTGTTCTGCAAAATGGAGTCA |
| oAA3091 | AGGAAAGACGACCATCTTGTACAA |

TABLE 50-continued

Primer List

| Primer | sequence |
|---|---|
| oAA3092 | TGGTCTCTGGACAACTTCAACAAT |
| oAA3212 | GGGGGAGATCGTTACCACCA |
| oAA3213 | AATTCGCAGAGCTCGGTACCGCTGCTGCTGCTGCTGTTTT |
| oAA3214 | AAAACAGCAGCAGCAGCAGCGGTACCGAGCTCTGCGAATT |
| oAA3215 | TTCGTTGTTGGCTCTCTCCATTAAAGGTATCTACGGTTGTTTCGG |
| oAA3216 | CCGAAACAACCGTAGATACCTTTAATGGAGAGAGCCAACAACGAA |
| oAA3217 | CAAAGGCATCGGTCAACTCC |

Example 44: Shake Flask Characterization of sAA875 and sAA2220

A 250 mL glass, non-baffled, flask containing 25 mL of SP92 media was inoculated with 5 mL of an overnight YPD culture (initial OD=0.4) and incubated for 24h at 30° C., with shaking at 300 rpm (2" throw incubator). The cells were centrifuged and the cell pellet resuspended in 12.5 mL of TB-lowN media (yeast nitrogen base without amino acids and without ammonium sulfate, 1.7 g/L; yeast extract, 3.0 g/L; potassium phosphate monobasic, 1.0 g/L; potassium phosphate dibasic, 1.0 g/L) and was transferred to 250 mL glass bottom-baffled flasks. Either 0.281 mL of oleic acid or linoleic acid was added to start adipic acid production and the cultures were incubated at 30° C., with shaking at 300 rpm. Samples were taken after 48 hours for gas chromatographic (GC) analysis. Shown below are the diacid profiles produced from oleic acid and linoleic acid with strains sAA875 (ECI1$^+$ ECI2$^+$) and sAA2220 (eci1$^-$ ECI2$^+$). In the case of linoleic acid, all unsaturated diacid products, whether having one or two double bonds, are combined and listed as the monounsaturated product. The results are shown in TABLE 41 AND TABLE 42 below; "g/L" refers to grams of the indicated di-acid per liter of fermentation broth.

TABLE 51

Diacid Profile, Linoleic acid Bioconversion (g/L)

| | C12:1 DA | C10:1 DA | C8:1 DA | C6:1 DA | C8:0 DA | C6:0 DA |
|---|---|---|---|---|---|---|
| ECI1+ ECI2+ | 0.00 | 0.78 | 2.26 | 0.00 | 2.88 | 5.82 |
| eci1− ECI2+ | 6.17 | 2.18 | 0.47 | 0.00 | 0.38 | 0.09 |

TABLE 52

Diacid Profile, Oleic acid Bioconversion (g/L)

| | C12:1 DA | C10:1 DA | C8:1 DA | C6:1 DA | C8:0 DA | C6:0 DA |
|---|---|---|---|---|---|---|
| ECI1+ ECI2+ | 0.00 | 0.11 | 0.46 | 0.00 | 4.88 | 7.77 |
| eci1− ECI2+ | 1.23 | 2.44 | 3.61 | 0.00 | 0.66 | 0.16 |

Example 45: Construction of Strains sAA2428 and sAA1269, Construction of sAA1269

Candida strain sAA988 was grown overnight in YPD and plated on 5-FOA plate. Colonies that grew in the presence of 5-FOA were PCR screened for the looping out of the URA3 gene leaving behind only the URA3 terminator. One such strain was named sAA1269.

Construction of Strain sAA2428

Candida strain SAA2428 was constructed by knocking out both alleles of POX5 from the genome of the starting strain sAA886. Both POX5 alleles were deleted by transforming the strain with the knock out plasmid construct pAA918.

| | 1$^{st}$ copy KO | after FOA | 2$^{nd}$ copy KO | after FOA |
|---|---|---|---|---|
| sAA886 → | sAA2291 → | sAA2310 → | sAA2399 → | sAA2428 |

Figure 32:
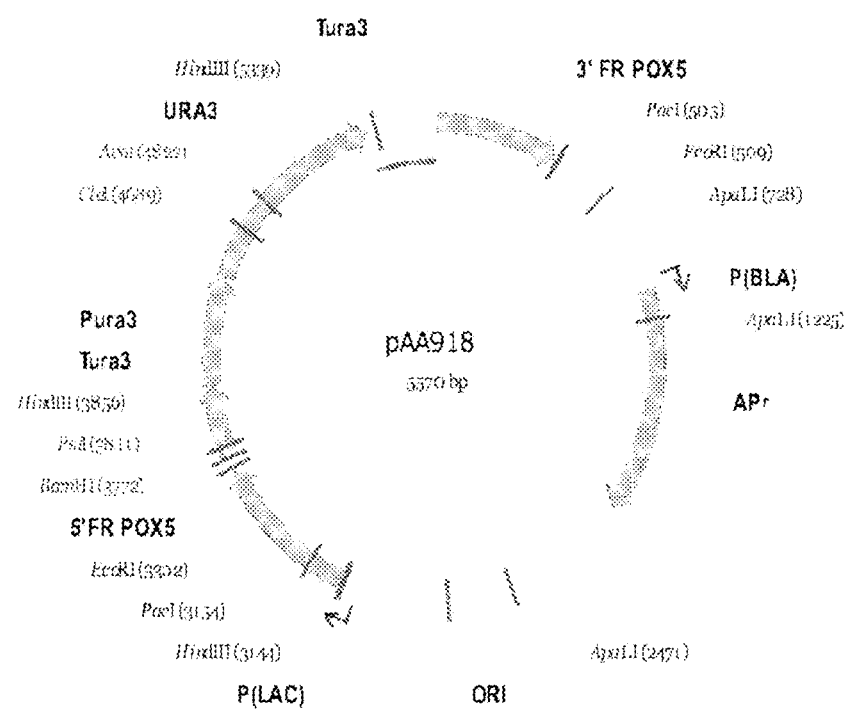
FIG. 32 shows plasmid vector map of pAA918.

Knock out plasmid construct pAA918: Approximately 600 bp of the 5' flanking region of the Candida POX5 gene was amplified using oligos oAA2656/oAA2657 and genomic DNA from ATCC20336. This fragment was gel purified and cloned into a PCR Blunt II TOPO vector to create plasmid pAA494. Approximately 500 bp of the 3' flanking region of the POX5 gene was amplified with primers oAA2658/oAA2659 using genomic DNA of ATCC20336 and this fragment was cloned into a PCR Blunt II TOPO vector to create plasmid pAA495. EcoRI/BamHI digested fragment of pAA494, HindIII/BamHI fragment of pAA495 and HindIII/EcoRI fragment of pUC19 were ligated together to construct plasmid pAA496. Subsequently, a DNA fragment containing the URA3 terminator—URA3 promoter—URA3 coding sequence—URA3 terminator flanked by NotI restriction sites was cloned into the NotI site of pAA496 to create the POX5 knockout construct plasmid pAA918. (FIG. 32).

TABLE 53

Primer List

| Primer | Sequence |
|---|---|
| oAA2656 | AAGCTTTTAATTAAAGATAATCACAGGGGTAGAGACCTTG |
| oAA2657 | GGATCCGCATGCGGCCGGCCGATAGCGTGGTATGAATGAATAAGTGTG |
| oAA2658 | GGATCCGAGCTCGCGGCCGCGAGCACTAGGTTTTGATAATTTGGTTCTTAC |
| oAA2659 | GAATTCTTAATTAACGGCGAAGAACATAGTGTGATG |

Example 46: Generation of Strain sAA2291

Candida strain sAA886 was transformed with PacI-digested fragment of pAA918 and plated on SCD-Ura plate. Several colonies were screened by PCR for integration of the deletion cassette in the first POX5 allele. A positive colony was named sAA2291.

Example 47: Generation of Strain sAA2310

Strain sAA2291 was grown in YPD media overnight and plated on a 5-FOA plate. Colonies that grew in the presence of 5-FOA were PCR screened for the looping out of the URA3 gene to leave behind only the URA3 terminator (T$_{URA3}$) in the first POX5 allele. This strain was named sAA2310.

Example 48: Generation of Strain sAA2399

The deletion of the second POX5 allele was performed by transformation of PacI-digested fragment of pAA918 into sAA2310 and plating on a SCD-Ura plate. Colonies that grew on the SCD-Ura plate were PCR screened for integration of the knockout cassette in the second POX5 allele. A positive colony was named sAA2399.

Example 49: Generation of Strain sAA2428

Strain sAA2399 was grown in YPD media overnight and plated on a 5-FOA plate. Colonies that grew in the presence of 5-FOA were PCR screened for the looping out of the URA3 gene to leave behind only the URA3 terminator (T$_{URA3}$) in the second POX5 allele. This strain was named sAA2428.

Example 50: Construction of ATCC 20336 POX4 and POX5 mutants in Strain sAA1269 or sAA2428

Mutants of ATCC20336 POX4 and POX5 had previously been constructed for expression in *E. coli* (as described above). To test these mutants for activity when expressed in strains derived from ATCC20336, they were cloned by PCR and inserted into either the vector pAA073 or pAA335.

The pAA335 vector was generated as follows. The promoter and terminator of PEX11 were PCR amplified from genomic DNA obtained from *Candida* strain ATCC20336 using oligos oAA2164 and oAA2138 or oAA2135 and oAA2136, respectively. The two pieces were digested with either Pst1 and SmaI or NdeI and SmaI and ligated into the Pst1 and NdeI sites of pAA61 to form pAA335.

If a gene is cloned into pAA073 or pAA335, it is under the regulation of the POX4 or PEX11 promoter, respectively. The oligonucleotides oAA540 and oAA541 were used to amplify POX5 sequences for seamless cloning into pAA073. The oligonucleotides oAA2984 and oAA2985 were used to amplify POX5 sequences for seamless cloning into pAA335. The oligonucleotides oAA3452 and oAA3453 were used to amplify POX4 sequences for seamless cloning into pAA335. The coding sequence for wildtype POX4 was amplified from genomic DNA of ATCC20336. All POX5 mutants except for T287A were transformed into sAA2428. The construct for the POX5 T287A mutant was transformed into sAA1269 to produce the strain sAA2058. The wildtype POX4 construct was transformed into sAA2428 to produce the strains sAA2778-2780 while the mutant POX4 D96A construct was transformed into sAA1269 to produce the strain sAA2109. All PCR amplifications were performed using Pfu Ultra II DNA Polymerase (Agilent Technologies, Santa Clara, Calif.) according to the manufacturer's instructions. Clones were selected by growth on SCD-ura plates and subsequently tested for growth on minimal media containing 0.1% Tween 80 with 0.1% oleic acid. Clones that grew well on media containing Tween 80 and oleic acid were tested in shake flask fermentations. In the case of the T287A mutant of POX5 and the D96A mutant of POX4, clones to be tested were identified by qPCR to determine how many copies of the mutant gene had been integrated. qPCR was performed using Brilliant III Ultra-Fast SYBR Green qPCR Master Mix (Agilent Technologies, Santa Clara, Calif.) according to the manufacturer's instructions.

The oligonucleotides oAA2718 and oAA2719 were used to amplify a portion of the actin gene while the oligonucleotides oAA3515 and oAA3516 were used to amplify a portion of the PEX11 promoter as the means of quantitating gene copy number. The tables below shows the sequences of oligonucleotides used for the above cloning procedures and qPCRs and the resulting strains from integration of the constructs by transformation.

TABLE 54

Cloning Primers List

| Primer | Primer Sequence (5'-3') | Restriction Site(s) |
|---|---|---|
| oAA540 | CACACAGCTCTTCCATAATGCCTACCGAACTTCAAAAAGAAAG | BspQ1 |
| oAA541 | CACACAGCTCTTCCCTCTCTTCTATTCTTAACTGGACAAGATTTCAGCAGC | BspQ1 |
| oAA2984 | CACACAGCTCTTCAGCCATGCCTACCGAACTTCAAAAAGAAAGAGAACTC | BspQ1 |
| oAA2985 | CACACAGCTCTTCGAGCTTACAATTTAGAACTGGACAAGATTTCAGCAGCTTCTTCG | BspQ1 |
| oAA3452 | CACACAGCTCTTCAGCCATGACTTTTACAAAGAAAAACGTTAGTGTATCACAAGG | BspQ1 |
| oAA3453 | CACACAGCTCTTCGAGCTTACTTGGACAAGATAGCAG | BspQ1 |
| oAA2135 | GAGCCCGGGTCTAGATGTGTGCTCTTCCGCTCCAGGCTTGTTATGACTCTAGAGAGAAGTGTG | SmaI |
| oAA2136 | CACACACATATGAATTCGGTCGGGTTTTGACCTTGGATATGAAACTCAAAAATCATCAAATT | NdeI |
| oAA2138 | CACACATCTAGACCCGGGCTCTTCTGGCTGCGTTGTGTATGGGTT | SmaI |
| oAA2164 | CACACACTGCAGGAGGATGAAGAAGACGAAGA | PstI |

TABLE 55 qPCR Primer List

| Primer | Primer Sequence (5'-3') | Restriction Site(s) |
|---|---|---|
| oAA2718 | AGAAGCTTTGTTCAGACCAGCCGA | n/a |
| oAA2719 | ACCACCGGACATGACAATGTTACC | n/a |
| oAA3515 | GCAGAGTTAAGCCCGAGAAAGCAA | n/a |
| oAA3516 | TTGCCTTCCTCTATTCGGCTACCA | n/a |

TABLE 56

POX5 Mutants

| Mutant | Position(s) | Native Amino Acid(s) | Introduced Mutation(s) | Primer Combination | Resulting Strain |
|---|---|---|---|---|---|
| O | 88 | S | A | oAA540, 541 | sAA2645 |
| I | 284, 436 | G, E | E, G | oAA540, 541 | sAA2646 |
| K | 292 | S | A | oAA540, 541 | sAA2648 |
| E | 95, 96 | P, Q | A, A | oAA540, 541 | sAA2651 |
| P | 98 | F | G | oAA540, 541 | sAA2570 |

TABLE 56-continued

POX5 Mutants

| Mutant | Native Position(s) | Amino Acid(s) | Introduced Mutation(s) | Primer Combination | Resulting Strain |
|---|---|---|---|---|---|
| G | 287 | T | A | oAA2984, 2985 | sAA2058 |

TABLE 57

POX4 Mutants

| Mutant | Native Position(s) | Amino Acid(s) | Introduced Mutation(s) | Primer Combination | Resulting Strain |
|---|---|---|---|---|---|
| C | 96 | D | A | oAA3452, 3453 | sAA2109 |

Example 51: Mutagenic Target Sites for *Y. lipolytica* Pox2, Pox3 and Pox5

Structural models of *Y. lipolytica* Pox2, Pox3 and Pox5, based on the crystal structure of *R. norvegicus* AcoII (PDB ID: 1IS2A), were obtained from MODBASE (ModBase: Database of Comparative Protein Structure Models—http://modbase.compbio.ucsf edu/modbase-cgi/index.cgi) and used for HotSpot Wizard analyses of these enzymes (Hotspot Wizard—loschmidt.chemi.muni.cz/hotspotwizard/). The MODBASE identification numbers for the structural models of *Y. lipolytica* Pox2, Pox3 and Pox5 (in addition to their UniProtKB identification numbers) are shown in TABLE 48 below:

TABLE 58

| *Y. lipolytica* acyl-CoA oxidase | MODBASE Database ID | UniProt Knowledgebase ID |
|---|---|---|
| Pox2 | TR O74935 | O74935 |
| Pox3 | TR O74936 | O74936 |
| Pox5 | TR O74938 | O74938 |

All three of the *Y. lipolytica* enzymes contain similar "hotspots" for mutagenesis as those found in both POX4 and POX5 of ATCC20336. TABLE 49 below shows the hotspots for POX4 and POX5 of ATCC20336 and the corresponding residues in Pox2, Pox3 and Pox5 of *Y. lipolytica* based on the multiple sequence alignment shown above. An amino acid at one or more positions identified in TABLE 49 can be substituted with a non-native amino acid for the purpose of modifying substrate specificity.

TABLE 59

| ATCC20336 POX5 | | YlAco2 | | YlAco3 | | YlAco5 | |
|---|---|---|---|---|---|---|---|
| Position | Residue | Position | Residue | Position | Residue | Position | Residue |
| 81 | D | 101 | D | 102 | K | 100 | K |
| 82 | Q | 102 | D | 103 | E | 101 | E |
| 83 | Q | 103 | I | 104 | A | 102 | A |
| 84 | A | 104 | K | 105 | L | 103 | I |
| 85 | Q | 105 | K | 106 | L | 104 | L |
| 86 | R | 106 | R | 107 | R | 105 | R |
| 88 | S | 108 | A | 109 | Q | 107 | Q |
| 93 | F | 113 | A | 114 | V | 112 | V |
| 94 | D | 114 | D | 115 | D | 113 | D |
| 95 | P | 115 | M | 116 | M | 114 | M |
| 96 | Q | 116 | G | 117 | G | 115 | G |
| 98 | F | 118 | Y | 119 | R | 117 | R |
| 102 | G | 122 | G | 123 | G | 121 | A |
| 284 | G | 304 | G | 305 | G | 303 | G |
| 287 | T | 307 | S | 308 | T | 306 | T |
| 290 | M | 310 | S | 311 | A | 309 | A |
| 291 | D | 311 | D | 312 | D | 310 | E |
| 292 | S | 312 | S | 313 | S | 311 | S |
| 294 | R | 314 | Q | 315 | F | 313 | L |
| 295 | M | 315 | V | 316 | V | 314 | L |
| 428 | D | 446 | D | 447 | D | 446 | D |
| 429 | W | 447 | W | 448 | W | 447 | W |
| 436 | E | 454 | E | 455 | E | 454 | E |
| 453 | D | 471 | S | 472 | S | 471 | S |
| 454 | L | 472 | A | 473 | C | 472 | C |
| 455 | L | 473 | V | 474 | L | 473 | I |
| 456 | K | 474 | A | 475 | G | 474 | A |
| 457 | E | 475 | L | 476 | H | 475 | M |
| 458 | P | 476 | R | 477 | R | 476 | R |
| 459 | E | 477 | K | 478 | K | 477 | K |
| 460 | Q | 478 | G | 479 | G | 478 | K |
| 461 | K | 494 | E | 494 | K | 495 | K |
| 462 | G | 495 | G | 495 | G | 496 | G |
| 463 | L | 496 | N | 496 | S | 497 | K |

| ATCC20336 POX4 | | YlAco2 | | YlAco3 | | YlAco5 | |
|---|---|---|---|---|---|---|---|
| Position | Residue | Position | Residue | Position | Residue | Position | Residue |
| 88 | R | 93 | L | 94 | G | 92 | R |
| 90 | R | 95 | V | 96 | W | 94 | L |
| 96 | D | 101 | D | 102 | K | 100 | K |
| 98 | F | 103 | I | 104 | A | 102 | A |
| 99 | N | 104 | K | 105 | L | 103 | I |
| 100 | K | 105 | K | 106 | L | 104 | L |
| 102 | L | 107 | F | 108 | S | 106 | G |
| 103 | S | 108 | A | 109 | Q | 107 | Q |
| 105 | I | 110 | I | 111 | H | 109 | H |
| 106 | G | 111 | G | 112 | G | 110 | G |
| 107 | I | 112 | I | 113 | I | 111 | I |
| 302 | M | 307 | S | 308 | T | 306 | T |
| 309 | R | 314 | Q | 315 | F | 313 | L |
| 310 | M | 315 | V | 316 | V | 314 | L |
| 374 | D | 373 | A | 374 | I | 372 | Q |
| 377 | H | 376 | S | 377 | D | 375 | N |
| 474 | V | 472 | A | 473 | C | 472 | C |
| 475 | I | 473 | V | 474 | L | 473 | I |
| 476 | S | 474 | A | 475 | G | 474 | A |
| 477 | I | 475 | L | 476 | H | 475 | M |
| 478 | E | 476 | R | 477 | R | 476 | R |
| 479 | D | 477 | K | 478 | K | 477 | K |
| 480 | A | 478 | G | 479 | G | 478 | K |
| 481 | G | 479 | E | 480 | K | 479 | K |
| 482 | K | | | | | 480 | G |
| 483 | T | 480 | P | 481 | P | 481 | H |
| 484 | V | 481 | V | 482 | L | 482 | V |
| 485 | R | 482 | G | 483 | G | 483 | G |
| 486 | G | 483 | N | 484 | S | 484 | K |
| 487 | S | 484 | A | 485 | S | 485 | S |
| 488 | T | 485 | V | 486 | V | 486 | V |
| 489 | A | 486 | S | 487 | G | 487 | E |
| 490 | F | 487 | Y | 488 | Y | 488 | Y |
| 491 | L | 488 | L | 489 | L | 489 | L |
| 492 | N | 489 | K | 490 | A | 490 | Q |
| 493 | Q | 490 | R | 491 | N | 491 | R |
| 494 | L | 491 | Y | | | 492 | R |
| 495 | K | 492 | K | 492 | K | 493 | D |
| 496 | D | 493 | D | 493 | G | 494 | E |
| 497 | Y | 494 | L | 494 | L | 495 | L |
| 498 | T | 495 | A | 495 | E | 496 | Q |
| 499 | G | 496 | N | 496 | Q | 497 | N |
| 500 | S | 497 | A | 497 | A | 498 | A |
| 501 | N | 498 | K | 498 | T | 499 | R |
| 502 | S | 499 | L | 499 | L | 500 | V |
| 503 | S | 500 | N | 500 | S | 501 | D |
| 504 | K | 501 | G | 501 | G | 502 | N |
| 505 | V | | | | | | |

Example 52: Functional Analyses of ATCC20336 POX4 and POX5 Mutants

Functional analyses of "hotspot" residues in POX5 and one residue in POX4 were performed by primarily substituting alanine or glycine at those positions to test if they changed the activity or substrate specificity of the enzyme. The (G284E, E436G) mutant is based on the ACAD mutagenesis studies previously described. The resulting mutants were cloned into either pAA073 or pAA335 and integrated into sAA2428. These clones were tested in shake flask fermentations of oleic acid as follows over a 48- or 72-hour period. Starter cultures (5 mL) of the strains to be tested were grown in SP92 glycerol media (6.7 g/L Difco yeast nitrogen base, 3.0 g/L Difco yeast extract, 3.0 g/L ammonium sulfate, 1.0 g/L potassium phosphate monobasic, 1.0 g/L potassium phosphate dibasic, 75 g/L glycerol) were incubated overnight at 30° C., 250 rpm and used to inoculate 25 mL fresh SP92 glycerol media to an initial OD600 nm of 0.4 and incubated for approximately 18 hours at 30° C., 300 rpm. Cells were then pelleted by centrifugation for 10 minutes at 4,000×g, 4° C. then resuspended in 12.5 mL of TB-lowN media (1.7 g/L Difco yeast nitrogen base without amino acids and ammonium sulfate, 3.0 g/L Difco yeast extract, 1.0 g/L potassium phosphate monobasic, 1.0 g/L potassium phosphate dibasic). Oleic acid (5620) was added to start diacid production. TABLE 50 below shows the resulting diacids produced from these fermentations:

TABLE 60

| Strain | | g/L Product (saturated + unsaturated diacid) | | | | |
|---|---|---|---|---|---|---|
| | | C14 diacid | C12 diacid | C10 diacid | C8 diacid | C6 diacid |
| | POX5 mutation | | | | | |
| sAA2645 | S88A | 0.05 | 0.12 | 2.71 | 9.36 | 1.64 |
| sAA2646 | G284E, E436G | 0.00 | 0.06 | 0.70 | 8.54 | 5.45 |
| sAA2648 | S292A | 0.00 | 0.08 | 0.88 | 7.58 | 3.04 |
| sAA2651 | P95A, Q96A | 0.00 | 0.05 | 0.95 | 7.72 | 3.35 |
| sAA2570 | F98G | 0.00 | 0.00 | 0.00 | 0.16 | 12.02 |
| sAA875 | wt | 0.00 | 0.04 | 0.14 | 4.24 | 7.48 |
| sAA2058 | T287A* | | 0.04 | 0.48 | 10.35 | 4.1 |
| sAA875 | wt* | | 0.02 | 0.17 | 4.84 | 6.69 |
| | POX4 mutation | | | | | |
| sAA2780 | wildtype* | 0.02 | 0.02 | 0.04 | 0.19 | 10.13 |
| sAA2109 | D96A* | 0 | 0.01 | 0.01 | 0.12 | 9.01 |

*Results from a separate 48 hour fermentation

TABLE 61

Description of some strains referenced herein.

| Strain | Genetic Modifications |
|---|---|
| sAA496 | pox4Δ, CPR750, P450A19 |
| sAA617 | pox4Δ, CPR750, acoataΔ/ACOATB, POX5 |
| sAA620 | pox4Δ, CPR750, acoataΔ/ACOATB, POX5, ura3 |
| sAA632 | pox4Δ, CPR750, acoataΔ/ACOATB, P450A19 |
| sAA635 | pox4Δ, CPR750, acoataΔ/ACOATB, P450A19 |
| sAA722 | pox4Δ, acs1Δ/ACS1 |
| sAA741 | pox4Δ, acs1Δ/ACS1, ura3 |
| sAA776 | pox4Δ, acs1Δ |
| sAA779 | pox4Δ, acs1Δ, ura3 |
| sAA811 | pox4Δ, acs1Δ, P450A19 |
| sAA810 | pox4Δ, acs1Δ, P450A19, EcTESA |
| sAA865 | pox4Δ, acs1Δ, fat1Δ/FAT1 |
| sAA869 | pox4Δ, acs1Δ, fat1Δ/FAT1, ura3 |
| sAA875 | pox4Δ, acs1Δ, fat1Δ |
| sAA886 | pox4Δ, acs1Δ, fat1Δ, ura3 |
| sAA1764 | pox4Δ, acs1Δ, fat1Δ, eci1Δ/ECI1 |
| sAA1860 | pox4Δ, acs1Δ, fat1Δ, eci1Δ/ECI1, ura3 |
| sAA2058 | pox4Δ, pox5Δ, acs1Δ, fat1Δ, POX5(T287A) |
| sAA2109 | pox4Δ, pox5Δ, acs1Δ, fat1Δ, POX4(D96A) |
| sAA2220 | pox4Δ, acs1Δ, fat1Δ, eci1Δ |
| sAA2291 | pox4Δ, pox5Δ/POX5, acs1Δ, fat1Δ |
| sAA2310 | pox4Δ, pox5Δ/POX5, acs1Δ, fat1Δ, ura3 |
| sAA2399 | pox4Δ, pox5Δ, acs1Δ, fat1Δ |
| sAA2428 | pox4Δ, pox5Δ, acs1Δ, fat1Δ, ura3 |
| sAA2570 | pox4Δ, pox5Δ, acs1Δ, fat1Δ, POX5(F98G) |
| sAA2645 | pox4Δ, pox5Δ, acs1Δ, fat1Δ, POX5(S88A) |
| sAA2646 | pox4Δ, pox5Δ, acs1Δ, fat1Δ, POX5(G284E) |
| sAA2648 | pox4Δ, pox5Δ, acs1Δ, fat1Δ, POX5(S292A) |
| sAA2651 | pox4Δ, pox5Δ, acs1Δ, fat1Δ, POX5(P95A, Q96A) |
| **sAA2780 | pox4Δ, pox5Δ, acs1Δ, fat1Δ, POX4 |

Note:

Genes in lower case and/or with a Δ symbol indicate a deleted gene. Strains sAA617, sAA620 and sAA632 comprise a deletion of one allele of "acoat" and are heterozygous for the acoat gene knock out (e.g., acetoacetyl CoA thiolase$^{-/+}$).

**Strain AA2780 comprises a deletion of the endogenous POX4 gene (i.e. pox4Δ) and re-introduction of the wild type POX4 gene (i.e., POX4) under the control of a PEX11 promoter.

Example 53: Nucleotide and Amino Acid Sequences Used for Manipulations Described Herein

| SEQ ID NO: | Description | Sequence |
|---|---|---|
| SEQ ID NO: 1 | Thioesterase activity Cuphea lanceolata Amino acid (A.A. Seq) | MVAAAATSAFFPVPAPGTSPKPGKSGNWPSSLSPTFKPKSIPN AGFQVKANASAHPKANGSAVNLKSGSLNTQEDTSSSPPPRAF LNQLPDWSMLLTAITTVFVAAEKQWTMLDRKSKRPDMLVDS VGLKSIVRDGLVSRQSFLIRSYEIGADRTASIETLMNHLQETSI NHCKSLGLLNDGFGRTPGMCKNDLIWVLTKMQIMVNRYPT WGDTVEINTWFSQSGKIGMASDWLISDCNTGEILIRATSVWA MMNQKTRRFSRLPYEVRQELTPHFVDSPHVIEDNDQKLHKFD VKTGDSIRKGLTPRWNDLDVNQHVSNVKYIGWILESMPIEVL ETQELCSLTVEYRRECGMDSVLESVTAVDPSENGGRSQYHL LRLEDGTDIVKSRTEWRPKNAGTNGAISTSTAKTSNGNSAS |
| SEQ ID NO: 2 | FAO-13 (fatty alcohol oxidase activity) C. Tropicalis | atggctccattttgcccgaccaggtcgactacaaacacgtcgacacccttatgttattatgtgacgg gatcatccacgaaaccaccgtcgacccaaatcaaagacgttattgctcctgacttcctgctgacaa gtacgaagagtacgtcaggacattcaccaaaccctccgaaacccagggttcagggaaaccgtc tacaacacagtcaacgcaaacaccacggacgcaatccaccagttcattatcttgaccaatgttttgg |

| SEQ ID NO: | Description | Sequence |
|---|---|---|
| | Nucleotide (Nuc. Seq) | catccagggtcttggctccagctttgaccaactcgttgacgcctatcaaggacatgagcttggaag<br>accgtgaaaaattgttggcctcgtggcgcgactcccccaatcgctgccaaaaggaagttgttcaggt<br>tggtttctacgcttaccttggtcacgttcacgagattggccaatgagttgcatttgaaagccattcatta<br>tccaggaagagaagaccgtgaaaaggcttatgaaacccaggagattgacccttttaagtaccagtt<br>tttggaaaaaccgaagttttacggcgctgagttgtacttgccagatattgatgtgatcattattggatct<br>ggtgccggtgctggtgttgtggcccacactttggccaacgatggcttcaagagtttggttttggaaa<br>agggcaaatactttagcaactccgagttgaactttgatgacaaggacggcgttcaagaattatacca<br>aagtggaggtactttgactacagtcaaccaacagttgtttgttcttgctggttccacttttggtggcggt<br>accactgtcaattggtcagcctgtcttaagacgccattcaaggtgcgtaaggaatggtatgatgagt<br>ttggtgttgactttgctgctgatgaagcatacgataaagcgcaggattatgtttggcagcaaatggg<br>agcttctaccgaaggcatcacccactcttggctaacgagattattattgaaggtggtaagaaattag<br>gttacaaggccaaggtattagaccaaaacagcggtggtcatcctcagcacagatgcggtttctgtt<br>atttgggctgtaagcacggtatcaagcagggttctgttaataactggtttagagacgcagctgccca<br>cggttcccagttcatgcaacaggttagagttttgcaaatacttaacaagaaagggatcgcttacggt<br>atcttgtgtgaggatgttgtaaccggcgccaagttcaccattactggccccaaaaagtttgttgttgct<br>gccggtgctttgaacactccatctgtgttggtcaactccggcttcaagaacaagaacatcggtaaga<br>acttaactttgcacccagtttctgtcgtgtttggtgattttggcaaagacgttcaagcagaccacttcc<br>acaactccatcatgactgcccctttgttcagaagccgctgatttagacggcaagggccatggatgca<br>gaattgaaaccatcttgaacgctccattcatccaggcttcattcttaccatggagaggtagtaacgag<br>gctagacgagacttgttgcgttacaacaacatggtggcgatgttgctccttagtcgtgacaccacca<br>gtggttccgtttctgctcatccaaccaaacctgaagctttggttgtcgagtacgacgtgaacaagttt<br>gacagaaactcgatcttgcaggcattgttggtcactgctgacttgttgtatatccaaggtgccaaga<br>gaatccttagtccacaggcatgggtgccaattttttgaatccgacaagcaaaggataagagatcaa<br>tcaaggacgaggactatgtcgaatggagagccaaggttgccaagattcctttcgacacctacggct<br>cacctttatggttcggcacatcaaatgtcttcttgccgtatgtcaggtaagggtcctaaatacggtgct<br>gttgacaccgatggtagattgtttgaatgttcgaatgtttatgttgccgatgcaagtcttttgccaactg<br>caagcggtgccaaccctatggtcaccaccatgactcttgccagacatgttgcgttaggtttggcag<br>actccttgaagaccaaagccaagttgtag |
| SEQ ID NO: 3 | FAO-13 (fatty alcohol oxidase activity) C. Tropicalis A.A. Seq | MAPFLPDQVDYKHVDTLMLLCDGIIHETTVDQIKDVIAPDFPA<br>DKYEEYVRTFTKPSETPGFRETVYNTVNANTTDAIHQFIILTN<br>VLASRVLAPALTNSLTPIKDMSLEDREKLLASWRDSPIAAKRK<br>LFRLVSTLTLVTFTRLANELHLKAIHYPGREDREKAYETQEID<br>PFKYQFLEKPKFYGAELYLPDIDVIIIGSGAGAGVVAHTLAND<br>GFKSLVLEKGKYFSNSELNFDDKDGVQELYQSGGTLTTVNQQ<br>LFVLAGSTFGGGTTVNWSACLKTPFKVRKEWYDEFGVDFAA<br>DEAYDKAQDYVWQQMGASTEGITHSLANEIIEGGKKLGYKA<br>KVLDQNSGGHPQHRCGFCYLGCKHGIKQGSVNNWFRDAAA<br>HGSQFMQQVRVLQILNKKGIAYGILCEDVVTGAKFTITGPKKF<br>VVVAAGALNTPSVLVNSGFKNKNIGKNLTLHPVSVVFGDFGKD<br>VQADHFHNSIMTALCSEAADLDGKGHGCRIETILNAPFIQASF<br>LPWRGSNEARRDLLRYNNMVAMLLLSRDTTSGSVSAHPTKP<br>EALVVEYDVNKFDRNSILQALLVTADLLYIQGAKRILSPQAW<br>VPIFESDKPKDKRSIKDEDYVEWRAKVAKIPFDTYGSPYGSAH<br>QMSSCRMSGKGPKYGAVDTDGRLFECSNVYVADASLLPTAS<br>GANPMVTTMTLARHVALGLADSLKTKAKL |
| SEQ ID NO: 4 | FAO-17 (fatty alcohol oxidase activity) C. Tropicalis Nuc. Seq | atggctccattttgcccgaccaggtcgactacaaacacgtcgacacccttatgttattatgtgacgg<br>gatcatccacgaaaccaccgtggacgaaatcaaagacgtcattgcccctgacttccccgccgaca<br>aatacgaggagtacgtcaggacattcaccaaaccctcgaaaccccaggggttcagggaaaccgt<br>ctacaaccaccgtcaacgcaaacaccatggatgcaatccaccagttcattatcttgaccaatgtttgg<br>gatcaagggtcttggcaccagctttgaccaactcgttgactcctatcaaggacatgagcttggaag<br>accgtgaaaagtgttagcctcgtggcgtgactcccctattgctgctaaaaggaagttgttcaggttg<br>gtttctacgcttaccttggtcacgttcacgagattggccaatgagttgcatttgaaagccattcattatc<br>aggaagagaagaccgtgaaaaggcttatgaaacccaggagattgacccttttaagtaccagttttt<br>ggaaaaaccgaagttttacgcgctgagttgtacttgccagatattgatgtgatcattattggatctg<br>gtgccggtgctggtgttgtggcccacactttggccaacgatggcttcaagagtttggttttggaaaa<br>gggcaaatactttagcaactccgagttgaactttgatgacaaggacggcgttcaagaattataccaa<br>agtggaggtactttgactacagtcaaccaacagttgtttgttcttgctggttccacttttggtggcggta<br>ccactgtcaattggtcagcctgtcttaagacgccattcaaggtgcgtaaggaatggtatgatgagttt<br>ggtgttgactttgctgctgatgaagcatacgataaagcgcaggattatgtttggcagcaaatggag<br>cttctaccgaaggcatcacccactcttggctaacgagattattattgaaggtggtaagaaattaggtt<br>acaaggccaaggtattagaccaaaacagcggtggtcatcctcagcacagatgcggtttctgtttattt<br>gggttgtaagcacggtatcaagcagggtctgttaataactggtttagagacgcagctgcccacgg<br>ttctcagttcatgcaacaggttagagttttgcaaatccttaacaagaaggcatcgcttatgtatctt<br>gtgtgaggatgttgtaaccggtgccaagttcaccattactggccccaaaaagtttgttgttgccgcc<br>ggcgccttaaacactccatctgtgttggtcaactccggattcaagaacaagaacatcggtaagaac<br>ttaactttgcatccagtttctgtcgtgtttggtgattttggcaaagacgttcaagcagaccacttccaca<br>actccatcatgactgcccctttgttcagaagccgctgatttagacggcaagggccatggatgcagaa<br>ttgaaaccatcttgaacgctccattcatccaggcttcattcttaccatggagaggtagtaacgagct<br>agacgagacttgttgcgttacaacaacatggtggcgatgttgctccttagtcgtgacaccaccagtg<br>gttccgtttctgctcatccaaccaaacctgaagctttggttgtcgagtacgacgtgaacaagtttgac<br>agaaactcgatcttgcaggcattgttggtcactgctgacttgttgtatatccaaggtgccaagagaat<br>ccttagtccacaggcatgggtgccaattttttgaatccgacaagcaaaggataagagatcaatcaa<br>ggacgaggactatgtcgaatggagagccaaggttgccaagattcctttcgacacctacggctcac |

| SEQ ID NO: | Description | Sequence |
|---|---|---|
| | | cttatggttcggcacatcaaatgtcttcttgccgtatgtcaggtaagggtcctaaatacggtgctgttg<br>acaccgatggtagattgtttgaatgttcgaatgtttatgttgccgatgcaagtcttttgccaactgcaa<br>gcggtgccaaccctatggtcaccaccatgactcttgcaagacatgttgcgttaggtttggcagactc<br>cttgaagaccaaggccaagttgtag |
| SEQ ID NO: 5 | FAO-17(fatty alcohol oxidase activity)<br>C. Tropicalis<br>A.A. Seq | MAPFLPDQVDYKHVDTLMLLCDGIIHETTVDEIKDVIAPDFPA<br>DKYEEYVRTFTKPSETPGFRETVYNTVNANTMDAIHQFIILTN<br>VLGSRVLAPALTNSLTPIKDMSLEDREKLLASWRDSPIAAKRK<br>LFRLVSTLTLVTFTRLANELHLKAIHYPGREDREKAYETQEID<br>PFKYQFLEKPKFYGAELYLPDIDVIIGSGAGAGVVAHTLAND<br>GFKSLVLEKGKYFSNSELNFDDKDGVQELYQSGGTLTTVNQQ<br>LFVLAGSTFGGGTTVNWSACLKTPFKVRKEWYDEFGVDFAA<br>DEAYDKAQDYVWQQMGASTEGITHSLANEIIIEGGKKLGYKA<br>KVLDQNSGGHPQHRCGFCYLGCKHGIKQGSVNNWFRDAAA<br>HGSQFMQQVRVLQILNKKGIAYGILCEDVVTGAKFTITGPKKF<br>VVAAGALNTPSVLVNSGFKNKNIGKNLTLHPVSVVFGDFGKD<br>VQADHFHNSIMTALCSEAADLDGKGHGCRIETILNAPFIQASF<br>LPWRGSNEARRDLLRYNNMVAMLLLSRDTTSGSVSAHPTKP<br>EALVVEYDVNKFDRNSILQALLVTADLLYIQGAKRILSPQAW<br>VPIFESDKPKDKRSIKDEDYVEWRAKVAKIPFDTYGSPYGSAH<br>QMSSCRMSGKGPKYGAVDTDGRLFECSNVYVADASLLPTAS<br>GANPMVTTMTLARHVALGLADSLKTKAK1 |
| SEQ ID NO: 6 | FAO-20(fatty alcohol oxidase activity)<br>C. Tropicalis<br>Nuc. Seq | atggctccattttgcccgaccaggtcgactacaaacacgtcgacacccttatgttattatgtgacgg<br>gatcatccacgaaaccaccgtcgaccaaatcaaagacgttattgctcctgacttccctgctgacaa<br>gtacgaagagtacgtcaggacattcaccaaaccctccgaaacccaggggttcagggaaaccgtc<br>tacaacacagtcaacgcaaacaccacggacgcaatccaccagttcattatctttgaccaatgttttgg<br>catccagggtcttggctccagctttgaccaactcgttgacgcctatcaaggacatgagcttggaag<br>accgtgaaaaattgttggcctcgtggcgcgactcccaatcgctgccaaaaggaaattgttcaggt<br>tggtttccacgcttaccttggttactttcacgagattggccaatgagttgcatttgaaagccattcacta<br>tccaggagagaagaccgtgaaaaggtcttatgaaacccaggagattgacccttcaagtaccagt<br>ttatggaaaagccaaagtttgacggcgctgagttgtacttgccagatattgatgttatcattattggat<br>ctggtgccggtgctggtgttgtggcccacactttggccaacgatggcttcaagagtttggttttggaa<br>aagggcaaatactttagcaactccgagttgaactttgatgacaaggacggcgttcaagaattatacc<br>aaagtggaggtactttgactacagtcaaccaacagttgtttgttcttgctggttccacttttggtggcg<br>gtaccactgtcaattggtcagcctgtcttaagacgccattcaaggtgcgtaaggaatggtatgatga<br>gttggtgttgactttgctgctgatgcatacgataaagcgcaggatttatgtttggcagcaaatgg<br>gagcttctaccgaaggcatcacccactctttggctaacgagattattattgaaggtggtaagaaatta<br>ggttacaaggccaaggtattagaccaaaacagcggtggtcatcctcagcacagatgcgggtttctgt<br>tatttgggctgtaagcacggtatcaagcagggttctgttaataactggtttagagacgcagctgccc<br>acggttcccagttcatgcaacaggttagagttttgcaaatacttaacaagaagggggatcgcttacgg<br>tatcttgtgtgaggatgttgtaaccggcgccaagttcaccattactggccccaaaaagtttgttgtgc<br>tgccggtgcttttgaacactccatctgtgttggtcaactccggcttcaagaacaagaacatcggtaag<br>aacttaactttgcacccagtttctgtcgtgtttggtgattttggcaaagacgttcaagcagaccacttc<br>cacaactccatcatgactgcccttgttcagaagccgctgatttagacggcaagggccatggatgc<br>agaattgaaaccatcttgaacgctccattcatccaggcttcattcttaccatggagaggtagtaacga<br>ggctagacgagacttgttgcgttacaacatggtggcgatgttgctccttagtcgtgacaccacc<br>agtggttccgtttctgctcatccaaccaaacctgaagctttggttgtcgagtacgacgtgaacaagtt<br>tgacagaaactcgatcttgcaggcattgttggtcactgctgacttgttgtatatccaaggtgccaaga<br>gaatccttagtccacaggcatgggtgccaattttgaatccgacaagccaaggataagagatcaa<br>tcaaggacgaggactatgtcgaatggagagccaaggttgccaagattcctttcgacacctacggct<br>caccttatggttcggcacatcaaatgtcttcttgccgtatgtcaggtaagggtcctaaatacggtgct<br>gttgacaccgatggtagattgtttgaatgttcgaatgtttatgttgccgatgcaagtcttttgccaactg<br>caagcggtgccaaccctatggtcaccaccatgactcttgccagacatgttgcgttaggtttggcag<br>actccttgaagaccaaagccaagttgtag |
| SEQ ID NO: 7 | FAO-20(fatty alcohol oxidase activity)<br>C. Tropicalis<br>A.A. Seq | MAPFLPDQVDYKHVDTLMLLCDGIIHETTVDQIKDVIAPDFPA<br>DKYEEYVRTFTKPSETPGFRETVYNTVNANTTDAIHQFIILTN<br>VLASRVLAPALTNSLTPIKDMSLEDREKLLASWRDSPIAAKRK<br>LFRLVSTLTLVTFTRLANELHLKAIHYPGREDREKAYETQEID<br>PFKYQFMEKPKFDGAELYLPDIDVIIGSGAGAGVVAHTLAND<br>GFKSLVLEKGKYFSNSELNFDDKDGVQELYQSGGTLTTVNQQ<br>LFVLAGSTFGGGTTVNWSACLKTPFKVRKEWYDEFGVDFAA<br>DEAYDKAQDYVWQQMGASTEGITHSLANEIIIEGGKKLGYKA<br>KVLDQNSGGHPQHRCGFCYLGCKHGIKQGSVNNWFRDAAA<br>HGSQFMQQVRVLQILNKKGIAYGILCEDVVTGAKFTITGPKKF<br>VVAAGALNTPSVLVNSGFKNKNIGKNLTLHPVSVVFGDFGKD<br>VQADHFHNSIMTALCSEAADLDGKGHGCRIETILNAPFIQASF<br>LPWRGSNEARRDLLRYNNMVAMLLLSRDTTSGSVSAHPTKP<br>EALVVEYDVNKFDRNSILQALLVTADLLYIQGAKRILSPQAW<br>VPIFESDKPKDKRSIKDEDYVEWRAKVAKIPFDTYGSPYGSAH<br>QMSSCRMSGKGPKYGAVDTDGRLFECSNVYVADASLLPTAS<br>GANPMVTTMTLARHVALGLADSLKTKAKL |

| SEQ ID NO: | Description | Sequence |
|---|---|---|
| SEQ ID NO: 8 | FAO-2a(fatty alcohol oxidase activity) C. Tropicalis Nuc. Seq | atgaataccttcttgccagacgtgctcgaatacaaacacgtcgacacccttttgttattgtgtgacgg gatcatccacgaaaccacagtcgatcagatcaaggacgccattgctcccgacttccctgaggacc agtacgaggagtatctcaagaccttcaccaagccatctgagaccctgggttcagagaagccgtc tacgacacgatcaacgccaccccaaccgatgccgtgcacatgtgtattgtcttgaccaccgcattg gactccagaatcttggccccccacgttgaccaactcgttgacgcctatcaaggatatgaccttgaag gagcgtgaacaattgttggcctcttggcgtgattccccgattgcggcaaagagaagattgttcagat tgatttcctcgcttaccttgacgacgtttacgagattggccagcgaattgcacttgaaagcatccac taccctggcagagacttgcgtgaaaaggcgtatgaaacccaggtggttgacccttcaggtacctg tttatggagaaaacaaagtttgacggcgcgaattgtacttgccagatatcgacgtcatcatcattgg atcaggcgccggtgctggtgtcatgggccacactctcgccaacgacgggttcaagaccttggtttt ggaaaagggaaagtatttcagcaactccgagttgaactttaatgacgctgatggcgtgaaagagtt gtaccaaggtaaaggtgctttggccaccaccaatcagcagatgtttattcttgccggttccactttgg gcggtggtaccactgtcaactggtctgcttgcctaaaacaccatttaaagtgcgtaaggagtggta cgacgagtttggtcttgaattgctgccgatgaagcctacgacaaagcgcaggattatgtttggaaa caaatgggtgcttcaacagatggaatcactcactccttggccaacgaagttgtggttgaaggaggt aagagttgggctacaagagcaaggaaattgagcagaacaacggtggccaccctgaccaccca tgtggtttctgttacttgggctgtaagtacggtattaaacagggtctgtgaataactggtttagagac gcagctgcccacggtccaagttcatgcaacaagtcagagttgtgcaaatcctcaacaagaatgg cgtcgcttatggtatcttgtgtgaggatgtcgaaaccggagtcaggttcactattagtggcccaaa aagtttgttgtttctgctggttctttgaacacgccaactgtgttgaccaactccggattcaagaacaag cacattggtaagaacttgacgttgcacccagtttccaccgtgtttggtgactttggcagagacgtgc aagcccgaccattttccacaaatctattatgacttcgctttgttacgaggttgctgacttggacggcaag ggccacggatgcagaatcgaaaccatcttgaacgctccattcatccaagcttcttttgttgccatgga gaggaagtgacgaggtcagaagagacttgttgcgttacaacaacatggtggccatgttgcttatca cgcgtgataccaccagtggttcagtttctgctgatgccccaaagaagcccgacgcttttgattgtcgacta tgagattaacaagtttgacaagaatgccatcttgcaagctttcttgatcacttccgacatgttgtacatt gaaggtgccaagagaatcctcagtccacagccatgggtgccaatctttgagtcgaacaagccaaa ggagcaagaacgatcaaggacaaggactatgttgagtgagagccaaggctgctaagtacct ttcgacacctacggttctgcatatgggtccgcacatcaaatgtccacctgtcgtatgtccggaaagg gtcctaaatacggtgctgttgatactgatggtagattgtttgaatgttcgaatgttctatgttgctgatgct agtgttttgcctactgccagcggtgccaacccaatgatatccaccatgaccttgctagacagattgc gttaggtttggctgactccttgaagaccaaacccaagttgtag |
| SEQ ID NO: 9 | FAO-2a(fatty alcohol oxidase activity) C. Tropicalis A.A. Seq | MNTFLPDVLEYKHVDTLLLLCDGIIHETTVDQIKDAIAPDFPE DQYEEYLKTFTKPSETPGFREAVYDTINATPTDAVHMCIVLTT ALDSRILAPTLTNSLTPIKDMTLKEREQLLASWRDSPIAAKRR LFRLISSLTLTTFTRLASELHLKAIHYPGRDLREKAYETQVVDP FRYSFMEKPKFDGAELYLPDIDVIIIGSGAGAGVMAHTLANDG FKTLVLEKGKYFSNSELNFNDADGVKELYQGKGALATTNQQ MFILAGSTLGGGTTVNWSACLKTPFKVRKEWYDEFGLEFAA DEAYDKAQDYVWKQMGASTDGITHSLANEVVVEGGKKLGY KSKEIEQNNGGHPDHPCGFCYLGCKYGIKQGSVNNWFRDAA AHGSKFMQQVRVVQILNKNGVAYGILCEDVETGVRFTISGPK KFVVSAGSLNTPTVLTNSGFKNKHIGKNLTLHPVSTVFGDFGR DVQADHFHKSIMTSLCYEVADLDGKGHGCRIETILNAPFIQAS LLPWRGSDEVRRDLLRYNNMVAMLLITRDTTSGSVSADPKKP DALIVDYEINKFDKNAILQAFLITSDMLYIEGAKRILSPQPWVP IFESNKPKEQRTIKDKDYVEWRAKAAKIPFDTYGSAYGSAHQ MSTCRMSGKGPKYGAVDTDGRLFECSNVYVADASVLPTASG ANPMISTMTFARQIALGLADSLKTKPKL |
| SEQ ID NO: 10 | FAO-2b(fatty alcohol oxidase activity) C. Tropicalis Nuc. Seq | atgaataccttcttgccagacgtgctcgaatacaaacacgtcgatacccttttgttattatgtgacggg atcatccacgaaaccacagtcgaccagatcagggacgccattgctcccgacttccctgaagacca gtacgaggagtatctcaagaccttcaccaagccatctgagaccctgggttcagagaagcctgtct acgacacgatcaacagcacccccaaccgaggcgtgcacatgtgtattgtattgaccaccgcattgg actcgagaatcttggccccacgttgaccaactcgttgacgcctatcaaggatatgaccttgaaag agcgtgaacaattgttggctgcctggcgtgattccccgatcgcggccaagagaagattgttcagat tgatttcctcacttaccttgacgacctttacgagattggccagcgacttgcacttgagagccatccac taccctggcagagacttgcgtgaaaaggcatatgaaacccaggtggttgacccttcaggtacctg tttatggaaaaaccaaagtttgacggcaccgagttgtacttgccagatatcgacgtcatcatcattgg atccggtgccggtgctggtgtcatgggccacactttagccaacgacgggtacaagaccttggtttt ggaaaagggaaagtatttcagcaactccgagttgaactttaatgatgccgatggtatgaaagagttg taccaaggtaaatgtgcgttgaccaccacgaaccagcagatgtttattcttgccggttccactttggg cggtggtaccactgttaactggtctgcttgtcttaaaacaccatttaaagtgcgtaaggagtggtacg acgagtttggtcttgaattgctgccgacgaagcctacgacaaagcacaagactatgtttggaaaca aatgggcgcttctaccgaaggaatcactcactccttggcgaacgcggttgtggttgaaggaggtaa gaagttgggttacaagagcaaggaaatcgagcagaacaatggtggccatcctgaccaccctgt ggtttctgttacttgggctgtaagtacggtattaagcagggttctgtgaataactggtttagagacgca gctgcccacggtccaagttcatgcaacaagtcagagttgtgcaaatcctccacaatcaaaggcgtc gcttatggcatcttgtgtgaggatgtcgagaccggagtcaaattcactatcagtggcccaaaaagt tgttgtttctgcaggttcttttgaacacgccaacggtgttgaccaactccggattcaagaacaaacac atcggtaagaacttgacgttgcacccagtttcgaccgtgtttggtgactttggcagagacgtgcaag ccgaccattttccacaaatctattatgacttcgctctgttacgaagtcgctgacttggacggcaaggg ccacggatgcagaatcgagaccatcttgaacgctccattcatccaagcttcttttgttgccatggaga |

| SEQ ID NO: | Description | Sequence |
|---|---|---|
| | | ggaagcgacgaggtcgaagagacttgttgcgttacaacaacatggtggccatgttgcttatcacc cgtgacaccaccagtggttcagtttctgctgacccaaagaagcccgacgctttgattgtcgactatg acatcaacaagtttgacaagaatgccatcttgcaagctttcttgatcacctccgacatgttgtacatcg aaggtgccaagagaatcctcagtccacaggcatgggtgccaatctttgagtcgaacaagccaaag gagcaaagaacaatcaaggacaaggactatgtcgaatggagagccaaggctgccaagatacctt tcgacacctacggttctgcctatgggtccgcacatcaaatgtccacctgtcgtatgtccggaaagg gtcctaaatacggcgccgttgataccgatggtagattgtttgaatgttcgaatgtctatgttgctgatg ctagtgttttgcctactgccagcggtgccaacccaatgatctccaccatgacgtttgctagacagatt gcgttaggtttggctgactcttttgaagaccaaacccaagttgtag |
| SEQ ID NO: 11 | FAO-2b (fatty alcohol oxidase activity) C. Tropicalis A.A. Seq | MNTFLPDVLEYKHVDTLLLLCDGIIHETTVDQIRDAIAPDFPE DQYEEYLKTFTKPSETPGFREAVYDTINSTPTEAVHMCIVLTT ALDSRILAPTLTNSLTPIKDMTLKEREQLLAAWRDSPIAAKRR LFRLISSLTLTTFTRLASDLHLRAIHYPGRDLREKAYETQVVDP FRYSFMEKPKFDGTELYLPDIDVIIIGSGAGAGVMAHTLANDG YKTLVLEKGKYFSNSELNFNDADGMKELYQGKCALTTTNQQ MFILAGSTLGGGTTVNWSACLKTPFKVRKEWYDEFGLEFAA DEAYDKAQDYVWKQMGASTEGITHSLANAVVVEGGKKLGY KSKEIEQNNGGHPDHPCGFCYLGCKYGIKQGSVNNWFRDAA AHGSKFMQQVRVVQILHNKGVAYGILCEDVETGVKFTISGPK KFVVSAGSLNTPTVLTNSGFKNKHIGKNLTLHPVSTVFGDFGR DVQADHFHKSIMTSLCYEVADLDGKGHGCRIETILNAPFIQAS LLPWRGSDEVRRDLLRYNNMVAMLLITRDTTSGSVSADPKKP DALIVDYDINKFDKNAILQAFLITSDMLYIEGAKRILSPQAWV PIFESNKPKEQRTIKDKDYVEWRAKAAKIPFDTYGSAYGSAH QMST |
| SEQ ID NO: 12 | FAO-18 (fatty alcohol oxidase activity) C. Tropicalis Nuc. Seq | atggctccattttgcccgaccaggtcgactacaaacacgtcgacacccttatgttattatgtgacgg gatcatccacgaaaccaccgtggacgaaatcaaagacgtcattgcccctgacttcccgccgaca aatacgaggagtacgtcaggacattcaccaaacccatccgaaacccagggttcagggaaaccgt ctacaacaccgtcaacgcaaacaccattggatgcaatccaccagttcattatcttgaccaatgttttgg gatcaagggtcttggcaccagctttgaccaactcgttgactcctatcaaggacatgagcttggaag accgtgaaaagttgttagcctcgtggcgtgactccccattgctgctaaaaggaagttgttcaggttg gtttctacgcttaccttggtcacgttcacgagattggccaatgagttgcatttgaaagccattcattatc caggaagagaagaccgtgaaaaggcttatgaagtaccgagttgaccctttaagtacgagtttt ggaaaaaccgaagttttacggcgctgagttgtacttgccagatattgatgtgatcattattggatctg gggccggtgctggtgtcgtggcccacacttttgaccaacgacggcttcaagagtttggttttggaaa agggcagatactttagcaactccgagttgaactttgatgacaaggacggggttcaagaattatacc aaagtggatactttgaccaccgtcaaccagcagttgtttgttcttgctggttccacttttggtggtg gtaccactgtcaattggtcggcctgtcttaaaacgccattccaaggtgcgtaaggaatggtatgatga gtttggcgttgacttgtgctgccgatgaagcctacgacaaagcacaggattatgtttggcagcaaatg ggagcttctaccgaaggcatcacccactctttggctaacgagattattattgaaggtggcaagaaat taggttacaaggccaagttattagaccaaaacagcggtggtcatcctcatcacagatgcgttttct gttatttgggttgtaagcacggtatcaagcagggctctgttaataactggtttagagacgcagctgcc cacggttctcagttcatgcaacaggttagagttttgcaaatccttaacaagaagggcatcgcttatgg tatcttgtgtgaggatgttgtaaccggtgccaagttcaccattactggccccaaaaagtttgttgttgc cgccggcgccttaaacactccatctgtcgttgtcaactccggattcaagaacaagaacatcggtaa gaacttaactttgcatccagtttctgtcgtgtttggtgattttggcaaagacgttcaagcagatcacttc cacaactccatcatgactgctctttgttcagaagccgctgatttagacggcaagggtcatggatgca gaattgaaaccatcttgaacgctccattcatccaggcttcattcttaccatggagaggtagtaacgag gctagacgagacttgttgcgttacaacaacatggtggccatgttacttcttagttgcgatgataccaccag tggttccgttcgtcccatccaactaaacctgaagcattagttgtcgagtacgacgtgaacaagtttg acagaaactccatcttgcaggcattgttggtcactgctgacttgttgtacattcaaggtgccaagaga atccttagtccccaaccatgggtgccaattttttgaatccgacaagccaaggataagagatcaatca aggacgaggactatgtcgaattggagagccaaggttgccaagattccttttgacacctacggctcg ccttatggttcggcgcatcaaatgtcttcttgtcgtatgtcaggtaagggtcctaaatacggtgctgtt gataccgatggtagattgtttgaatgttcgaatgtttatgttgctgacgctagtctttttgccaactgcta gcggtgctaatcctatggtcaccaccatgactcttgcaagacatgttgcgttaggtttggcagactcc ttgaagaccaaggccaagttgtag |
| SEQ ID NO: 13 | FAO-1 (fatty alcohol oxidase activity) C. Tropicalis A.A. Seq | MAPFLPDQVDYKHVDTLMLLCDGIIHETTVDEIKDVIAPDFPA DKYEEYVRTFTKPSETPGFRETVYNTVNANTMDAIHQFIILTN VLGSRVLAPALTNSLTPIKDMSLEDREKLLASWRDSPIAAKRK LFRLVSTLTLVFTTRLANELHLKAIHYPGREDREKAYETQEID PFKYQFLEKPKFYGAELYLPDIDVIIIGSGAGAGVVAHTLTND GFKSLVLEKGRYFSNSELNFDDKDGVQELYQSGGTLTTVNQQ LFVLAGSTFGGGTTVNWSACLKTPFKVRKEWYDEFGVDFAA DEAYDKAQDYVWQQMGASTEGITHSLANEIIIEGGKKLGYKA KVLDQNSGGHPHHRCGFCYLGCKHGIKQGSVNNWFRDAAA HGSQFMQQVRVLQILNKKGIAYGILCEDVVTGAKFTITGPKKF VVAAGALNTPSVLVNSGFKNKNIGKNLTLHPVSVVFGDFGKD VQADHFHNSIMTALCSEAADLDGKGHGCRIETILNAPFIQASF LPWRGSNEARRDLLRYNNMVAMLLLSRDTTSGSVSSHPTKPE ALVVEYDVNKFDRNSILQALLVTADLLYIQGAKRILSPQPWV PIFESDKPKDKRSIKDEDYVEWRAKVAKIPFDTYGSPYGSAHQ |

| SEQ ID NO: | Description | Sequence |
|---|---|---|
| | | MSSCRMSGKGPKYGAVDTDGRLFECSNVYVADASLLPTASG<br>ANPMVTTMTLARHVALGLADSLKTKAKL |
| SEQ ID NO: 14 | cytochrome P450 A12 (CYP52A12) Nuc. Seq | atggccacacaagaaatcatcgattctgtacttccgtacttgaccaaatggtacactgtgattactgc<br>agcagtattagtcttccttatctccacaaacatcaagaactacgtcaaggcaaagaaattgaaatgtg<br>tcgatccaccatacttgaaggatgccggtctcactggtattctgtctttgatcgccgccatcaaggcc<br>aagaacgacggtagattggctaactttgccgatgaagttttcgacgagtacccaaaccacaccttct<br>acttgtctgttgccggtgctttgaagattgtcatgactgttgacccagaaaacatcaaggctgtcttgg<br>gccacccaattcactgacttctccttgggtaccagacacgcccactttgctccttttgttgggtgacggt<br>atcttcaccttggacggagaaggttgaagcactccagagctatgttgagaccacagtttgctaga<br>gaccagattggacacgttaaagccttggaaccacacatccaaatcatggctaagcagatcaagttg<br>aaccagggaaagactttcgatatccaagaattgttctttagatttaccgtcgacaccgctactgagtt<br>cttgtttggtgaatccgttcactccttgtacgatgaaaaattgggcatcccaactccaaacgaaatcc<br>caggaagagaaaactttgccgctgctttcaacgtttcccaacactacttggccaccagaagttactc<br>ccagacttttttacttttgaccaaccctaaggaattcagagactgtaacgccaaggtccaccacttgg<br>ccaagtactttgtcaacaaggccttgaactttactcctgaagaactcgaagagaaatccaagtccgg<br>ttacgttttcttgtacgaattggttaagcaaaccagagatccaaaggtcttgcaagatcaattgttgaa<br>cattatggttgccggaagagacaccactgccggtctgcttgttgtccttttgcttttgtttgaattggctagaca<br>cccagagatgtggtccaagttgagagaagaaatcgaagttaacttggtgttggtgaagactcccg<br>cgttgaagaaattacctcgaagccttgaagagatgtgaatacttgaaggctatccttaacgaaacct<br>tgcgtatgtacccatctgttcctgtcaactttagaaccgccaccagagacaccacttgtgccaagag<br>gtggtggtgctaacggtaccgacccaatctacattcctaaaggctccactgttgcttacgttgtctaca<br>agacccaccgtttggaagaatactacgctaaggacgctaacgacttcagaccagaaagatggttt<br>gaaccatctactaagaagtgggctgggcttatgttccattcaacggtggtccaagagtctgcttgg<br>gtcaacaattcgccttgactgaagcttcttatgtgatcactagattggcccagatgtttgaaactgtct<br>catctgatccaggtctcgaataccctccaccaaagtgtattcacttgaccatgagtcacaacgatgg<br>tgtctttgtcaagatgtaa |
| SEQ ID NO: 15 | cytochrome P450 A13 (CYP52A13) Nuc. Seq | atgactgtacacgatattatcgccacatacttcaccaaatggtacgtgatagtaccactcgctttgatt<br>gcttatagagtcctcgactacttctatgagcagatacttgatgtacaagcttggtgctaaaccattttcc<br>agaaacagacagacggctgtgtttcggattcaaagctccgcttgaattgttgaagaagaagagcga<br>ggtaccctcatagacttcacactccagcgtatccacgatctcgatcgtcccgatatcccaactttcac<br>attcccggtcttttccatcaaccttgtcaataccttgagccggagaacatcaaggccatcttggcca<br>ctcagttcaacgatttctccttgggtaccagacactcgcactttgctccttttgttgggtgatggtatcttt<br>acgttggatggcgccggctggaagcacagccagatctatgttgagaccacagtttgccagagaaca<br>gatttccccacgtcaagttgttggagccacacgttcaggtgttcttcaaacacgtcagaaaggcacag<br>ggcaagacttttgacatccaggaattgttttcagattaccgtcgactccgccaccgagttttttgtttg<br>gtgaatccgttgagtccttgagagatgaatctatcggcatgtccatcaatgcgcttgactttgacggc<br>aaggctggcttttgctgatgcttttaactattcgcagaattatttggcttcgagagcggttatgcaacaa<br>ttgtactgggtgttgaacgggaaaaagtttaaggagtgcaacgctaaagtgcacaagtttgctgact<br>actacgtcaacaaggctttggacttgacgcctgaacaattggaaaagcaggatggttatgtgttttg<br>tacgaattggtcaagcaaaccagagacaagcaagtgttgagagaccaattgttgaacatcatggtt<br>gctggtagagacaccaccgccggtttgttgtcgttttgttttcttttgaattggccagaaacccagaagtt<br>accaacaagttgagagaagaaattgaggacaagtttggactcggtgagaatgctagtgttgaaga<br>catttcctttgagtcgttgaagtcctgtgaatacttgaaggctgttctcaacgaaacctttgagattgtac<br>ccatccgtgccacagaattcagagttgccaccaagaacactaccctcccaagaggtggtggtaa<br>ggacggggttgtctcctgttttggtgagaaagggtcagaccgtcgttatttacggtgtctacgcagcccac<br>agaaacccagctgtttacggtaaggacgctcttgagtttagaccagagagatggttgagccagag<br>acaaagaagcttggctgggccttcctcccattcaacggtggtccaagaatctgtttgggacagcag<br>tttgccttgacagaagcttcgtatgtcactgtcaggttgctccaggagtttgcacacttgtctatggac<br>ccagacaccgaatccacctaagaaaatgtcgcatttgaccatgtcgctttcgacggtgccaata<br>ttgagatgtattag |
| SEQ ID NO: 16 | cytochrome P450 A14 (CYP52A14) Nuc. Seq | atgactgcacaggatattatcgccacatacatcaccaaatggtacgtgatagtaccactcgctttgat<br>tgcttataggtcctcgactacttacggcagatacttgatgtacaagcttggtgctaaaccgtttttc<br>cagaaaacagacggtctatttcggattcaaagctccacttgaattgttaaaaagaagagtgac<br>ggtaccctcatagacttcactctcgagcgtatccaagcgctcaatcgtccagatatcccaactttttac<br>attcccaatcttttccatcaaccttatcagcacccttgagccggagaacatcaaggctatcttggcca<br>cccagttcaacgattctccttgggcaccagacactcgcactttgctccttttgttgggcgatggtatct<br>ttacctggacggtgccggctggaagcacagccagatctatgttgagaccacagtttgccagagaa<br>cagatttccccacgtcaagttgttggagccacacatgcaggtgttcttcaagcacgtcagaaaggca<br>cagggcaagacttttgacatccaagaattgttttcagattaccgtcgactccgccactgagttttg<br>tttggtgaatccgttgagtccttgagagatgaatctattgggatgtccatcaatgcacttgactttgac<br>ggcaaggctggctttgctgatgcttttaactactcgcagaactatttggcttcgagagcggttatgca<br>acaattgtactgggtgttgaacgggaaaagttttaaggagtgcaacgctaaagtgcacaagtttgct<br>gactattacgtcagcaaggctttggacttgacacctgaacaattggaaaagcaggatggttatgtgt<br>tcttgtacgagttggtcaagcaaaccagagacaggcaagtgttgagagaccagttgttgaacatca<br>tggttgccggtagagacaccaccgccggtttgttgtcgtttgtttctttgaattggccagaaaccca<br>gaggtgaccaacaagttgagagaagaaatcgaggacaagtttggtcttggtgagaatgctcgtgtt<br>gaagcatttcctttgagtcgttgaagtcatgtgaatacttgaaggctgttctcaacgaaacctttgaga<br>ttgtacccatccgtgccacagaatttcagagttgccaccaaaaacactaccttccaagggaggt<br>ggtaaggacgggtatctcctgttttggtcagaaagggtcaaaccgttatgtacggtgtctacgctg<br>cccacagaaacccagctgtctacggtaaggacgcccttgagtttagaccagagaggtggtttgag<br>ccagacaaagaagcttggctgggccttcctccattcaacggtggtccaagaatttgcttggga<br>cagcagtttgccttgacagaagcttcgtatgtcactgtcagattgctccaagagtttggacacttgtct |

| SEQ ID NO: | Description | Sequence |
|---|---|---|
| | | atggacccaacaccgaatatccacctaggaaaatgtcgcatttgaccatgtccctttttcgacggtg ccaacattgagatgtattag |
| SEQ ID NO: 17 | cytochrome P450 A15 (CYP52A15) Nuc. Seq | atgtcgtcttctccatcgtttgcccaagaggttctcgctaccactagtccttacatcgagtactttcttg acaactacaccagatggtactacttcataccctttggtgcttctttcgttgaacttttataagtttgctccac acaaggtacttggaacgcaggttccacgccaagccactcggtaacttttgtcagggaccctacgttt ggtatcgctactccgttgcttttgatctacttgaagtcgaaaggtacgtgtcatgaagtttgcttgggcc ctctggaacaacaagtacatcgtcagagacccaaagtacaagacaactgggctcaggattgttgg cctcccattgattgaaaccatggacccagagaacatcaaggctgttttggctactcagttcaatgatt tctctttgggaaccagacacgattcttgtactcttgttgggtgacggtattttcaccttggacggtgc tggctgaaacatagtagaactatgttgagaccacagtttgctagagaacaggtttctcacgtcaag ttgttggagccacacgttcaggtgttcttcaagcacgttagaaagcaccgcggtcaaacgttcgac atccaagaattgttcttcaggttgaccgtcgactccgccaccgagttcttgtttggtgagtctgctgaa tccttgagggacgaatctattggattgaccccaaccaccaaggattttcgatggcagaagagatttc gctgacgctttcaactattcgcagacttaccaggcctacagattttttgttgcaacaaatgtactggatc ttgaatggctcggaattcagaaagtcgattgctgtcgtcacaagtttgctgaccactatgtgcaaaa ggcttggagttgaccgacgatgacttgcagaaacaagacggctatgtgttcttgtacgagttggct aagcaaaccagagacccaaaggtcttgagagaccagttattgaacattttggttgccggtagagac acgaccgccggtttgttgtcatttgttttctacgagttgtcaagaaaccctgaggtgtttgctaagttga gagaggaggtggaaaacagatttggactcggtgaagaagctcgtgttgaagagatctcgtttgagt ccttgaagtcttgtgagtacttgaaggctgtcatcaatgaaaccttgagattgtacccatcggttccac acaactttagagttgctaccagaaactaccctcccaagaggtggtggtgaagatggatactcgc caattgtcgtcaagaagggtcaagttgtcatgtacactgttattgctacccacagagacccaagtatc tacggtgccgacgctgacgtcttcagaccagaaagatggtttgaaccagaaactagaaagttggg ctgggcatacgttccattcaatggtggtccaagaatctgtttgggtcaacagtttgccttgaccgaag cttcatacgtcactgtcagattgctccaggagtttgcacacttgtctcatggacccagacaccgaatat ccaccaaaattgcagaacaccttgaccttgtcgctctttgatggtgctgatgttagaatgtactaa |
| SEQ ID NO: 18 | cytochrome P450 A16 (CYP52A16) Nuc. Seq | atgtcgtcttctccatcgtttgctcaggaggttctcgctaccactagtccttacatcgagtactttcttga caactacaccagatggtactacttcatcccctttggtgcttcttcgttgaacttcatcagcttgctccac acaaagtacttggaacgcaggttccacgccaagccgctcggtaacttcgtcgtgttggatcctacgtt ggtatcgctactccgttgatcttgatctacttaaagtcgaaaggtacagtcatgaagtttgcctggag cttctgaacaacaagtacattgtcaaagacccaaagtacaagaccactggccttagaattgtcgg cctcccattgattgaaaccatagacccagagaacatcaaagctgtgttggctactcagttcaacgat ttctccttgggaactagacacgattcttgtgtactcctgtttgggcgatggtattttttaccttggacggtg ctggctggaaacacagtagaactatgttgagaccacagtttgctagagaacaggttttcccacgtca agttgttggaaccacacgttcaggtgttcttcaagcacgttagaaaacaccgcggtcagactttga catccaagaattgttcttcagattgaccgtcgactccgccaccgagttcttgtttggtgagtctgctga atccttgagagacgactctgttggtttgaccccaaccaccaaggattttcgaaggcagaagagattt cgctgacgctttcaactactcgcagacttaccaggcctacagattttttgttgcaacaaatgtactgga ttttgaatggcgcggaattcagaaagtcgattgccatcgtgcacaagtttgctgaccactatgtgcaa aaggcttggagttgaccgacgatgacttgcagaaacaagacggctatgtgttcttgtacgagttgg ctaagcaaactagagacccaaaggtcttgagagaccagttgttgaacattttggttgccggtagag acacgaccgccggtttgttgtcgtttgtgttctacgagttgtcgagaaaccctgaagtgtttgccaag ttgagagaggaggtggaaaacagatttggactcggcgaagaggctcgtgttgaagagatctcttttt gagtccttgaagtcctgtgagtacttgaaggctgtcatcaatgaagcttgagattgtacccatctgtt ccacacaacttcagagttgccaccagaaactacccttccaagaggcggtggtaaagacggat gctcgccaattgttgtcaagaagggtcaagttgtcatgtacactgtcattggtacccacagagaccc aagtatctacggtgccgacgccgacgtcttcagaccagaaagatggtcgagccagaaactagaa agttgggctgggcatatgttccattcaatggtggtccaagaatctgtttgggtcagcagtttgccttga ctgaagcttcatacgtcactgtcagattgctccaagagtttggaaacttgtccctggatccaaacgct gagtacccaccaaaattgcagaacaccttgaccttgtcactctttgatggtgctgacgttagaatgtt ctaa |
| SEQ ID NO: 19 | cytochrome P450 A17 (CYP52A17) Nuc. Seq | atgattgaacaactcctagaatattggtatgtcgttgtgccagtgttgtacatcatcaaacaactccttg catacacaaagactcgcgtcttgatgaaaaagtttgggtgctgctccagtcacaaacaagttgtacg acaacgcttcggtatcgtcaatggatggaaggctctccagttcaagaaagagggcagggctcaa gagtacaacgattacaagtttgaccactcaagaacccaagcgtgggcacctacgtcagtattcttt tcggcaccaggatcgtcgtgaccaaagatccagagaatatcaaagctatttttggcaacccagttg gtgattttctcttgggcaagaggcacactcttttttaagcctttgttaggtgatggatcttcacattgga cggcgaaggctggaagcacagcagagccatgttgagaccacagtttgccagagaacaagttgct catgtgacgctcgttggaaccacacttccagttgttgaagaagcatattcttaagcacaagggtaat actttgatatccaggaattgttctttagatttaccgttgattcggccacggagttcttattcggtgagtcc gtgcactccttaaaggacgaatctattggtatcaaccaagacgatatagattttgctggtagaaagg acttttgctgagtcgttcaacaaagcccaggaatacttggctattagaaccttggtgcagacgttctac tggttggtcaacaacaaggagtttagagactgtaccaagctggtgcacaagttcaccaactactatg ttcagaaagctttggatgctagcccagaagagcttgaaaagcaaagtgggtatgtgttcttgtacga gcttgtcaagcagacaagagacccaatgttgcgtgaccagtcttgaacatcttgttggccgga agagacaccactgctgggttgttgtcgtttgctgtctcttttgagttggccagacacccagagatctggg ccaagttgagagaggaaattgaacaacagtttggaagacttcgtgttgaagagattac ctttgagagcttgaagagatgtgagtacttgaaagcgttccttaatgaaaccttgcgtatttacccaa gtgtcccaagaaacttcagaatcgccaccaagaacacgcattgccaaggggcggtggttcaga cggtacctcgccaatcttgatccaaaaggagaagctgtgtcgtatggtatcaactctactcatttgg accctgtctattacggccctgatgctgctgagttcagaccagagagatgggttgagccatcaaccaa aaagctcggctgggcttacttgccattcaacggtggtccaagaatctgtttgggtcagcagtttgcct |

| SEQ ID NO: | Description | Sequence |
|---|---|---|
| | | tgacggaagctggctatgtgttggttagattggtgcaagagttctcccacgttaggctggacccaga cgaggtgtacccgccaaagaggttgaccaacttgaccatgtgtttgcaggatggtgctattgtcaa gtttgactag |
| SEQ ID NO: 20 | cytochrome P450 A18 (CYP52A18) Nuc. Seq | atgattgaacaaatcctagaatattggtatattgttgtgcctgtgttgtacatcatcaaacaactcattg cctacagcaagactcgcgtcttgatgaaacagttgggtgctgctccaatcacaaaccagttgtacg acaacgttttcggtatcgtcaacggatggaaggctctccagttcaagaaagagggcagagctcaa gagtacaacgatcacaagtttgacagctccaagaacccaagcgtcggcacctatgtcagtattcttt ttggcaccaagattgtcgtgaccaaggatccagagaatatcaaagctattttggcaacccagtttgg cgattttcttgggcaagagacacgctcttttttaaaccttttgttaggtgatgggatcttcaccttggac ggcgaaggctggaagcatagcagatccatgttaagaccacagtttgccagagaacaagttgctca tgtgacgtcgttggaaccacacttccagttgttgaagaagcatatccttaaacacaagggtgagtac tttgatatccaggaattgttctttagatttactgtcgactcggccacggagttcttatttggtgagtccgt gcactccttaaaggacgaaactatcggtatcaaccaagacgatatagattttgctggtagaaagga ctttgctgagtcgttcaacaaagcccaggagtatttgtctattagaattttggtgcagaccttctactgg ttgatcaacaacaaggagtttagagactgtaccaagctggtgcacaagtttaccaactactatgttca gaaagctttggatgctaccccagaggaacttgaaaagcaaggcgggtatgtgttcttgtatgagctt gtcaagcagacagacgagaccccaaggtgttgcgtgaccagtctttgaacatcttgttggcaggaag agacaccactgctgggttgttgtcctttgctgtgtttgagttggccagaaacccacacatctgggcc aagttgagagaggaaattgaacagcagtttggtcttggagaagactctcgtgttgaagagattacct tgagagcttgaagagatgtgagtacttgaaagcgttccttaacgaaaccttgcgtgtttacccaagt gtcccaagaaacttcagaatcgccaccaagaataacaattgccaaggggtggtggtccagacg gtacccagccaatcttgatccaaaagggagaaggtgtgtcgtatggtatcaactctacccacttaga tcctgtctattatgccctgatgctgctgagtcagaccagagagatggtttgagccatcaaccaga aagctcggctgggcttacttgccattcaacgtgggccacgaatctgtttgggtcagcagtttgcctt gaccgaagctggttacgttttggtcagattggtgcaagagttctcccacattaggctggacccagat gaagtgtatccaccaaagaggttgaccaacttgaccatgtgtttgcaggatggtgctattgtcaagtt tgactag |
| SEQ ID NO: 21 | cytochrome P450 A19 (CYP52A19) Nuc. Seq | atgctcgatcagatcttacattactggtacattgtcttgccattgttggccattatcaaccagatcgtgg ctcatgtcaggaccaattatttgatgaagaaatttgggtgctaagccattcacacacgtccaacgtga cgggtggtttgggcttcaaattcggccgtgaattcctcaaagcaaaaagtgctgggagactggttga tttaatcatctcccgtttccacgataatgaggacactttctccagctatgcttttggcaaccatgtggtg ttcaccagggaccccgagaatatcaaggcgcttttggcaacccagtttggtgattttttcattgggca gcagggtcaagttcttcaaaccattattggggtacggtatcttcacattggacgcgcaaggctgaa gcacagcagagccatgttgagaccacagtttgccagagaacaagttgctcatgtgacgtcgttgg aaccacacttccagttgttgaagaagcatatccttaaacacaagggtgagtactttgatatccagga attgttctttagatttactgtcgactcggccacggagttcttatttggtgagtccgtgcactccttaaaag gacgaggaaattggctacgacacgaaagacatgtctgaagaaagacgcagatttgccgacgcgt tcaacaagtcgcaagtctacgtggccaccagagttgctttacagaacttgtactggttggtcaacaa caaagagttcaaggagtgcaatgacattgtccacaagtttaccaactactatgttcagaaagccttg gatgctaccccagaggaacttgaaaagcaaggcgggtatgtgttcttgtatgagcttgtcaagcag acgagagaccccaaggtgttgcgtgaccagtctttgaacatcttgttggcaggaagagagacaccact gctgggttgttgtcctttgctgtgtttgagttggccagaaacccacacatctgggccaagttgagag aggaaattgaacagcagtttggtcttggagaagactctcgtgttgaagagattacctttgagagcttg aagagatgtgagtacttgaaggccgtgttgaacgaaactttgagattacacccaagtgtcccaaga aacgcaagatttgcgattaaagacacgactttaccaagaggcggtggccccaacggcaaggatc ctatcttgatcaggaaggatgaggtggtgcaatactccatctcggcaactcagacaaatcctgctta ttatggcgccgatgctgctgattttagaccggaaagatggtttgaaccatcaactagaaacttgggca tgggctttcttgccattcaacggtggtccaagaatctgtttgggacaacagtttgctttgactgaagcc ggttacgttttggttagacttgttcaggagttcgaaacttgtcacaagaccccgaaaccaagtaccc accacctagattggcacacttgacgatgtgcttgtttgacggtgcacacgtcaagatgtcatag |
| SEQ ID NO: 22 | cytochrome P450 A20 (CYP52A20) Nuc. Seq | atgctcgaccagatcttccattactggtacattgtcttgccattgttggtcattatcaagcagatcgtgg ctcatgccaggaccaattatttgatgaagaagtttgggcgctaagccattcacacatgtccaactaga cgggtggtttgggcttcaaatttggccgtgaattcctcaaagctaaaagtgctgggaggcaggttgat ttaatcatctcccgtttccacgataatgaggacacttctccagctatgcttttggcaaccatgtggtgt tcaccagggaccccgagaatatcaaggcgctttttggcaacccagtttggtgattttttcattgggaag cagggtcaaattcttcaaaccattgttggggtacggtatcttcacctttgacgggcgaaggctgaa gcacagcagagccatgttgagaccacagtttgccagagaacaagttgctcatgtgacgtcgttgg aaccacatttccagttgttgaagaagcatattcttaagcacaagggtgaatactttgatatccaggaa ttgttctttagatttaccgttgattcagcgacggagttcttatttggtgagtccgtgcactccttaagggg acgaggaaattggctacgataagaaggacatggctgaagaaagacgcaaatttgccgacgcgtt caacaagtcgcaagtctatttgtccaccagagttgctttacagacattgtactggttggtcaacaaca aagagttcaaggagtgcaacgacattgtccacaagttcaccaactactatgttcagaaagccttgg atgctaccccagaggaacttgaaaacaaggcgggtatgtgttcttgtacgagcttgccaagcaga cgaaagaccccaatgtgttgcgtgaccagtctttgaacatcttgttggctggaagggacaccactg ctgggttgttgtcctttgctgtgtttgagttggccagaaccccacacatctgggccaagttgagaga ggaaattgaatcacactttgggctgggtgaggactctcgtgttgaagagattaccttgagagcttg aagagatgtgagtacttgaaagccgtgttgaacgaaacgttgagattacacccaagtgtcccaaga aacgcaagatttgcgattaaagacacgactttaccaagaggcggtggccccaacggcaaggatc ctatcttgatcagaaagaatgaggtggtgcaatactccatctcggcaactcagacaaatcctgcttat tatggcgccgatgctgctgattttagaccggaaagatggtttgagccatcaactagaaacttgggat gggcttacttgccattcaacggtggtccaagaatctgctttgggacaacagtttgctttgaccgaagc |

| SEQ ID NO: | Description | Sequence |
|---|---|---|
| | | cggttacgttttggttagacttgttcaggaattccctagcttgtcacaggaccccgaaactgagtacc<br>caccacctagattggcacacttgacgatgtgcttgtttgacggggcatacgtcaagatgcaatag |
| SEQ ID NO: 23 | cytochrome P450 D2 (CYP52D2) Nuc. Seq | atggctatatctagtttgctatcgtgggatgtgatctgtgtcgtcttcatttgcgtttgtgtttatttcgggt<br>atgaatattgttatactaaatacttgatgcacaaacatggcgctcgagaaatcgagaatgtgatcaac<br>gatgggttcttttgggttccgcttacctttgctactcatgcgagccagcaatgagggccgacttatcga<br>gttcagtgtcaagagattcgagtcggcgccacatccacagaacaagacattggtcaaccgggcat<br>tgagcgttcctgtgatactcaccaaggacccagtgaatatcaaagcgatgctatcgacccagtttga<br>tgactttccctttggggttgagactacaccagtttgcgccgttgttggggaaaggcatctttactttgga<br>cggcccagagtggaagcagagccgatctatgttgcgtccgcaatttgccaaagatcgggtttctca<br>tatcctggatctagaaccgcatttgtgttgcttcggaagcacattgatggccacaatggagactact<br>tcgacatccaggagctctacttccggttctcgatggatgtggcgacggggttttgtttggcgagtct<br>gtgggtcgttgaaagacgaagatgcgaggttcctggaagcattcaatgagtcgcagaagtatttg<br>gcaactagggcaacgttgcacgagttgtactttcttttgtgacgggtttaggtttcgccagtacaacaa<br>ggttgtgcgaaagttctgcagccagtgtgtccacaaggcgttagatgttgcaccggaagacacca<br>gcgagtacgtgtttctccgcgagttggtcaaacacactcgagatcccgttgttttacaagaccaagc<br>gttgaacgtcttgcttgctggacgcgacaccaccgcgtcgttattatcgtttgcaacatttgagctag<br>cccggaatgaccacatgtgaggaagctacgagaggaggttatcctgacgatgggaccgtccag<br>tgatgaaataaccgtggccgggttgaagagttgccgttacctcaaagcaatcctaaacgaaactctt<br>cgactatacccaagtgtgcctaggaacgcgagatttgctacgaggaatacgacgcttcctcgtggc<br>ggaggtccagatggatcgtttccgattttgataagaaagggccagccagtggggtatttcatttgtg<br>ctacacacttgaatgagaaggtatatgggaatgatgtgtttcgaccggagagatgggctg<br>cgttagagggcaagagtttgggctggtcgtatcttccattcaacggcggcccgagaagcgccttg<br>gtcagcagtttgcaatcctgaagcttcgtatgttttggctcgattgacacagtgctacacgacgata<br>cagcttagaactaccgagtacccaccaaagaaactcgttcatctcacgatgagtcttctcaacggg<br>gtgtacatccgaactagaacttga |
| SEQ ID NO: 24 | cytochrome P450:NADPH P450 reductase (Bacillus megaterium) nucleotide Nuc. Seq | atgacaattaaagaaatgcctcagccaaaaacgtttggagagcttaaaaatttaccgttattaaacac<br>agataaaccggttcaagctttgatgaaaattgcggatgaattaggagaaatctttaaattcgaggcg<br>cctggtcgtgtaacgcgctacttatcaagtcagcgtctaattaaagaagcatgcgatgaatcacgct<br>ttgataaaaacttaagtcaagcgcttaaatttgtacgtgatttttgcaggagacgggttatttacaagct<br>ggacgcatgaaaaaaattggaaaaaagcgcataatatcttacttccaagcttcagtcagcaggcaa<br>tgaaaggctatcatgcgatgatggtcgatatcgccgtgcagcttgttcaaaagtgggagcgtctaa<br>atgcagatgagcatattgaagtaccggaagacatgacacgtttaacgcttgatacaattggtctttgc<br>ggctttaactatcgcttaactcagctttttaccgagatcagcctcatccattttattacaagtatggtccgtg<br>cactgtgaagcaatgaacaagctgcagcgagcaaatccagacgaccgcagcttatgatgaaaaa<br>caagcgccagtttcaagaagatatcaaggtgatgaacgacctagtagataaaatttattgcagatcg<br>caaagcaagcggtgaacaaagcgatgatttattaacgcatatgctaaacggaaaagatccagaaa<br>cggggtgagccgcttgatgacgagaacattcgctatcaaattattacattcttaattgcgggacacga<br>aacaacaagtggtcttttatcatttgcgctgtatttcttagtgaaaaatccacatgtattacaaaaagca<br>gcagaagaagcagcacgagttctagtagatcctgttccaagctcaaacaagtcaaacagcttaa<br>atatgtcggcatggtcttaaacgaagcgctgcgcttatggccaactgctcctgcgttttccctatatg<br>caaaagaagatacggtgcttggaggagaatatccttagaaaaaggcgacgaactaatggttctga<br>ttcctcagcttcaccgtgataaaaacaattggggagacgatgtggaagagttccgtccagagcgttt<br>tgaaaatccaagtgcgattccgcagcatgcgtttaaaccgtttgaaacggtcagcgtgcgtgtatc<br>ggtcagcagttcgctcttcatgaagcaacgctggtacttggtatgatgctaaaacactttgactttga<br>agatcatacaaactacgagctggatattaaagaaactttaacgttaaaaccgaaggctttgtggtaa<br>aagcaaaatcgaaaaaaattccgcttggcggtattccttcacctagcactgaacagtctgctaaaaa<br>agtacgcaaaaaggcagaaaacgctcataatacgccgctgcttgtgctatacggttcaaatatggg<br>aacagctgaaggaacggcgcgtgatttagcagatattgcaatgagcaaaggatttgcaccgcagg<br>tcgcaacgcttgattcacacgccggaaatcttccgcgcgaagagctgtattaattgtaacggcgt<br>cttataacggtcatccgcctgataacgcaaagcaatttgtcgactggttagaccaagcgctgctga<br>tgaagtaaaaggcgttcgctactccgtatttggatgcggcgataaaaactgggctactacgtatcaa<br>aaagtgcctgcttttatcgatgaaacgcttgccgctaaaggggcagaaaacatcgctgaccgcggt<br>gaagcagatgcaagcgacgactttgaaggcacatatgaagaatggcgtgaacatatgtggagtg<br>acgtagcagcctactttaacctcgacattgaaaacgttgaagataataaatctactctttcacttcaat<br>ttgtcgacagcgccgcggatatgccgcttgcgaaaatgcacggtgcgttttcaacgaacgtcgtag<br>caagcaaagaacttcaacagccaggcagtgcacgaagcacgcgacatcttgaaattgaacttcca<br>aaagaagcttcttatcaagaaggagatcatttaggtgttattcctcgcaactatgaaggaatagtaaa<br>ccgtgtaacagcaaggttcggccgtagatgcatcacagcaaatccgtcgtgaagcagaagaagaa<br>aaattagctcatttgccactcgctaaaacagtatccgtagaagagctctgcaatacgtggagcttca<br>agatcctgttacgcgcacgcagcttcgcgcaatggctgctaaaacggtctgcccgccgcataaag<br>tagagcttgaagccttgcttgaaaagcaagcctacaaagaacaagtgctggcaaaacgtttaacaa<br>tgcttgaactgcttgaaaaatacccggcgtgtgaaatgaaattcagcgaatttatcgcccttctgcca<br>agcatacgccccgcgctattactcgatttcttcatcaccctcgtgtcgatgaaaaacaagcaagcatca<br>cggtcagcgttgtctcaggagtaagcgtggagcggatatggagaatataaaggaattgcgtcgaac<br>tatcttgccgagctgcaagaaggagatacgattacgttgctttatttccacaccgcagtcagaatttac<br>gctgccaaaagaccctgaaacgccgcttatcatggtcggaccgggaacaggcgtcgcgccgttt<br>agaggctttgtgcaggcgcgcaaacagctaaaagaacaaggacagtcacttggagaagcacatt<br>tatacttcggctgccgttcacctcatgaagcatatctgtatcaagaagacgttgaaaacgcccaaag<br>cgaaggcatcattacgcttcataccgcttttctcgcatgccaaatcagccgaaaacatacgttcagc<br>acgtaatggaacaagacggcaagaatttgattgaacttcttgatcaaggagcgcacttctatatttg<br>cggagacggaagccaaatggcacctgccgttgaagcaacgcttatgaaaagctatgctgacgttc<br>accaagtgagtgaagcagacgcgctcgcttatggctgcagcagctagaagaaaaaggccgatacgc<br>aaaagacgtgtgggctgggtaa |

| SEQ ID NO: | Description | Sequence |
|---|---|---|
| SEQ ID NO: 25 | NADPH cytochrome P450 reductase, CPR (*C. tropicalis* strain ATCC750) Nuc. Seq | atggcattagataagttagatttatatgttattataacattggtggttgcaattgcagcttattttgcaaag<br>aatcagtttcttgaccaacaacaagataccggggttccttaatactgatagtggagatggtaattcaag<br>agatatcttacaagctttgaagaagaacaataaaaatacgttattattatttggatcccaaacaggtac<br>agcagaagattatgccaacaaattgtcaagagaattgcattcaagatttggtttgaaaaccatggttg<br>ctgatttcgctgattatgatttcgaaaacttcggagatattactgaagatatcttggttttctttattgttgc<br>tacttatggtgaaggtgaaccaaccgataatgctgacgaatttcacacttggttgactgaagaagct<br>gacaccttgagtactttgaaatatactgttttggttgggtaattcaacttatgaattcttcaatgctattg<br>gtagaaaatttgacagattgttgggagaaaaaggtggtgacagatttgctgaatacggtgaaggtg<br>acgatggtactggtactttcttggcctggaaggataacgtgtttgattccttaaaga<br>atgatttgaattttgaagaaaaagagttgaaatacgaaccaaatgttaaattgactgaaagagatgat<br>ttatctggcaatgatccagatgtctcctgggtgaaccaaatgtcaaatacattaaatctgaaggtgtt<br>gacttaactaaaggtccatttgatcatactcatccatttttggctagaattgttaaaactaaagaattgtt<br>tacttctgaagacagacattgtgttcatgttgaatttgatatttctgaatcaaacttgaaatataccaccg<br>gtgatcatcttgcaatctggccatctaactctgatgaaaacattaagcaatttgccaaatgttttggttt<br>agaagacaaacttgatactgttattgaattgaaagctttggattccacttattccatcccattccctaat<br>ccaatcacttatggagctgttattagacaccatttggaaatttcaggtcctgtttctagacaattttctta<br>tctattgctggatttgcccctgatgaagaaactaaaaagtcatttactagaattggtggtgataagcaa<br>gaatttgctagtaaagtcaccgtagaaaattcaacattgccgatgctttattatttgcttccaacaaca<br>gaccatggtccgatgttccattcgaattccttattgaaaatgtccaacacttaactcctcgttattactc<br>catttcttcttcctcattaagtgaaaagcaaaccattaatgttactgctgttgttgaagccgaagaaga<br>agctgatggaagaccagttactggtgttgtcaccaacttgttgaagaatattgaaattgaacaaaac<br>aaaactggtgaaacccaatggttcattatgatttgaatggtccaagaggcaaatttagcaagttca<br>gattgccagttcacgttagaagatctaatttcaaattaccaaagaatagcactaccccagttattttgat<br>tggtccaggtaccggtgttgcaccattgagaggttttgttagagaaaagagttcaacaagttaaaat<br>ggtgttaatgttggtaagactgtattgttttatggatgtagaaattccgaacaagatttcttgtcaaac<br>aagaatggagtgaatatgcctcagtattgggagaaaaatttcgaaatgtttaatgcctctcaagacaa<br>gatccaactaagaaagtttatgttcaagataagatttagaaaatagtgctcttgttgatgagttattatc<br>tagtggagcaattatttatgtttgtggtgatgccagtagaatggctagagatgttcaagctgcaattgc<br>caagattgttgccaaaagtagagatatccacgaagataaagctgctgaattggttaaatcttggaaa<br>gttcaaaatagataccaagaagatgtctggtaa |
| SEQ ID NO: 26 | NADPH cytochrome P450 reductase A, CPRA (Candida strain ATCC20336) Nuc. Seq | atggctttagacaagttagatttgtatgtcatcataacattggtggtcgctgtagccgcctatttgcta<br>agaaccagttccttgatcagccccaggacaccgggttcctcaacacggacagcggaagcaactc<br>cagagacgtcttgctgacattgaagaagaataataaaaacacgttgttgttgtttgggtcccagacg<br>ggtacgcagaagattacgccaacaaattgtccagagaattgcactccagatttggcttgaaaacg<br>atggttgcagatttcgctgattacgattgggataacttcggagatatcaccgaagacatcttggtgttt<br>ttcattgttgccacctatggtgagggtgaacctaccgataatgccgacgagttccacacctggttga<br>ctgaagaagctgacactttgagtacctgtgaaatacgttcgggttgggtaactccacgtacga<br>gttcttcaatgccattggtagaaagtttgacagattgttgagcggagaaaggtggtgacaggtttgctg<br>aatacgctgaaggtgatgacggtactggcaccttggacgaagatttcatggcctggaaggacaat<br>gtctttgacgccttgaagaatgatttgaactttgaagaaaaggaattgaagtacgaaccaaacgtga<br>aattgactgagagagacgacttgtctgctgctgactcccaagttttccttgggtgagccaacaaga<br>agtacatcaactccgagggcatcgacttgaccaagggtccattcgaccacacccacccatacttg<br>gccagaatcaccgagacgagagagttgttcagctccaaggacagacactgtatccacgttgaattt<br>gacatttctgaatcgaacttgaaatacaccaccggtgaccatctagctatctggccatccaactccg<br>acgaaaaacattaagcaatttgccaagtgtttcaagtgttggaagataaaactcgacactgttattgaattg<br>aaggcgttggactccacttacaccatcccattcccaaccccaattacctacggtgctgtcattagac<br>accatttagaaatctccggtccagtctcgagacaattcttttttgtcaattgctgggtttgctcctgatga<br>agaaacaaagaaggcttttaccagacttggtggtgacaagcaagaattcgccgccaaggtcaccc<br>gcagaaagttcaacattgccgatgcctgttatattcctccaacaacgctccatggtcgatgttcctt<br>ttgaattccttattgaaaacgttccacacttgactccacgttactactccatttcgtcttcgtcattgagt<br>gaaaagcaactcatcaacgttactgcagttgttgaagccgaagaagaagctgatggcagaccagt<br>cactggtgttgtcaccaacttgttgaagaacgttgaaattgtgcaaaacaagactggcgaaaagcc<br>acttgtccactacgatttgagcggcccaagaggcaagttcaacaagttcaagttgccagtgcatgt<br>gagaagatccaactttaagttgccaaagaacttccaccacccccagttatcttgattggtccaggtact<br>ggtgttgcccccattgagaggttttgtcagagaaagagttcaacaagtcaagaatggtgtcaatgttg<br>gcaagacttgtgttttatggttgcagaaactccaacgaggactttttgtacaagcaagaatgggcc<br>gagtacgcttctgttttgggtgaaaactttgagatgttcaatgccttctccagacaagacccatccaa<br>gaaggtttacgtccaggataagttttagaaaacagccaacttgtgcacgagttgttgactgaaggt<br>gccattatctacgtctgtggtgatgccagtagaatggctagaacgtgcagaccacaatttccaag<br>attgttgctaaaagcagagaaattagtgaagacaaggctgctgaattggttcaagtcctggaaggtc<br>caaaatagataccaagaagatgtttggtag |
| SEQ ID NO: 27 | NADPH cytochrome P450 reductase B, CPRB (Candida strain ATCC20336) Nuc. Seq | atggctttagacaagttagatttgtatgtcatcataacattggtggtcgctgtggccgcctatttgcta<br>agaaccagttccttgatcagccccaggacaccgggttcctcaacacggacagcggaagcaactc<br>cagagacgtcttgctgacattgaagaagaataataaaaacacgttgttgttgtttgggtcccagacc<br>ggtacgcagaagattacgccaacaaattgtcaagagaattgcactccagatttggcttgaaaacc<br>atggttgcagatttcgctgattacgattgggataacttcggagatatcaccgaagatatcttggtgtttt<br>tcatcgttgccacctatggtgagggtgaacctaccgacaatgccgacgagttccacacctggttga<br>ctgaagaagctgacactttgagtacttgtgagatacgtgttcggggttgggtaactccacctacga<br>gttcttcaatgctattggtagaaagtttgacagattgttgagtgagaaaggtggtgacagatttgctga<br>atatgctgaaggtgacgacggcactggcaccttggacgaagatttcatggcctggaaggataatgt<br>ctttgacgccttgaagaatgacttgaactttgaagaaaaggaattgaagtacgaaccaaacgtgaa<br>attgactgagagagatgacttgtctgctgctgccgactcccaagtttccttgggtgagccaaacaagaa |

| SEQ ID NO: | Description | Sequence |
|---|---|---|
| | | gtacatcaactccgagggcatcgacttgaccaagggtccattcgaccacacccacccatacttgg<br>ccaggatcaccgagaccagagagttgttcagctccaaggaaagacactgtattcacgttgaatttg<br>acatttctgaatcgaacttgaaatacaccaccggtgaccatctagccatctggccatccaactccga<br>cgaaaacatcaagcaatttgccaagtgtttcggattggaagataaactcgacactgttattgaattga<br>aggcattggactccacttacaccattccattcccaactccaattacttacgtgctgtcattagacacc<br>atttagaaatctccggtccagtctcgagacaattcttttttgtcgattgctggggtttgctcctgatgaaga<br>aacaaagaagactttcaccagacttggtggtgacaaacaagaattcgccaccaaggttacccgca<br>gaaagttcaacattgccgatgccttgttatattcctccaacaacactccatggtccgatgttcctttga<br>gttccttattgaaaacatccaacacttgactccacgttactactccattcttcttcgtcgttgagtgaaa<br>aacaactcatcaatgttactgcagtcgttgaggccgaagaagaagccgatggcagaccagtcact<br>ggtgttgttaccaacttgttgaagaacattgaaattgcgcaaaacaagactggcgaaaagccacttg<br>ttcactacgatttgagcggcccaagaggcaagttcaacaagttcaagttgccagtgcacgtgagaa<br>gatccaacttttaagttgccaaagaactccaccaccccagttatcttgattggtccaggtactggtgtt<br>gccccattgagaggtttcgttagagaaagagttcaacaagtcaagaatggtgtcaatgttggcaag<br>actttgttgttttatggttgcagaaactccaacgaggacttttttgtacaagcaagaatgggccgagta<br>cgcttctgttttgggtgaaaactttgagatgttcaatgccttctctagacaagacccatccaagaaggt<br>ttacgtccaggataagattttagaaaacagccaacttgtgcacgaattgttgaccgaaggtgccatt<br>atctacgtctgtggtgacgccagtagaatggccagagacgtccagaccacgatctccaagattgtt<br>gccaaaagcagagaaatcagtgaagacaaggccgctgaattggtcaagtcctggaaagtccaaa<br>atagataccaagaagatgtttggtag |
| SEQ ID NO: 28 | cytochrome P450: NADPH P450 reductase (Bacillus megaterium) amino acid [P450 activity shown in italics, P450 reductase activity shown in normal font] A.A. Seq | *mtikempqpktfgelknlpllntdkpvqalmkiadelgeifkfeapgrvtrylssqrlikeacdes*<br>*rfdknlsqalkfvrdfagdglftswtheknwkkahnillpsfsqqamkgyhammvdiavqlvq*<br>*kwerlnadehievpedmtrltldtiglcgfnyrfnsfyrdqphpfitsmvrasdeamnksqran*<br>*pddpaydenkrqfqedikvmndlvdkiiadrkasgeqsddllthmlngkdpetgeplddenir*<br>*yqiitfliaghettsgllsfasyflvknphylqkaaeeaarvlvdpvpsykqvkqlkyvgmvlnea*<br>*srlwptapafslyakedtvlggeyplekgdelmvsipqlhrdktiwgddveefrperfenpsaip*<br>*qhafkpfgngqracigqqfalheatsvlgmmlkhfdfedhtnyesdiketltlkpegfvvkaksk*<br>*kiplggipspsteqsakkvrkkaenahntpslvlygsnmgtaegtardladiamskgfapqvat*<br>*ldshagnlpregavlivtasynghppdnakqfvdwldqasadevkgvrysvfgcgdknwat*<br>*tyqkvpafidetlaakgaeniadrgeadasddfegtyeewrehmwsdvaayfnldiensedn*<br>kstlslqfvdsaadmplakmhgafstnvvaskelqqpgsarstrhleielpkeasyqegdhlgv<br>iprnyegivnrvtarfgldasqqirseaeeeklahlplaktvsveelsqyvelqdpvtrtqlrama<br>aktvcpphkveleallekqaykeqvsakrltmlesleykypacemkfsefialspsirpryysiss<br>sprvdekqasitvsvvsgeawsgygeykgiasnylaesqegdtitcfistpqseftspkdpetpl<br>imvgpgtgvapfrgfvqarkqlkeqgqslgeahlyfgcrsphedysyqeelenaqsegiitlht<br>afsrmpnqpktyvqhvmeqdgkklielldqgahfyicgdgsqmapaveatlmksyadvhq<br>vseadarlwsqqleekgryakdvwag* |
| SEQ ID NO: 29 | acyl CoA oxidase, POX4 (Candida strain ATCC20336) nucleotide | ATGACTTTTACAAAGAAAAACGTTAGTGTATCACAAGGTC<br>CTGACCCTAGATCATCCATCCAAAAGGAAAGAGACAGCTC<br>CAAATGGAACCCTCAACAAATGAACTACTTCTTGGAAGGC<br>TCCGTCGAAAGAAGTGAGTTGATGAAGGCTTTGGCCCAAC<br>AAATGGAAAGAGACCCAATCTTGTTCACAGACGGCTCCTA<br>CTACGACTTGACCAAGGACCAACAAAGAGAATTGACCGCC<br>GTCAAGATCAACAGAATCGCCAGATACAGAGAACAAGAAT<br>CCATCGACACTTTCAACAAGAGATTGTCCTTGATTGGTATC<br>TTTGACCCACAGGTCGGTACCAGAATTGGTGTCAACCTCGG<br>TTTGTTCCTTTCTTGTATCAGAGGTAACGGTACCACTTCCCA<br>ATTGAACTACTGGGCTAACGAAAAGGAAACCGCTGACGTT<br>AAAGGTATCTACGGTTGTTTCGGTATGACCGAATTGGCCCA<br>CGGTTCCAACGTTGCTGGTTTGGAAACCACCGCCACATTTG<br>ACAAGGAATCTGACGAGTTTGTCATCAACACCCCACACATT<br>GGTGCCACCAAGTGGTGGATTGGTGGTGCTGCTCACTCCGC<br>CACCCACTGTTCTGTCTACGCCAGATTGATTGTTGACGGTC<br>AAGATTACGGTGTCAAGACTTTTGTTGTCCCATTGAGAGAC<br>TCCAACCACGACCTCATGCCAGGTGTCACTGTTGGTGACAT<br>TGGTGCCAAGATGGGTAGAGATGGTATCGATAACGGTTGG<br>ATCCAATTCTCCAACGTCAGAATCCCAAGATTCTTTATGTT<br>GCAAAAGTTCTGTAAGGTTTCTGCTGAAGGTGAAGTCACCT<br>TGCCACCTTTGGAACAATTGTCTTACTCCGCCTTGTTGGGT<br>GGTAGAGTCATGATGGTTTTGGACTCCTACAGAATGTTGGC<br>TAGAATGTCCACCATTGCCTTGAGATACGCCATTGGTAGAA<br>GACAATTCAAGGGTGACAATGTCGATCCAAAAGATCCAAA<br>CGCTTTGGAAACCCAATTGATAGATTACCCATTGCACCAAA<br>AGAGATTGTTCCCATACTTGGCTGCTGCCTACGTCATCTCC<br>GCTGGTGCCCTCAAGGTTGAAGACACCATCCATAACACCTT<br>GGCTGAATTGGACGCTGCCGTTGAAAAGAACGACACCAAG<br>GCTATCTTTAAGTCTATTGACGACATGAAGTCATTGTTTGT<br>TGACTCTGGTTCCTTGAAGTCCACTGCCACTTGGTTGGGTG<br>CTGAAGCCATTGACCAATGTAGACAAGCCTGTGGTGGTCA<br>CGGTTACTCGTCCTACAACGGCTTCGGTAAAGCCTACAACG<br>ATTGGGTTGTCCAATGTACTTGGGAAGGTGACAACAATGTC<br>TTGGCCATGAGTGTTGGTAAGCCAATTGTCAAGCAAGTTAT<br>CAGCATTGAAGATGCCGGCAAGACCGTCAGAGGTTCCACC |

| SEQ ID NO: | Description | Sequence |
|---|---|---|
| | | GCTTTCTTGAACCAATTGAAGGACTACACTGGTTCCAACAG<br>CTCCAAGGTTGTTTTGAACACTGTTGCTGACTTGGACGACA<br>TCAAGACTGTCATCAAGGCTATTGAAGTTGCCATCATCAGA<br>TTGTCCCAAGAAGCTGCTTCTATTGTCAAGAAGGAATCTTT<br>CGACTATGTCGGCGCTGAATTGGTTCAACTCTCCAAGTTGA<br>AGGCTCACCACTACTTGTTGACTGAATACATCAGAAGAATT<br>GACACCTTTGACCAAAAGGACTTGGTTCCATACTTGATCAC<br>CCTCGGTAAGTTGTACGCTGCCACTATTGTCTTGGACAGAT<br>TTGCCGGTGTCTTCTTGACTTTCAACGTTGCCTCCACCGAA<br>GCCATCACTGCTTTGGCCTCTGTGCAAATTCCAAAGTTGTG<br>TGCTGAAGTCAGACCAAACGTTGTTGCTTACACCGACTCCT<br>TCCAACAATCCGACATGATTGTCAATTCTGCTATTGGTAGA<br>TACGATGGTGACATCTATGAGAACTACTTTGACTTGGTCAA<br>GTTGCAGAACCCACCATCCAAGACCAAGGCTCCTTACTCTG<br>ATGCTTTGGAAGCCATGTTGAACAGACCAACCTTGGACGA<br>AAGAGAAAGATTTGAAAAGTCTGATGAAACCGCTGCTATC<br>TTGTCCAAGTAA |
| SEQ ID NO: 30 | acyl CoA oxidase, POX4 (Candida strain ATCC20336) amino acid | MTFTKKNVSVSQGPDPRSSIQKERDSSKWNPQQMNYFLEGSV<br>ERSELMKALAQQMERDPILFTDGSYYDLTKDQQRELTAVKIN<br>RIARYREQESIDTFNKRLSLIGIFDPQVGTRIGVNLGLFLSCIRG<br>NGTTSQLNYWANEKETADVKGIYGCFGMTELAHGSNVAGLE<br>TTATFDKESDEFVINTPHIGATKWWIGGAAHSATHCSVYARLI<br>VDGQDYGVKTFVVPLRDSNHDLMPGVTVGDIGAKMGRDGID<br>NGWIQFSNVRIPRFFMLQKFCKVSAEGEVTLPPLEQLSYSALL<br>GGRVMMVLDSYRMLARMSTIALRYAIGRRQFKGDNVDPKDP<br>NALETQLIDYPLHQKRLFPYLAAAYVISAGALKVEDTIHNTLA<br>ELDAAVEKNDTKAIFKSIDDMKSLFVDSGSLKSTATWLGAEA<br>IDQCRQACGGHGYSSYNGFGKAYNDWVVQCTWEGDNNVLA<br>MSVGKPIVKQVISIEDAGKTVRGSTAFLNQLKDYTGSNSSKV<br>VLNTVADLDDIKTVIKAIEVAIIRLSQEAASIVKKESFDYVGAE<br>LVQLSKLKAHHYLLTEYIRRIDTFDQKDLVPYLITLGKLYAAT<br>IVLDRFAGVFLTFNVASTEAITALASVQIPKLCAEVRPNVVAY<br>TDSFQQSDMIVNSAIGRYDGDIYENYFDLVKLQNPPSKTKAPY<br>SDALEAMLNRPTLDERERFEKSDETAAILSK* |
| SEQ ID NO: 31 | acyl CoA oxidase, POX5 (Candida strain ATCC20336) nucleotide | ATGCCTACCGAACTTCAAAAAGAAAGAGAACTCACCAAGT<br>TCAACCCAAAGGAGTTGAACTACTTCTTGGAAGGTTCCCAA<br>GAAAGATCCGAGATCATCAGCAACATGTCGAACAAATGC<br>AAAAAGACCCTATCTTGAAGGTCGACGCTTCATACTACAA<br>CTTGACCAAAGACCAACAAAGAGAAGTCACCGCCAAGAAG<br>ATTGCCAGACTCTCCAGATACTTTGAGCACGAGTACCCAGA<br>CCAACAGGCCCAGAGATTGTCGATCCTCGGTGTCTTTGACC<br>CACAAGTCTTCACCAGAATCGGTGTCAACTTGGGTTTGTTT<br>GTTTCCTGTGTCCGTGGTAACGGTACCAACTCCCAGTTCTT<br>CTACTGGACCATAAATAAGGGTATCGACAAGTTGAGAGGT<br>ATCTATGGTTGTTTTGGTATGACTGAGTTGGCCCACGGTTC<br>CAACGTCCAAGGTATTGAAACCACCGCCACTTTTGACGAA<br>GACACTGACGAGTTTGTCATCAACACCCCACACATTGGTGC<br>CACCAAGTGGTGGATCGGTGGTGCTGCGCACTCCGCCACC<br>CACTGCTCCGTCTACGCCAGATTGAAGGTCAAGGAAAGG<br>ACTACGGTGTCAAGACCTTTGTTGTCCCATTGAGAGACTCC<br>AACCACGACCTCGAGCCAGGTGTGACTGTTGGTGACATTG<br>GTGCCAAGATGGGTAGAGACGGTATCGATAACGGTTGGAT<br>CCAGTTCTCCAACGTCAGAATCCCAAGATTCTTTATGTTGC<br>AAAAGTTCTGTAAGGTTTCCGTCTGGGTGAAGTCACCATG<br>CCACCATCTGAACAATTGTCTTACTCGGCTTTGATTGGTGG<br>TAGAGTCACCATGATGATGGACTCCTACAGAATGACCAGT<br>AGATTCATCACCATTGCCTTGAGATACGCCATCCACAGAAG<br>ACAATTCAAGAAGAAGGACACCGATACCATTGAAACCAAG<br>TTGATTGACTACCCATTGCATCAAAAGAGATTGTTCCCATT<br>CTTGGCTGCCGCTTACTTGTTCTCCCAAGGTGCCTTGTACTT<br>AGAACAAACCATGAACGCAACCAACGACAAGTTGGACGA<br>AGCTGTCAGTGCTGGTGAAAAGGAAGCCATTGACGCTGCC<br>ATTGTCGAATCCAAGAAATTGTTCGTCGCTTCCGGTTGTTT<br>GAAGTCCACCTGTACCTGGTTGACTGCTGAAGCCATTGACG<br>AAGCTCGTCAAGCTTGTGGTGGTCACGGTTACTCGTCTTAC<br>AACGGTTTCGGTAAAGCCTACTCCGACTGGGTTGTCCAATG<br>TACCTGGGAAGGTGACAACAACATCTTGGCCATGAACGTT<br>GCCAAGCCAATGGTTAGAGACTTGTTGAAGGAGCCAGAAC<br>AAAAGGGATTGGTTCTCTCCAGCGTTGCCGACTTGGACGAC<br>CCAGCCAAGTTGGTTAAGGCTTTCGACCACGCCCTTTCCGG<br>CTTGGCCAGAGACATTGGTGCTGTTGCTGAAGACAAGGGT<br>TTCGACATTACCGGTCCAAGTTTGGTTTTGGTTTCCAAGTT<br>GAACGCTCACAGATTCTTGATTGACGGTTTCTTCAAGCGTA |

| SEQ ID NO: | Description | Sequence |
|---|---|---|
| | | TCACCCCAGAATGGTCTGAAGTCTTGAGACCCTTTGGGTTTC<br>TTGTATGCCGACTGGATCTTGACCAACTTTGGTGCCACCTT<br>CTTGCAGTACGGTATCATTACCCCAGATGTCAGCAGAAAG<br>ATTTCCTCCGAGCACTTCCCAGCCTTGTGTGCCAAGGTTAG<br>ACCAAACGTTGTTGGTTTGACTGATGGTTTCAACTTGACTG<br>ACATGATGACCAATGCTGCTATTGGTAGATATGATGGTAAC<br>GTCTACGAACACTACTTCGAAACTGTCAAGGCTTTGAACCC<br>ACCAGAAAACACCAAGGCTCCATACTCCAAGGCTTTGGAA<br>GACATGTTGAACCGTCCAGACCTTGAAGTCAGAGAAAGAG<br>GTGAAAAGTCCGAAGAAGCTGCTGAAATCTTGTCCAGTTAA |
| SEQ ID NO: 32 | acyl CoA oxidase, POX5 (Candida strain ATCC20336) amino acid | MPTELQKERELTKFNPKELNYFLEGSQERSEIISNMVEQMQKD<br>PILKVDASYYNLTKDQQREVTAKKIARLSRYFEHEYPDQQAQ<br>RLSILGVFDPQVFTRIGVNLGLFVSCVRGNGTNSQFFYWTINK<br>GIDKLRGIYGCFGMTELAHGSNVQGIETTATFDEDTDEFVINT<br>PHIGATKWWIGGAAHSATHCSVYARLKVKGKDYGVKTFVVP<br>LRDSNHDLEPGVTVGDIGAKMGRDGIDNGWIQFSNVRIPRFF<br>MLQKYCKVSRSGEVTMPPSEQLSYSALIGGRVTMMMDSYRM<br>TSRFITIALRYAIHRRQFKKKDTDTIETKLIDYPLHQKRLFPFLA<br>AAYLFSQGALYLEQTMNATNDKLDEAVSAGEKEAIDAAIVES<br>KKLFVASGCLKSTCTWLTAEAIDEARQACGGHGYSSYNGFG<br>KAYSDWVVQCTWEGDNNILAMNVAKPMVRDLLKEPEQKGL<br>VLSSVADLDDPAKLVKAFDHALSGLARDIGAVAEDKGFDITG<br>PSLVLVSKLNAHRFLIDGFFKRITPEWSEVLRPLGFLYADWILT<br>NFGATFLQYGIITPDVSRKISSEHPFALCAKVRPNVVGLTDGF<br>NLTDMMTNAAIGRYDGNVYEHYFETVKALNPPENTKAPYSK<br>ALEDMLNRPDLEVRERGEKSEEAAEILSS* |
| SEQ ID NO: 33 | Acyl-CoA Hydrolase (ACHA) Nucleotide Seq | atgatcagaaccgtccgttatcaatccctcaagaggttcagacctctggctttgtctcctgttttcgtc<br>cacgctacaactcccagaaggccaatttccaccgtccagaccacccctgggtccgacgagccagc<br>tgaagccgccgacgccgccgccacgatcctcgccgagttgcgagacaagcagacgaacccga<br>acaaggccacctggctcgatgcgttaacggagcgggagaagttcgctgccgagggcaagacga<br>ttgacagtttcagctacgttgaccccaagacgaccgtcgtggggagaagacacgcagtgactcg<br>ttctcgttcttgttgttgccgttcaaggacgacaagtggttgtgtgacgcgtacatcaatgcgtttggc<br>cggttgcgtgtagcgcagttgttccaggacttggacgccttggcggggccgcatcgcgtacaggca<br>ctgttccccagcggagcccgtaatgtcacggcgagcgtggataggtgtacatggtgaagaaa<br>gtggacgagattaacaattacaatttcgtgttggcggggtccgtgacgtggaccgggagatcgtcg<br>atggagatcacggtgaaagggtatgcttttgaagacgccgtgccggatataacgaacgaggagtc<br>cttgccggcagagaatgtgttttggctgctaatttcaccttcgtggcacggaacccacttacacaca<br>agtcctttgctattaacagattgttgcccgtgactgagaaggactgggtcgactatcgccgtgctga<br>gtcccacaacgccaagaagaagttgatggcaaagaacaagaagatcttggagcctaccgcgga<br>agagtccaagttgatctacgacatgtggagatcgtccaagtccttacagaacatcgagagggcca<br>acgatgggatcgcgttcatgaaggacacgaccatgaagtccacccttgttcatgcagccccagtac<br>cgtaacagacactcatacatgattttcggagggtacttgttaagacaaacttttcgaattggcctactgt<br>accgcggcaacgtttttcctggccgggcccgtttcgtcagcttggactccaccacgttcaagaac<br>cccgtgcccgtggggtcggtgctcaccatggactcgtcgatctcgtacacggagcacgtgcacg<br>agggagtggaggagattgacgcggactcgttccaacttcagcttgcctgccacgaacaagatc<br>tcgaagaaccccgaggcgttcttgtcggaacccggcacgttgattcaagtcaaggtcgacacata<br>catccaggagttagagcagagtgtgaagaagcccgcgggtacgttcatctactcgttctatgttgat<br>aaagaaagcgttactgttgatggaaaggcgtcgttttgttcagttatcccgcagacgtactccgaga<br>tgatgacttatgtgggcgggagaagaagagcccaggatactgctaactacgtggagctttgccg<br>tttagtggaagcggcaattaa |
| SEQ ID NO: 34 | Acyl-CoA Hydrolase (ACHA) Amino Acid Seq | MIRTVRYQSLKRFRPSALSPVFRPRYNSQKANFHRPDHPGSDE<br>PAEAADAAATILAELRDKQTNPNKATWLDALTEREKLRAEG<br>KTIDSFSYVDPKTTVVGEKTRSDSFSFLLLPFKDDKWLCDAYI<br>NAFGRLRVAQLFQDLDALAGRIAYRHCSPAEPVNVTASVDRV<br>YMVKKVDEINNYNFVLAGSVTWTGRSSMEITVKGYAFEDAV<br>PDITNEESLPAENVFLAANFTFVARNPLTHKSFAINRLLYVTEK<br>DWVDYRRAESHNAKKKLMAKNKKILEPTAEESKLIYDMWRS<br>SKSLQNIERANDGIAFMKDTTMKSTLFMQPQYRNRHSYMIFG<br>GYLLRQTFELAYCTAATFSSAGPRFVSLDSTTFKNPVPVGSVL<br>TMDSSISYTEHVHEGVEEIDADSPFNFSLPATNKISKNPEAFLS<br>EPGTLIQVKVDTYIQELEQSVKKPAGTFIYSFYVDKESVTVDG<br>KASFCSVIPQTYSEMMTYVGGRRRAQDTANYVETLPFSGSGN |
| SEQ ID NO: 35 | Acyl-CoA Hydrolase (ACHB) Nucleotide Seq | atgatcagaaccgtccgttatcaatccttcaagaggttcaaacctctgactttatccccgttttccgtc<br>cacgctacaactcccagaaggccaatttccaccgtccagaccacgctgggtccgacgagccagc<br>cgaagccgccgacgccgctgccacgatcctcgccgagttgcgagacaagcagacgaacccga<br>acaaggccacctggctcgatgcgttaacggagcgggaagttgcgctgccgagggcaagacaa<br>tcgacagcttcagctacgttgaccccaagacaaccgtcgtggggagaagacacgcagcgactc<br>gttctcgttcttgttgttgccgttcaaggacgacaagtggttgtgtgacgcgtacatcaatgcgtttgg<br>ccggttgcgtgtagcgcagttgttccaggacttggacgccttggcggggccgcatcgcgtacaggc<br>actgttccccgctgagcccgtgaatgtcacggcgagcgtggatagagtgtatatggtgaagaaa<br>gtggacgagattaataattacaatttcgtgttggcggggtccgtgacgtggaccgggagatcgtcg |

| SEQ ID NO: | Description | Sequence |
|---|---|---|
| | | atggagatcacggtcaaagggtatgcttttgaagacgccgtgccggagataactaacgaggagtc<br>cttgccggcagagaatgtgttcttggctgttaatttcaccttcgtggcacgtaacccactcacacaca<br>agtcctccgctattaacagattgttgcccgtgactgagaaggactgggtcgattatcgccgtgctga<br>gtcccacaacgccaagaagaagttgatggcaaagaacaagagatcttggagcctaccccggaa<br>gagtccaagttgatctacgacatgtgggagatcgtccaagtcctatacagaacatcgagaaggccaa<br>cgacgggatcgcgttcatgaaggacacgataatgaagtccaccttgttcatgcagcccccagtacc<br>gtaacagacactcatacatgattttcggtgggtatttgttaagacaaacttcgaattggcctattgtac<br>cgcagcaacgttttccctggcgggaccccgttcgtcagcttggactccaccacgttcaagaaccc<br>cgtgcccgtgggtcggtgctcaccatggactcgtcgatctcgtacacggagcacgtccacgatg<br>gcgttgaggagattgacgccgactcccccgttcaacttcagcttgcctgccacgaacaagatctcga<br>agaaccccgaggcgttcttgtcggagcccggcacgttgatccaagtcaaggtcgacacgtacatc<br>caggagttagagcaaagtgtgaagaagcctgcgggaacgttcatctactcgttctatgttgataaag<br>agagcgttactgtggatggaaaggcgtcgttttgttcagttatcccgcagacgtactccgagatgat<br>gacttatgtggcgggagaagaagagcccaggatactgctaattacgtggagactttgccgttag<br>tggaagcggcaattaa |
| SEQ ID NO: 36 | Acyl-CoA Hydrolase (ACHB) | MIRTVRYQSFKRFKPLTLSPVFRPRYNSQKANFHRPDHAGSDE<br>PAEAADAAATILAELRDKQTNPNKATWLDALTEREKLRAEG<br>KTIDSFSYVDPKTTVVGEKTRSDSFSPLLLPFKDDKWLCDAYI<br>NAFGRLRVAQLFQDLDALAGRIAYRHCSPAEPVNVTASVDRV<br>YMVKKVDEINNYNFVLAGSVTWTGRSSMEITVKGYAFEDAV<br>PEITNEESLPAENVFLAVNFTFVARNPLTHKSFAINRLLPVTEK<br>DWVDYRRAESHNAKKKLMAKNKKILEPTPEESKLIYDMWRS<br>SKSLQNIEKANDGIAFMKDTIMKSTLFMQPQYRNRHSYMIFG<br>GYLLRQTFELAYCTAATFSLAGPRFVSLDSTTFKNPVPVGSVL<br>TMDSSISYTEHVHDGVEEIDADSPFNFSLPATNKISKNPEAFLS<br>EPGTLIQVKVDTYIQELEQSVKKPAGTFIYSFYVDKESVTVDG<br>KASFCSVIPQTYSEMMTYVGGRRRAQDTANYVETLPFSGSGN |
| SEQ ID NO: 37 | E. coli Acyl-CoA Thioesterase (TESA) gene without signal peptide sequence optimized for C. tropicalis Nucleotide Seq | atggccgatacattgctcatcttgggtgactcttgtctgcagggtatcggatgtccgcatctgccgc<br>atggcctgcactcctcaatgacaaatggcaaagcaagacatcggtcgtgaatgcatctatctctgg<br>cgataccctcgcagcaggggttggcccgtctcccagccttgttgaagcaacatcaaccacgttgggt<br>cttggtcgaattgggcggcaatgatggtctcagaggttttcaacctcaacagaccgagcagacatt<br>gcgtcaaatcctccaagacgtgaaggcagcaaacgccgaacctctcttgatgcagataagattgc<br>ctgccaactatggtcgtagatacaatgaagcctttctgcaatctacccgaagcttgcaaaggagttt<br>gacgtcccattgttgccgttttgatggaagaggtgtaccttaagcctcagtggatgcaagacgatg<br>gtatccatccgaaccgtgatgcacaaccattcatcgcagattggatggcaaacaactccaacccttt<br>ggtcaatcatgatagctaa |
| SEQ ID NO: 38 | E. coli Acyl-CoA Thioesterase (TESA) without signal peptide Amino Acid Seq | MADTLLILGDSLSAGYRMSASAAWPALLNDKWQSKTSVVNA<br>SISGDTSQQGLARLPALLKQHQPRWVLVELGGNDGLRGFQPQ<br>QTEQTLRQILQDVKAANAEPLLMQIRLPANYGRRYNEAFSAI<br>YPKLAKEFDVPLLPFLMEEVYLKPQWMQDDGIHPNRDAQPFI<br>ADWMAKQLQPLVNHDS |
| SEQ ID NO: 39 | Acyl-CoA Synthetase (ACS1) Nuc. Seq | atgggtgccccttaacagtcgccgttggcgaagcaaaaccaggcgaaaccgctccaagaagaa<br>aagccgctcaaaaatggcctctgtcgaacgcccaacagactcaaaggcaaccactttgccaga<br>cttcattgaagagtgttttgccagaaacggcaccagagatgccatggcctggagagacttggtcga<br>aatccacgtcgaaaccaaacaggttaccaaaatcattgacggcgaacagaaaaaggtcgataag<br>gactggatctactacgaaatgggtccttacaactacatatcctaccccaagttgttgacgttggtcaa<br>gaactactccaagggttgttggagttgggcttggccccagatcaagaatccaagttgatgatcttg<br>ccagtacctcccacaagtggatgcagaccttcttagcctccagtttccaaggtatcccggttgtcac<br>cgcctacgacaccttgggtgagtcgggcttgacccactccttggtgcaaaccgaatccgatgccgt<br>gttcaccgacaaccaattgttgtcctccttgattcgtccttggagaaggccacctccgtcaagtatgt<br>catccacggggaaagattgaccctaacgacaagagacagggcggcaaaatctaccaggatgc<br>ggaaaaggccaaggagaagattttacaaattagaccagatattaaatttatttctttcgacgaggtgt<br>tgcattgggtgaacaatcgtccaaagaattgcatttcccaaaaccagaagacccaatctgtatcatg<br>tacacctcgggttccaccggtgctccaaagggtgtgttatcaccaatgccaacattgttgccgcc<br>gtgggtggtatctccaccaatgctactagagacttggttagaactgtcgacagagtgattgcattttt<br>gccattggcccacatttcgagttggcctttgagttggttaccttctggtgggggctccattgggtta<br>cgccaatgtcaagactttgaccgaagcttcctgcagaaacttctcagccagacttgattgaattcaaa<br>ccaaccatcatggttggtgttgctgccgtttgggaatcggtcagaaagggtgtcttgtctaaattgaa<br>acaggcttctccaatccaaccaaaaagatcttctgggctgcattcaatgccaagtctactttgaaccgtt<br>atggcttgccaggcggtgggttgtttgacgctgtcttcaagaaggttaaagccgccactggtggcc<br>aattgcgttatgtgttaatggtgggtccccaatctctgttgatgcccaagtgtttatctccaccttgctt<br>gcgccaatgttgttgggttacggtttgactgaaacctgtgccaataccaccattgtcgaacacacgc<br>gcttccagattggtacttgggtaccttggttggatctgtcactgccaagttggttgatgttgctgatgc<br>tggatactacgccaagaacaaccagggtgaaatctggttgaaaggcggtccagttgtcaaggaat<br>actacaagaacgaagaagaaaccaaggctgcattcaccgaagatggctggttcaagactggtgat<br>attggtgaatggaccgccgacggtggtttgaacatcattgaccgtaagaagaacttggtcaagactt<br>tgaatggtgaatacattgctttggagaaattggaaagtatttacagatccaaccacttgatttttgaact<br>gtgtgtttacgcgtgaccaaaccaaggtcaagccaattgctattgtcttgccaattgaagccaacttga |

| SEQ ID NO: | Description | Sequence |
|---|---|---|
| | | agtctatgttgaaggacgaaaagattatcccagatgctgattcacaagaattgagcagcttggttca<br>caacaagaaggttgcccaagctgtcttgagacacttgctccaaaccggtaaacaacaaggtttgaa<br>aggtattgaattgttgcagaatgttgtcttgttggatgacgagtggaccccacagaatggttttgttac<br>ttctgcccaaaagttgcagagaaagaagatttagaaaagttgtaaaaaagaagttgaagaggcata<br>caagtcgtcttag |
| SEQ ID NO: 40 | Acyl-CoA Synthetase (ACS1) A.A. Seq | MGAPLTVAVGEAKPGETAPRRKAAQKMASVERPTDSKATTL<br>PDFIEECFARNGTRDAMAWRDLVEIHVETKQVTKIIDGEQKK<br>VDKDWIYYEMGPYNYISYPKLLTLVKNYSKGLLELGLAPDQE<br>SKLMIFASTSHKWMQTFLASSFQGIPVVTAYDTLGESGLTHSL<br>VQTESDAVFTDNQLLSSLIRPLEKATSVKYVIHGEKIDPNDKR<br>QGGKIYQDAEKAKEKILQIRPDIKFISFDEVVALGEQSSKELHF<br>PKPEDPICIMYTSGSTGAPKGVVITNANIVAAVGGISTNATRDL<br>VRTVDRVIAFLPLAHIFELAFELVTFWWGAPLGYANVKTLTE<br>ASCRNCQPDLIEFKPTIMVGVAAVWESVRKGVLSKLKQASPI<br>QQKIFWAAFNAKSTLNRYGLPGGGLFDAVFKKVKAATGGQL<br>RYVLNGGSPISVDAQVFISTLLAPMLLGYGLTETCANTTIVEH<br>TRFQIGTLGTLVGSVTAKLVDVADAGYYAKNNQGEIWLKGG<br>PVVKEYYKNEEETKAAFTEDGWFKTGDIGEWTADGGLNIIDR<br>KKNLVKTLNGEYIALEKLESIYRSNHLILNLCVYADQTKVKPI<br>AIVLPIEANLKSMLKDEKIIPDADSQELSSLVHNKKVAQAVLR<br>HLLQTGKQQGLKGIELLQNVVLLDDEWTPQNGFVTSAQKLQ<br>RKKILESCKKEVEEAYKSS |
| SEQ ID NO: 41 | Long-chain Acyl-CoA Synthetase (FAT1) Nuc. Seq | atgtcaggattagaaatagccgctgctgccatccttggtagtcagttattggaagccaaatatttaatt<br>gccgacgacgtgctgttagccaagacagtcgctgtcaatgccctcccatactgtgggaaagccag<br>cagaggtaaggcatcatactggtacttttttcgagcagtccgtgttcaagaacccaaacaacaaagc<br>gttggcgttcccaagaccaagaaagaatgcccccacccccaagaccgacgccgagggattcca<br>gatctacgacgatcagtttgacctagaagaatacacctacaaggaattgtacgacatggttttgaag<br>tactcatacatcttaagaacgagtacggcgtcactgccaacgacaccatccggtgttcttcgtgtgaa<br>caagccgcttttcattgtcttgtggttggcattgtggaacattggtgccttgcctgcgttcttgaacttc<br>aacaccaaggacaagccattgatccactgtcttaagattgtcaacgcttcgcaagttttcgttgaccc<br>ggactgtgattcccaatcagagataccgaggctcagatcagagaggaattgccacatgtgcaaa<br>taaactacattgacgagtttgccttgtttgacagattgagactcaagtcgactccaaaacacagagc<br>cgaggacaagaccagaagaccaaccgatactgactcctccgcttgtgcattgatttacacctcggg<br>taccaccggtttgccaaaagccggtatcatgtcctggagaaaagccttcatggcctcggttttcttg<br>gccacatcatgaagattgactcgaaatcgaacgtcttgaccgccatgcccttgtaccactccaccg<br>cggccatgttgggttgtgtcctactttgattgtcggtggctgtgtctccgtgtcccagaaattctccg<br>ctacttcgttcgttggaccaggccagattatgtggctgccacccacgtgcaatacgtcggtggcgtg<br>tcgttacttgttgaactccaagcctcatccagaccaagacagacacaatgtcagaattgcctacgt<br>aacgggttcgctccagatatatggtctgagttcaagcgcagattccacattgaaggtatcggtgagt<br>ctacgccgccaccgagtcccctatcgccaccaccaacttgcagtacggtgagtacggtgtcggc<br>gcctgtcgtaagtacgggtccctcatcagcttgttcttacccgcagaaattggccaagatgg<br>acccagaagacgagagtgaaatctacaaggacccccaagaccgggttctgtaccgaggccgctta<br>caacgagccaggtgagttgttgatgagaatcttgaaccctaacgacgtgcagaaatccttccaggg<br>ttattatggtaacaagtccgccaccaacagcaaaatcctcaccaatgttttcaaaaaaggtgacgcg<br>tggtacagatccggtgacttgttgaagatggacgaggacaaattgttgtactttgtcgacagattag<br>gtgacactttccgttggaagtccgaaaacgtctccgccaccgagtcgagaacgaattgatgggc<br>tccaaggccttgaagcagtccgtcgttgtcggtgtcaaggtgccaaaccacgaaggtagagcctg<br>ttttgccgtctgtgaagccaaggacgagttgagccatgaagaaatcttgaaattgattcactctcacg<br>tgaccaagtcttttgcctgtgtatgctcaacctgcgttcatcaagattggcaccattgaggcttcgcac<br>aaccacaaggttcctaagaaccaattcaagaaccaaaagttgccaaagggtgaagacggcaagg<br>atttgatctactgttgaatggcgacaagtaccaggagttgactgaagacgattggtctttgatttgta<br>ccggtaaagccaaattg |
| SEQ ID NO: 42 | Long-chain Acyl-CoA Synthetase (FAT1) A.A. Seq | MSGLEIAAAAILGSQLLEAKYLIADDVSLAKTVAVNALPYLW<br>KASRGKASYWYFFEQSVFKNPNNKALAFPRPRKNAPTPKTDA<br>EGFQIYDDQFDLEEYTYKELYDMVLKYSYILKNEYGVTANDT<br>IGVSCMNKPLFIVLWLALWNIGALPAFLNFNTKDKPLIHCLKI<br>VNASQVFVDPDCDSPIRDTEAQIREELPHVQINYIDEFALFDRL<br>RLKSTPKHRAEDKTRRPTDTDSSACALIYTSGTTGLPKAGIMS<br>WRKAFMASVFFGHIMKIDSKSNVLTAMPLYHSTAAMLGLCP<br>TLIVGGCVSVSQKFSATSFWTQARLCGATHVQYVGEVCRYLL<br>NSKPHPDQDRHNVRIAYGNGLRPDIWSEFKRRFHIEGIGEFYA<br>ATESPIATTNLQYGEYGVGACRKYGSLISLLLSTQQKLAKMD<br>PEDESEIYKDPKTGFCTEAAYNEPGELLMRILNPNDVQKSFQG<br>YYGNKSATNSKILTNVFKKGDAWYRSGDLLKMDEDKLLYFV<br>DRLGDTFRWKSENVSATEVENELMGSKALKQSVVVGVKVPN<br>HEGRACFAVCEAKDELSHEEILKLIHSHVTKSLPVYAQPAFIKI<br>GTIEASHNHKVPKNQFKNQKLPKGEDGKDLIYWLNGDKYQE<br>LTEDDWSLICTGKAKL |
| SEQ ID NO: 43 | Acyl-CoA Sterol acyl transferase | atgtccgacgacgagatagcaggaatagtcattgaaatcgacgatgacgtgaaatccacgtcttcg<br>ttccaggaagaactagtcgaggttgaaatgtccaactcgtccattaacgaatcccagaccgatgag<br>tcgtaccgtcctgaagaaacctcattgcattacaggaggaagtcccacaggacccgtcagagga |

| SEQ ID NO: | Description | Sequence |
|---|---|---|
| | (ARE1) Nuc. Seq | gtcgttcctagagatcaccaagaacgtgaatgatccggatctagtttccaagattgagaacctaagg<br>ggcaaagtaagccaacgggaagacaggttgaggaagcactaccttcacacctcccaggacgtc<br>aagttcttgtcccggttcaacgacatcaagttcaagctgaactccgcgacgattctagattcggatg<br>cgttttacaagagtgaatactttggagtcttgaccatcttctgggtggtatcgcactctacatattgtc<br>aacgttgtcagatgtttacttggcatggccaagccctactggactggatcatcataggaatgttca<br>agcaggacttggtgaaagttgcactcgttgatcttgccatgtacctatcctcgtattttccttatttcttg<br>caggttgcatgcaaacggggtgatgtatcttggcatggtcttggatgggcaatacaggggtttac<br>agcttggtgtttttgacgttctggacggtagttccgcaggagttggccatggatcttccttggattgca<br>cgaatttcttgatcttgcattgcttggtgtttattatgaagatgcagtcgtatgggcattacaatggata<br>ccttgggatgtgtatcaggaaggattggcctctcagggactgatctcagggacctttctgagtatgatg<br>aagatttccccctggatcacgtggaggttctagaacagagcttgtggtttgccaaacacgagttgga<br>gtttcaatcgaatgaactgctgagaggaaggaccaccatcaccatgtattcgacgaaaaggatgt<br>caacaaaccaatacgtgtcttgcaagaagagggaattatcaagtttccggcaaacatcaacttcaa<br>ggattatttcgagtacagtatgttcccaacgctagtctacacgttgagcttcccccgaactcgacaga<br>ttagatggacgtatgtgttgcagaaggtttgggaacatttgccttagtgtttgccatgattatcgtcgc<br>cgaagagagtttctgcccccttgatgcaagaagttgatcagtacacaaaattgccaaccaaccaaag<br>gttcccaaaatacttcgtcgttctttcccacttgatattaccgctcggcaagcagtacttgctctcattc<br>atcctcatctggaatgaaattctcaacggcatagcggagttaagcaggtttggcgaccggcatttct<br>acggcgcttggtggtcgagcgtcgattacatggactattcaagaaaatggaacaccatcgtgcacc<br>gattcctccgtcggcacgtttacaattcgagcattcacatcctcggtatttccaggacgcaagccgc<br>gataattacacttttgcttctgccacaatccacgaactcgttatgtacgtcctatttggcaaattacga<br>gggtacctattccttacgatgcttgtccagatccccatgaccgtcacctccaagttcaacaaccgtgt<br>ttggggcaacatcatgttctggttgacgtatttatctggccccagcttggttagtgcgttgtatttactct<br>tctag |
| SEQ ID NO: 44 | Acyl-CoA Sterol acyl transferase (ARE1) A.A. Seq | MSDDEIAGIVIEIDDDVKSTSSFQEELVEVEMSNSSINESQTDE<br>SYRPEETSLHYRRKSHRTPSEESFLEITKNVDPDLVSKIENLR<br>GKVSQREDRLRKHYLHTSQDVKFLSRFNDIKPKLNSATILDSD<br>AFYKSEYFGVLTIFWVVIALYILSTLSDVYFGMAKPLLDWIIIG<br>MFKQDLVKVALVDLAMYLSSYFPYFLQVACKRGDVSWHGL<br>GWAIQGVYSLVFLTFWTVVPQELAMDLPWIARIFLILHCLVFI<br>MKMQSYGHYNGYLWDVYQEGLASEADLRDLSEYDEDFPLD<br>HVEVLEQSLWFAKHELEFQSNGTAERKDHHHHVFDEKDVNK<br>PIRVLQEEGIIKFPANINFKDYFEYSMFPTLVYTLSPPRTRQIRW<br>TYVLQKVLGTFALVFAMIIVAEESFCPLMQEVDQYTKLPTNQ<br>RFPKYFVVLSHLILPLGKQYLLSFILIWNEILNGIAELSRFGDRH<br>FYGAWWSSVDYMDYSRKWNTIVHRFLRRHVYNSSIHILGISR<br>TQAAIVTLLLSATIHELVMYVLFGKLRGYLFLTMLVQIPMTVT<br>SKFNNRVWGNIMFWLTYLSGPSLVSALYLLF |
| SEQ ID NO: 45 | Acyl-CoA Sterol acyl transferase (ARE2) Nuc. Seq | atgtccgacgacgagatagcaggaatagtcattgaaatcgacgatgacgtgaaatctacgtcttcg<br>ttccaggaagacctagtcgaggttgagatgtccaactcgtccattaacgaatcccagacggatgag<br>ttgtcgtaccgtcctgaagaaatctcattgcattcgagaaggaagtccccacaagacccccgtcagat<br>gagtcgttcctagagatcaccaagaacgtgaatgatccggatctagttccaagattgagaacttaa<br>ggggcaaagtaagccaacgggaagacaggttgaggaaacactaccttccacacatcccaggacg<br>tcaagttcttgtctcggttcaacgacatcaagttcaagctgaactccgcgacgattctagattcggat<br>gcgttttacaagagcgagcactttggagtcttgaccatcttctgggtgttatcgcactctacataatgt<br>caacgttgtcagacatgtattttggcatggccaagccctactggactggataatcataggaatgtt<br>caagaaggatttgatgcaagttgcactcgttgatcttgtcatgtacttatcctcgtattttccttatttcct<br>acaggttgcatgcaagaccggagctatatcttggcatggtcttggatgggccatacaggggtttta<br>cagcttggtgttttttaactttctgggcggtacttccgctggagctggccatggatcttccttggattgc<br>acgagttttcttgatcttgcattgcttggtgtttattatgaagatgcaatcatatggacattacaatggat<br>acctttgggatgtatatcaggaaggattggtctcggaagctgatctcacggctgtttctgagtatgat<br>gatgatttccccctggatcacggggaggttctagaacagagcttgtggttcgccaaacacgagttg<br>gagtttcaatctaatggaactacggagaggaaggatcaccatcatcatgtattcgacgaaaaggat<br>gtcaacaaaccaatacgtgtcttgcaagaagagggaattatcaaatttccggcaaacatcaatttca<br>aggattatttcgagtacagtatgttccccacgctagtctacacattgaacttccccagaattcgacata<br>ttagatgggcgtatgtgttgcagaaggtttgggaacatttgccttagtgtttgccatgattatcgtcgc<br>cgaagagagtttctgtcccttgatgcaagaagttgaacagtacacaagattgccaaccaaccaaag<br>gttctcaaagtacttcgtcgttctttcccacttgatattgccccctcggcaaacagtacttgctctcgttta<br>tcctcatttggaacgaaattctcaacgggatagcggagttaagcaggtttggggatcgccatttcta<br>cggcgcctggtggtcaagcgtcgactacatggactattcaagaaaatggaacacgatcgtgcacc<br>gattcctccgccggcacgtttacaattcgaccattcgcatcctcggtatttccaggacccaagccgc<br>gataattacacttttgcttcagccacaatccacgaactcgttatgtacatcctatttggaaaattacga<br>gggtacctattccttacgatgcttgtccagatccccatgacagtcaccgccaagttcaacaaccgttt<br>gtggggcaacatcatgttctggttgacgtatttatctggccccagcttggttagtgcgttgtatttactc<br>ttctga |
| SEQ ID NO: 46 | Acyl-CoA Sterol acyl transferase (ARE2) A.A. Seq | MSDDEIAGIVIEIDDDVKSTSSFQEDLVEVEMSNSSINESQTDE<br>LSYRPEEISLHSRRKSHKTPSDESFLEITKNVNDPDLVSKIENLR<br>GKVSQREDRLRKHYLHTSQDVKFLSRFNDIKFKSNSATILDSD<br>AFYKSEHFGVLTIFWVVIGLYIMSTLSDMYFGMAKPLSDWIII<br>GMFKKDLMQVALVDLVMYLSSYFPYFLQVACKTGAISWHGL<br>GWAIQGVYSLVFLTFWAVLPSESAMDLPWIARVFLILHCLVFI<br>MKMQSYGHYNGYLWDVYQEGLVSEADLTAVSEYDDDFPSD |

| SEQ ID NO: | Description | Sequence |
|---|---|---|
| | | HGEVLEQSLWFAKHELEFQSNGTTERKDHHHHVFDEKDVNK<br>PMRVLQEEGIIKFPANINFKDYFEYSMFPTLVYTLNFPRIRHIR<br>WAYVLQKVLGTFALVFAMIIVAEESFCPLMQEVEQYTRLPTN<br>QRFSKYFVVLSHLILPLGKQYLLSFILIWNEILNGIAELSRFGDR<br>HFYGAWWSSVDYMDYSRKWNTIVHRFLRRHVYNSTIRILGIS<br>RTQAAIITLLLSATIHELVMYILFGKLRGYLFLTMLVQIPMTVT<br>AKFNNRLWGNIMFWLTYLSGPSLVSALYLLF |
| SEQ ID NO: 47 | Diacylglycerol acyltransferase (DGA1) Nuc. Seq | atgactcaggactataaagacgatagtcctacgtccactgagttggacactaacatagaagaggtg<br>gaaagcactgcaaccctagagtcggaactcagacagagaaaacagaccacggaaactccagca<br>tcaaccccaccaccacctccacaacaacagcaggcgcataagaaagccctgaagaatggcaag<br>aggaagagaccatttataaacgtggcgccgctcaacacccgttggctcacaggctcgagacttt<br>ggctgttgtttggcactgtgtcagtatcccgttctttatgttttgttcttgcttacggtctccatggggtt<br>gcttgggtggttattatcattttgccatatttcatttggtggtacggtttcgactttgcacactccatcga<br>atggtaaagttgtctatcgtgtgcgcaactcgttcaagaatttcatcatttgggactggtttgtcaagta<br>tttcccgattgaagtgcacaagacggtcgagttggatcctacttttagcgaattgcctgtggaagag<br>agcggcgacagttcggacgacgacgaacaagacttggtgtctgagcacagcagaactttggttg<br>atcaaatcttcaagttttttcgggttgaagaaacgcttgaatgacacctccctgggcaaaccagaga<br>attcaagaatgtgcctacgggtccaaggtatatttttgggtaccacccacacggagtgatttctatgg<br>gggcagtgggttgttgccaacaacgccttgaggaacgaaccatatacgccaatttccaaatggt<br>taaaaccattcttccacgacagctccaagggcgagagattgttccctggtattggcaatatcttccca<br>ttgacgcttaccacacagtttgcgctccattttacctgactactgatggctttgggatcactagt<br>gcatcggctaaaaacattagaagcttgatcaacaatggagacaactctgtgtgtctcgtcgttggcg<br>gtgcacaagaatcgttgttgaacaatatgattgccaagcacgccagagtcgggtacggttacaaag<br>agagcctagatattcatggcgaccagtccgaagaagaagaagaagaagaggatgataccaagc<br>agctagagaacccaagtcctaaacgtgaagtgcaattggtcttgaacaaacgtaaaggttttgtgaa<br>gttggctatcgaactaggaaatgtttccttggtgcctatttttgcattcggagaagctgatgtttacaga<br>ttggcccagccagcaccaggctcgttcttgtacaagttccagcaatggatgaaggcaacttttcaat<br>tcaccatcccattgtttagtgctcgaggcgtgttcatctatgatttcggattgttgccattcagaaaccc<br>aataaacatttgcgtcggtagaccgtctacattccgcacaacgtcttgcaagaatacaagcaaaa<br>gcacccagaggagtttgccgaagaggaacctgccagtacccgatgaagaagtctgatcttca<br>ccgatatgttcaaagctggtgaaaagaagcccaagacttcaagtatcaagactaaaatcccacctg<br>cattactagacaagtaccacaagctatacgtcgacgagttgaagaaggtctatgaagagaacaag<br>gaaaggtttggctacggtgatgttgaattaaacattgtagaatag |
| SEQ ID NO: 48 | Diacylglycerol acyltransferase (DGA1) A.A. Seq | MTQDYKDDSPTSTELDTNIEEVESTATLESELRQRKQTTETPA<br>STPPPPPQQQQAHKKASKNGKRKRPFINVAPLNTPLAHRLETL<br>AVVWHCVSIPFFMFLFLLTVSMGLLGWFFIILPYFIWWYGFDL<br>HTPSNGKVVYRVRNSFKNFIIWDWFVKYFPIEVHKTVELDPTF<br>SELPVEESGDSSDDDEQDLVSEHSRTLVDQIFKFFGLKKRLND<br>TSSGKPETFKNVPTGPRYIFGYHPHGVISMGAVGLFANNALR<br>NEPYTPISKWLKPFFHDSSKGERLFPGIGNIFPLTLTTQFALPFY<br>RDYLMALGITSASAKNIRSLINNGDNSVCLVVGGAQESLLNN<br>MIAKHARVGYGYKESLDIHGDQSEEEEEEDDTKQLENPSPK<br>REVQLVLNKRKGFVKLAIELGNVSLVPIFAFGEADVYRLAQP<br>APGSFLYKFQQWMKATFQFTIPLFSARGVFIYDFGLLPFRNPIN<br>ICVGRPVYIPHNVLQEYKQKHPEEFAEEEPASTPMKKSGSFTD<br>MFKAGEKKPKTSSIKTKIPPALLDKYHKLYVDELKKVYEENK<br>ERFGYGDVELNIVE |
| SEQ ID NO: 49 | Diacylglycerol acyltransferase (LRO1) Nuc. Seq | atgtcgtctttaaagaacagaaaatccgcaagcgtcgccacaagcgatacagaagactcagaaac<br>agaggcagtatcctcctcaattgatcccaacggcaccatattgcgaccagtcctacatgacgaacc<br>ccaccacagccatcaccaccacaacataactagaccagtattggaggacgatggcagcatcctg<br>gtgtccagaagatcgtcgatctccaaatccgacgacctgcaggcaaagcaaaagaagaagaaac<br>ccaagagaagatcttggagtctcgtcggtcatgttatctttggtaccctccattgggttaatctttgc<br>gtgggcgtttaccacagacacgcatccttcaatggcgacttggagaagtttatcaactttgaccag<br>ctcaacgggatctttgacgactggaagaactggaaggatatcttgcccaacagcatccagacgta<br>cttgcaggaatcggcaagggcgaagataacgacgggttgcatggtctggccgattccttctccg<br>tcgggctccgcttgaaagcccagaagaacttcactgacaaccacaatgtcgtgttggttcctggtgt<br>ggtgagcacgggggttggaatcgtggggaacaaccaccaccggtgattgtccatctatcggatactt<br>caggaagagattgtggggatcattttatatgttaaggacaatgattttggagaaaacgtgctggttga<br>agcatatccagttgacgagaagacggggttggatcctcccaatattaaggtccgtgcggcgcag<br>ggtttcgaagcggcagatttctttatggctgggtactggatctgaacaagatcttgcagaacttgg<br>cggttattgggtacggaccaaataacatggtgagtgctagttatgactggagattggcttacattgac<br>ttggagagaagagatggatattttcgaacttaaagcgcagattgagttgaataacaagttgaaca<br>acaagaagactgtgttgattggccactcgatggggacccagattattttctacttttgaaatgggtcg<br>aagccaccgggaaccatactatggcaatggcggaccaaactgggtgaatgatcatattgagtcg<br>attattgacatcagtgggtcgactttgggtaccccaagagtattcctgtgttgatctctggggaaat<br>gaaagacaccgttcaattgaacgcgttggcggtttacgggttggagcaatttttcagcaggcgtga<br>aagagtcgatatgttgcgtactatttgtgccagtatgttgccaaggggggagacaagat<br>atggggcaacttgacgcatgcgccagatgatccaatttccacattcagtgatgacgaagttacgga<br>cagccacgaacctaaagatcgttcttttggtacgtttatccaattcaagaaccaaactagcgacgcta<br>agccatacagggagatcaccatggctgaaggtatcgatgaattgttggacaaatcaccgactggt<br>attccaagagagtccgtgagaactactcttacggcattacagacagcaaggcgcaattagagaag<br>aacaacaatgaccacctgaagtggtcgaacccattagaagctgccttgcctaaagcacccgacat |

| SEQ ID NO: | Description | Sequence |
|---|---|---|
| | | gaagatctattgtttctacggagttggaaatcctaccgaaagggcatacaagtatgtgactgccgat aaaaaagccacgaaattggactacataatagacgccgacgatgccaatggagtcatattaggaga cggagacggcactgtttcgttattaacccactcgatgtgccatgagtgggccaagggagacaagt cgagatacaacccagccaactcgaaggttaccattgttgaaatcaagcacgagccagacagattt gatttacgaggcggcgccaagactgcggaacatgttgatattttggggagtgccgagttgaacga gttgattttgactgtggttagcgggaacggggacgagattgagaatagatatgtcagcaacttaaaa gaaatagtagaggccataaatttataa |
| SEQ ID NO: 50 | Diacylglycerol acyltransferase (LRO1) A.A. Seq | MSSLKNRKSASVATSDTEDSETEAVSSSIDPNGTILRPVLHDEP HHSHHHHNITRPVLEDDGSISVSRRSSISKSDDSQAKQKKKKP KKKILESRRVMFIFGTLIGLIFAWAFTTDTHPFNGDLEKFINFD QLNGIFDDWKNWKDILPNSIQTYLQESGKGEDNDGLHGSADS FSVGLRLKAQKNFTDNHNVVLVPGVVSTGLESWGTTTTGDC PSIGYFRKRLWGSFYMLRTMILEKTCWLKHIQLDEKTGLDPP NIKVRAAQGFEAADFFMAGYWIWNKILQNLAVIGYGPNNMV SASYDWRLAYIDLERRDGYFSKLKAQIELNNKLNNKKTVLIG HSMGTQIIFYFLKWVEATGKPYYGNGGPNWVNDHIESIIDISG STLGTPKSIPVLISGEMKDTVQLNALAVYGLEQFFSRRERVDM LRTFGGVASMLPKGGDKIWGNLTHAPDDPISTFSDDEVTDSH EPKDRSFGTFIQFKNQTSDAKPYREITMAEGIDELLDKSPDWY SKRVRENYSYGITDSKAQLEKNNNDHSKWSNPLEAALPKAPD MKIYCFYGVGNPTERAYKYVTADKKATKLDYIIDADDANGVI LGDGDGTVSLLTHSMCHEWAKGDKSRYNPANSKVTIVEIKH EPDRFDLRGGAKTAEHVDILGSAELNELILTVVSGNGDEIENR YVSNLKEIVEAINL |
| SEQ ID NO: 3674 | ECI1, ATCC20336 (Nucleic Acid Seq.) | atgtccgacgaggaatcagatatcttatacgaggtcagagacagaaccgccatcatcaccttgaac atccccaagagattgaacgcattgaacggtgctcaatacttgaagttgggtaagttcttggagagag ccaacaacgaagaggacaccgtcttgacattgatccaggccctgggcagattcttctccgccggtg ccaatttcgccgacaacgatatggccaaggtcgaaatgtccaagttgttcagtcacgagtactggtt ggaaagattcgtcgccagaaacatctggttgaccaacttgttcaacgaccacaagaagatcttggct gctgctgtcaatggtccagttatcggtttgagcactggtttgttgttggtcgatttggtctacgtcca cgacttgaacaagttctacctcttggccccatttgccaacttgggtttggttgccgaaggtgcttcctct gccactttgttcaacagattgggctggtcaaaggcttctgaggccttgttgttggccaagccaatcgg cggccaagactgttacaacgccggttttcatcaacaagcactacgacggtaagttttcctccactgaa gagttcaacgaacacgtctacaaggagttgacggaagcttttgaaaacttgcacgatgactccatttt gcagaacaagcaattgttgaagttgtccagagaccaggccatcaactag |
| SEQ ID NO: 3675 | ECI1, ATCC20336 (Amino Acid seq.) | MSDEESDILYEVRDRTAIITLNIPKRLNALNGAQYLKLGKFLER ANNEEDTVLTLIQASGRFFSAGANFADNDMAKVEMSKLFSHE YWLERFVARNIWLTNLFNDHKKILAAAVNGPVIGLSTGLLLV DLVYVHDLNKFYLLAPFANLGLVAEGASSATLFNRLGWSKAS EALLLAKPIGGQDCYNAGFINKHYDGKFSSTEEFNEHVYKELT EAFENLHDDSILQNKQLLKLSRDQAIN* |
| SEQ ID NO: 3676 | ECI2, ATCC20336 (Nucleic Acid Seq.) | atgtccgacgaccttatcacctacgaagtcaaagaccgagctgccgtgatcaccttgaacaacccc aagagctcaacgccttcgatcccgcagtacgacaccatctgcaagctcttagaacgagccaac gccgaagaagacaccgtcatcaccttgctccagtccagggccgggtgttctctgccggggccaa cgccgactccatcgtggggcaggatgccgagctcgagacctggttgaacatgtcggtggccaag cagacgttcttggtgcagacgttcctcgcacacaagaagatccttgccgtcgccttgaacggcccc gtgattggcttatcggcggcgttcgtggcgctctggtctacggtgcacaacgccgcaaag acgttcttcttgaccccgttcgccaacatcgggatccttgccgagggcggcacctcagccacgttgc ccatgcgcgtggggtggtccagggccgcggaagcgttgttgttgtcaaagaggattcgggagat gacttgcagagagcggggttcttcaataaggactacaagggggcagttcaagtccgcggaggagttt aacgaggcgtcttgaaggagttgcttgacgccacggaaaacttgcatgaggactcgatcatccag aacaaggagttgttgaaggctattttcaagccaaagatcagtgaggtcaactcgcaggaggtgtca agaggtgtgtacaagtggaccctctgggtgccaatggatagattaaaaaattgcttaatggtgagtt gaaacataaaattatag |
| SEQ ID NO: 3677 | ECI2, ATCC20336 (Amino Acid seq.) | MSDDLITYEVKDRAAVITLNNPKKLNALSIPQYDTICKLLERA NAEEDTVITLLQSTGRVFSAGANADSIVGQDAELETWLNMSV AKQTFLVQTFLAHKKILAVALNGPVIGLSAAFVALCDLVYVH NAAKTFFLTPFANIGILAEGGTSATLPMRVGWSRAAEALLLSK RISGDDLQRAGFFNKDYKGQFKSAEEFNEVVLKELLDATENL HEDSIIQNKELLKAIFKPKISEVNSQEVSRGVYKWTSGVPMDRF KKLLNGELKHKL* |
| SEQ ID NO: 3678 | >gi\|50550800\|ref\| XM_502873.1\| Yarrowia lipolytica YALI0D15708p (YALI0D15708g) mRNA, complete cds | ATGTTGTCCATTCGATCCATTACCCGATCTCTCCCCATTGGC AGCCGAATCTGCCAGCAGAGTGCCATGAAGGCCTCTACTGT GCGACCTCTCGCCTTGAGAGCTTACTCCACCCGACCCCCTGT CACTCACTTCTCCGAGGAGGAGGAGATGTTTCGTGACATGG TTAGCAAGTTTGCTGATGAGGTGATTGCTCCCAAGGTCCGT GAGATGGACGAGGCCGAGCAGATGGACAAGACAATCATCC AGGACATGTTCGACAATGGCCTTATGGGCATCGAGACTCCC GAGGAGTTCGGTGGTGCAGGTGCCAACTTCACCTCTGCTAT |

| SEQ ID NO: | Description | Sequence |
|---|---|---|
| | (similar to uniprot\|P45954 Homo sapiens Acyl-CoA dehydrogenase short/branched chain specific mitochondrial precursor) | CATCGTCGTTGAGGAGCTTGCCAAGGTGGACCCCTCAGTGT CTGTGATGAACGATGTCCACAATACCCTCGTCAACACCTGC ATCCGATCCTGGGGATCCGACGCACTCCGAAACAAGTATCT CCCCCAGCTTGCTGCCCAGAAGGTCGGATCTTTCGCTCTTTC TGAGCCCTCTTCCGGATCTGATGCCTTCGCCATGAAGTCTCG AGCCACAAAGACTGACGATGGATACATTTTGAACGGTTCCA AGATGTGGATCACCAACGCTGCCGAGGCTGAGCTTTTCATT GTTTTTGCTAATCTCGATCCCAGCAAGGGCTACAAGGGTAT TACTGCCTTTGTTGTCGAGAAGGACATGGGAGTGCAGATTG CTAAGAAGGAGCAGAAGCTGGGTATCCGAGCCTCTTCTACC TGCGTTCTCAACTTCGAGGACGTTTTCATTCCTAAGGAGAA CCTTCTTGGCGAGGAGGGCAAGGGCTACAAGATTGCTATCG AGTGCTTGAACGAGGGCCGAATCGGAATTGCGGCCCAGAT GCTTGGCCTTGCTGGTGGAGCTTTCAAGAAGGCTACCGGCT ATGCTTTCAACGACAGAAAGCAGTTCGGCCAGTACATCGGT GAGTTCCAGGGTATGCAGCACCAGATTGGCCAGGCCGCTAC TGAGATCGAGGCTGCTCGACTCCTGGTCTACAACGCTGCCC GACTCAAGGAGGCTGGCGTTCCTTTCACAAAGGAGGCTGCT ATGGCAAAGCTCTATGCTTCCCAGGTTGCAGGAAACGTCGC ATCCAAGGCTGTCGAATGGATGGGTGGTGTCGGATTCACTC GAGAGGAGACTCTGGAGAAGTTCTTCCGAGATTCTAAGATC GGTGCCATTTACGAGGGAACTTCCAACATCCAGCTGCAGAC TATTGCCAAGATCATCCAGAAGGAGTCTGCCTAA |
| SEQ ID NO: 3679 | >gi\|49648741\|emb\|CAG81061.1\| YALI0D15708p [Yarrowia lipolytica CLIB122](similar to uniprot\|P45954 Homo sapiens Acyl-CoA dehydrogenase short/branched chain specific mitochondrial precursor) | MLSIRSITRSLPIGSRICQQSAMKASTVRPLALRAYSTRPPVTHF SEEEEMFRDMVSKFADEVIAPKVREMDEAEQMDKTIIQDMFD NGLMGIETPEEFGGAGANFTSAIIVVEELAKVDPSVSVMNDVH NTLVNTCIRSWGSDALRNKYLPQLAAQKVGSFALSEPSSGSDA FAMKSRATKTDDGYILNGSKMWITNAAEAELFIVFANLDPSK GYKGITAFVVEKDMGVQIAKKEQKLGIRASSTCandidaLNFEDV FIPKENLLGEEGKGYKIAIECLNEGRIGIAAQMLGLAGGAFKKA TGYAFNDRKQFGQYIGEFQGMQHQIGQAATEIEAARLLVYNA ARLKEAGVPFTKEAAMAKLYASQVAGNVASKAVEWMGGVG FTREETLEKFFRDSKIGAIYEGTSNIQLQTIAKIIQKESA |
| SEQ ID NO: 3680 | >gi\|210075528\|ref\|XM_501919.2\| Yarrowia lipolytica YALI0C16797p (YALI0C16797g) mRNA, complete cds (similar to uniprot\|Q96VP9 Glomus intraradices Probable acyl-CoA dehydrogenase) | ATGAGCGAGCAGTACACCCCCGAACAAGTTGCGGAGCACA ACTCTCCCGAATCTCTGTGGATCATCATTGACGGTAACGTTT TCGACCTCACTGAATTCCAGAAAGAACACCCCGGCGGAAA AAAGATTCTCAAACGAGTCGCAGGAAAAGACGCTACCAAG TTTTTCCACAAATACCACGACGCCCCAAGATTATGCGAAA GGTTGGACACAAGTTCAAGATCGGAACCCTTAAAGACGCTG AAGCAAACCCCACTCGAGCCATGATTGCCCCTAACAAGACC ACCGCCCTCGAGCCCTACGAGACCTTGTCCCCTACGCCGA CCCCAACTGGTACCACGGCTACCACAACCCCTACTACAAGG AGTCCCACGCCAAGCTGCGTGACGAGGTCCGACAGTGGGTT GAGGAGAAGATTGAGCCCTTCGTTGAGGAATGGGATGAGG AGAAGGAGGTTCCCAAGGAGATCTTCCAGGAGATGGGCAA GCGAGGTTACCTTGCCGGCTCTCTCGGCACCCCCTACAAGG AGCTGGCCAAGTACACCAACGTCAAGCCCGCCTCTGTGCCC ATTGAGGAGTACGAGACATGTTCCACGAGCTCATCATCACCGA CGAGATCATGCGAGCTGGCTCCGGAGGTCTCACCTGGAACC TGCTTGGTGGCTACTGTATTGGTCTGCCTCCCGTGATCAAGT CGCCAAGGAGCCCCTTAAGGAGCGAATCCTCCCCGGCCTG CTCGACGGTTCCAAGCGAATCTGTCTGTGTATCACTGAGCC CGACGCTGGCTCCGATGTTGCCAACATCACCACTACCGCCG AGAAGACCCCCGACGGAAAGTTCTACATTGTCAACGGTATC AAGAAGTGGATCACCAACGGTATCTGGGCTGACTACTTCAC TGTTGCCGTCCGAACCGGTGGCCCCGGCTCTGGCATGAACG GTATCTCTGTTCTGCTGCTCGAGCGAGGCATGGAGGGTCTT GAGACCCGACGAATGAACACTCAGGGTATGCTGTCTTCCGG CTCTACCTGGGTCACCATGGAGGATGTCAAGGTCCCCGTGG AGAACCTGCTCGGCAAGGAGAACAAGGGTTTCAAGGTCAT CATGACCAACTTCAACCACGAGCGAGTTGGTATCATCATCC AGGCAAACCGAGCTTCTCGAGTTTGCTACGAGGAGGCCTGC AAGTACGCCCACAAGCGAAAGACTTTCGGCAAGCCTCTGAT TGAGCACCCCGTCATCCGAGCCAAGCTCGCCAACATGGCCA TTCGAATCGAGTCCACCCACGCCTGGCTCGAGAACCTGGTC TTCCAGTGCCAGATGTTCCCCGAGGAGGAGGCCATGCTTCG ACTTGGTGGTGCCATTGCTGGTTGCAAGGCCCAGGCCACCC AGACCCTCGAGCTGTGTGCCCGAGAGGCTTCCCAGATCTTT |

| SEQ ID NO: | Description | Sequence |
|---|---|---|
| | | GGTGGTCTTTCCTACACCCGAGGCGGTCTCGGAGGTAAGGT<br>TGAGCGACTGTACCGAGAGGTCCGAGCCTACGCCATCCCCG<br>GTGGATCCGAGGAGATTATGCTGGATCTGGCCATGCGACAG<br>GCCCTCAAGGTCCACAAGGCTGTTGGCGCCAAGCTTTAA |
| SEQ ID NO: 3681 | >gi\|199425292\|emb\|CAG82239.2\| YALI0C16797p [Yarrowia lipolytica CLIB122](similar to uniprot\|Q96VP9 Glomus intraradices Probable acyl-CoA dehydrogenase) | MSEQYTPEQVAEHNSPESLWIIIDGNVFDLTEFQKEHPGGKKIL<br>KRVAGKDATKFFHKYHDAPKIMRKVGHKFKIGTLKDAEANPT<br>RAMIAPNKTTALEPYGDLVPYADPNWYHGYHNPYYKESHAK<br>LRDEVRQWVEEKIEPFVEEWDEEKEVPKEIFQEMGKRGYLAG<br>SLGTPYKELAKYTNVKPASVPIEEYDMFHELIITDEIMRAGSGG<br>LTWNLLGGYCIGLPPVIKFAKEPLKERILPGLLDGSKRICLCITE<br>PDAGSDVANITTTAEKTPDGKFYIVNGIKKWITNGIWADYFTV<br>AVRTGGPGSGMNGISVLLLERGMEGLETRRMNTQGMLSSGST<br>WVTMEDVKVPVENLLGKENKGFKVIMTNFNHERVGIIIQANR<br>ASRVCYEEACKYAHKRKTFGKPLIEHPVIRAKLANMAIRIEST<br>HAWLENLVFQCQMFPEEEAMLRLGGAIAGCKAQATQTLELC<br>AREASQIFGGLSYTRGGLGGKVERLYREVRAYAIPGGSEEIML<br>DLAMRQALKVHKAVGAKL |
| SEQ ID NO: 3682 | >gi\|50556785\|ref\|XM_505801.1\| Yarrowia lipolytica YALI0F23749p (YALI0F23749g) mRNA, complete cds (highly similar to uniprot\|Q7S579 Neurospora crassa NCU02291.1 hypothetical protein probable Glutaryl-CoA dehydrogenase) | ATGCTTACCAGAATCTCCCGTTTGGCACCTGCTGCCCGAGG<br>CTTTGCTACCTCCTCCGTCAACCGATCCACAGCCGCCATGG<br>ACTGGCAGGATCCCTTCCAGCTGGACTCTCTTCTCACCGAG<br>GACGAGATTGCCGTGGCTGAGGCTGCTCGAGACTTCTGCCA<br>GACAGAGCTCTACCCCAAGGTACTTGAGGGCTACGAACCG<br>AGGAGTTCCCCCGAAGCATCATGAAGCAGATGGGTGAGGTT<br>GGTCTGCTCGGAACAACCGTCAAGAGCCACGGATGCCCCGG<br>CATGTCTTCTGTCGCTTACGGTCTCGTGGCCCGAGAGGTCG<br>AGAGGGTCGACTCCGGCTACCGATCTGCCATGTCTGTGCAG<br>TCGTCGCTGGTCATGCACCCCATTGAACAGTTTGGATCCCA<br>GGAGCAGAAGGACCGGTTCCTGCCCAAATTGGCCTCCGGCG<br>AGATGATCGGCTGCTTCGGTCTCACCGAGCCTAACCACGGT<br>TCCGACCCTGGATCCATGGAGACCGTCGCCAAGATGCACCC<br>TACTAAGAAGGGCGTCATTGTGCTCAATGGAGCCAAGAACT<br>GGATCACTAACTCTCCTATTGCCGATCTCATGGTTGTGTGGG<br>CCAAGTTGGACGGTAAGATCCGAGGCTTCCTTGTCGAGCGA<br>TCTCAGGTCGCCTCCGGCCTCGCTACTCCCGCCATCAAGAA<br>CAAGACCGCTCTGCGAGCCTCCATCACCGGTATGATCCAGA<br>TGGACGACGTTGAGATCCCTGTGGAGAACATGTTCCCCGAG<br>GTGACCGGTCTCAAGGGCCCCTTCACCTGCCTCAACTCTGC<br>CCGATACGGTATCGCCTGGGGAACCATGGGCGCTCTGTCCG<br>AGTCCATCAAGCTCGCTCGAGAGTACTCTCTGGACCGAAAG<br>CAGTTTAAGGGCCAGCCTCTGGCCAAGTACCAGCTCATCCA<br>GAAGAAGCTCGCTGACGCTCTGACCGATGCCACCTACGGAC<br>AGGTCGCTGCCATTCAGGTCGGCCGGCTCAAGGATGCCGGC<br>AATTGTCCTCCCGAGCTCATCTCCATGATTAAGAGACAGAA<br>CTGTGACCGAGCCCTCGCTGGCGCTCGAAACCTGATGGAGA<br>TCTTTTGGCGGTAACGCTGCCTCTGACGAGTACCACATTGGC<br>CGAATTGCCGCCAACCTGTGGGTTGTCCAGACCTATGAGGG<br>CCAGTCTGATATCCATGCTCTCATCCTGGGAAGAGCCATGA<br>CCGGCGTCCAGGCTTTTGCTTAA |
| SEQ ID NO: 3683 | >gi\|50556786\|ref\|XP_505801.1\| YALI0F23749p [Yarrowia lipolytica] (highly similar to uniprot\|Q7S579 Neurospora crassa NCU02291.1 hypothetical protein probable Glutaryl-CoA dehydrogenase) | MLTRISRLAPAARGFATSSVNRSTAAMDWQDPFQLDSLLTEDE<br>IAVAEAARDFCQTELYPKVLEGYRTEEFPRSIMKQMGEVGLLG<br>TTVKSHGCPGMSSVAYGLVAREVERVDSGYRSAMSVQSSLV<br>MHPIEQFGSQEQKDRFLPKLASGEMIGCFGLTEPNHGSDPGSM<br>ETVAKMHPTKKGVIVLNGAKNWITNSPIADLMVVWAKLDGKI<br>RGFLVERSQVASGLATPAIKNKTALRASITGMIQMDDVEIPVE<br>NMFPEVTGLKGPFTCLNSARYGIAWGTMGALSESIKLAREYSL<br>DRKQFKGQPLAKYQLIQKKLADALTDATYGQVAAIQVGRLK<br>DAGNCPPELISMIKRQNCDRALAGARNLMEIFGGNAASDEYHI<br>GRIAANLWVVQTYEGQSDIHALILGRAMTGVQAFA |
| SEQ ID NO: 3684 | >gi\|255723091\|ref\|XM_002546434.1\| Candida tropicalis MYA-3404 conserved hypothetical protein, mRNA | ATGTCAGTCAAAGAAGATATCCCAGCTGTTTTTCTTTCCCAA<br>ATTTCTCCTCGTGGTCTTGAAGCTATCCAGAAAACCAAAGA<br>CTTTGTCAATGACTACTGTATTCCAGCCGATGAAATCTACTT<br>CAAACAGGTCTCTACTGATCCTGCCAAAAGATGGAAAACAA<br>TCCCACCTATTATTGAGACATTGAAATCCAAAGCCAAAGAA<br>CTTGGTTTATGGAATATGTTTTATCCAAACATTATAAGGAA<br>GGTCCACAATATACCAACTTAGAATATGGTTTGATGGCTAG<br>ATATTTGGGTCGTGCACACACTGCTCCTGAAGCTACTAATA |

| SEQ ID NO: | Description | Sequence |
|---|---|---|
| | (similar to *C. albicans* ACD99) | CTGCTGCTCCAGATACTGGTAACATGGAATTACTTGCTAAA TACGGTACTCCATACCAAAAAGAAAAGTACTTACAACCATT GTTAGATGGAAAGATCAGATCTGCTTTCTTGATGACCGAAA AGGGCACATCATCTTCCAATGCATTAAATATCTCCACTAGT GCCAAAAAGAATGCCAGTGGTAACTATGTTCTTGATGGTGT AAAGTGGTTTGCTTCAGGTGCTGGTGATCCAAGGTGTTCTG TTTGGTTGGTCATGTGTAAAACTGAAGACAATAAGAAGAAC CCATATGCAAACCACACCGTGTTGGTTCTTGATGCCAAGAG AGCATTGGCTAGCGGCAGGGCCAAATTAGTCAGACCTTTGC ATGTTATTGGATATGATGATGCTCCTCATGGTCATTGTGAAA TTTCTTTTGAAAACTACGAAGTTCCTGCTGACGAAATGCCA AATGCTGTTTTGGCCGGTATTGGAAGAGGATTTGAGTTGAT TCAGTCTAGATTAGGACCTGGTAGAATTCATCATTGTATGA GAGCTATTGGTACAGGTGAAATTGCATTGTTGATCATTGCT CATAGAGCTAACCACAGAATGATTTTTGGAAAACCAATGAA AGACAGAGAAGGATTTTTGTCTAAGTTCGGTCAGAGCAGAA TTGATATTACCAGATGCTTGTTATTGGTATTAAATGCTGCTC ATAAAATTGATATTTCCAACGCAAAGGCTGCTCAGAAAGAG ATTGCCATGGCTAAGATTGAAACACCAAGAACCATCTCTGA TATCCTTGACTGGGGTATCCAAGTTTTTGGCGCAGAAGGGG TCTCACAAGACACAGACTTAGCTAGAATGTATGCTCTCAAC AGAACCTTGAGAATTGCTGATGGTCCTGATGAAGCTCACTT GGCACAATTGGCAAGAAATGAGGCCAAAAAATTCCCAGAG GTCGATATCTTCTTTGAACATGTTGCTAGTCAACGTAATAAA TTATAG |
| SEQ ID NO: 3685 | >gi\|240130997\| gb\|EER30559.1\| conserved hypothetical protein [*Candida tropicalis* MYA-3404] (similar to *C. albicans* ACD99) | MSVKEDIPAVFLSQISPRGLEAIQTKDFVNDYCIPADEIYFKQ VSTDPAKRWKTIPPIIETLKSKAKELGLWNMFLSKHYKEGPQY TNLEYGLMARYLGRAHTAPEATNTAAPDTGNMELLAKYGTP YQKEKYLQPLLDGKIRSAFLMTEKGTSSSNALNISTSAKKNAS GNYVLDGVKWFASGAGDPRCSVWLVMCKTEDNKKNPYANH TVLVLDAKRALASGRAKLVRPLHVIGYDDAPHGHCEISFENYE VPADEMPNAVLAGIGRGFELIQSRLGPGRIHHCMRAIGTGEIAL LIIAHRANHRMIFGKPMKDREGFLSKFGQSRIDITRCLLLVLNA AHKIDISNAKAAQKEIAMAKIETPRTISDILDWGIQVFGAEGVS QDTDLARMYALNRTLRIADGPDEAHLAQLARNEAKKFPEVDI FFEHVASQRNKL |
| SEQ ID NO: 3686 | XP_716423.1\| probable acyl-CoA dehydrogenase [*Candida albicans* SC5314] | MSVKEDIPAVFLEKVSPRGLEAIQTKDFVNDYCLPADQIYFE QLSDIPSERWKSVPPVIETLKKKAKELGLWNMFLSKHYKEGPQ YTNLEYGLMARYLGRSYTAPEATNTAAPDTGNMELFAKYGT TYQKDRYLKPLLNGEIRSAFLMTEKGVSSSNALNISTSAVKNS NGNYVLNGVKWFASGAGDPRCSVWLVMCKTDNNKQNPYQN HTVLIIDAKKALATGKAKLIRPLQVIGFDDAPHGHCEIQFQDYE VPADEMPNVVMAGVGRGFELIQSRLGPGRIHHCMRAIGAGEF ALLRIAHRANHRLIFGKPMNQREGFLSRYGQSKIDIERCLLLVL NAAHKIDISNAKEAQKEIAMAKIETPRTISDILDWGIQVYGAEG MSQDTELARMYAHNRTLRIADGPDEAHLAQLARNEAKKFAK VDDFFANMETQRSKL |
| SEQ ID NO: 3687 | XM_711330.1\| *Candida albicans* SC5314 probable acyl-CoA dehydrogenase (ACD99) mRNA, complete cds | ATGTCAGTTAAAGAAGACATTCCTGCTGTTTTCCTTGAAAA GGTTTCTCCTCGTGGTCTCGAAGCCATCCAGAAAACCAAAG ATTTCGTTAACGATTATTGTCTTCCAGCCGATCAAATTTATT TTGAACAACTTTCAGACATCCCATCAGAAAGATGGAAGAGT GTTCCTCCTGTCATTGAGACATTGAAGAAGAAAGCCAAGGA ACTTGGTTTATGGAACATGTTTTTGTCAAAGCATTATAAGG AAGGTCCACAATATACAAACTTAGAGTATGGATTGATGGCC AGATACTTGGGTCGTTCATACACAGCACCAGAGGCTACCAA CACAGCTGCTCCAGATACCGGTAATATGGAATTGTTTGCCA AATATGGAACCACTTATCAGAAAGATAGATACTTGAAACCC TTGTTAAATGGGGAAATTAGATCAGCATTCTTGATGACAGA AAAAGGTGTTTCATCATCTAATGCTCTCAATATTTCTACAAG TGCTGTCAAGAATTCGAATGGAAATTACGTGCTCAATGGTG TCAAATGGTTTGCTTCAGGTGCAGGAGATCCAAGATGTTCC GTCTGGTTGGTGATGTGCAAGACAGACAACAACAAGCAAA ATCCATATCAAAACCACACAGTTTTGATCATCGATGCCAAA AAGGCTTTGGCTACTGGAAAAGCCAAATTGATCAGACCATT GCAGGTCATTGGTTTTGATGATGCTCCTCATGGACATTGTGA GATTCAATTTCAAGATTACGAAGTTCCTGCCGATGAAATGC CTAATGTTGTTATGGCTGGTGTTGGTAGAGGATTTGAGTTG ATTCAATCCAGATTGGGTCCAGGTAGAATCCACCATTGTAT GAGAGCTATTGGTGCTGGTGAATTTGCATTATTGAGAATTG CTCACAGAGCAAATCACAGATTGATTTTTGGTAAACCTATG AACCAGAGGGAAGGATTCTTATCCAGATACGGACAAAGCA AAATCGACATTGAAAGATGTTTATTGTTGGTGTTGAATGCT |

| SEQ ID NO: | Description | Sequence |
|---|---|---|
| | | GCTCACAAAATTGATATTTCCAATGCCAAAGAAGCACAAAA<br>GGAAATTGCTATGGCTAAGATTGAGACCCCGAGAACTATCT<br>CTGATATTCTCGATTGGGGTATTCAAGTTTATGGTGCTGAGG<br>GTATGTCACAAGATACCGAGTTGGCCAGAATGTATGCTCAT<br>AACAGAACATTGAGAATAGCTGATGGACCTGATGAAGCTC<br>ATTTGGCCCAATTGGCTAGAAATGAAGCTAAAAAGTTTGCA<br>AAAGTTGACGACTTTTTCGCCAACATGGAAACTCAACGTAG<br>CAAATTATAA |
| SEQ ID NO: 3688 | acyl-CoA dehydrogenase NM domain-like protein [Candida tenuis ATCC 10573] (similar to C. albicans ACD99) | ATGACAGACCTTGACATTCCAGCAGTATTCCTTGATAAGAT<br>CTCACCACGTGGCCTCGAGGCGATCCGCAAGACCTACGACT<br>TTGTGCATAACTACTGTATTCCTGCGGATGCTCTCTACTTTG<br>ACCAAATTTCCCAGGATCCCGAACAAAGGTGGAAAACCACT<br>CCTGAAGTCACTGAAAAATTGAAACAAAAGGCCAAACAAT<br>TAGGTTTGTGGAACATGTTCCTCTCTAAGCACTATACCGATG<br>GACCTGGCTACACAAACTTGGAGTATGGCCTTATGGCGCAA<br>TTCTTGGGCCGGTCGTTCGTGGCACCCGAGGCCACCAATAC<br>AGGTGCACCCGATACAGGTAACATGGAGATTCTCGCCAAGT<br>TCGGCTCGGCCTATCACCGGGAGCAGTACCTCCTTCCATTG<br>CTCCGCGGTGAGATCCGCTCGGCGTTCTTGATGACAGAAAA<br>AGGCACTTCTTCATCCAATGCCTTGAACATCTCATGCTCGGC<br>CCAGAAGAATTCACACGGCAACTACGTTCTCAATGGAGTCA<br>AGTGGTTTGCCTCTGGTGCAGGTGATCCTCGGTGTCGCGTGT<br>GGTTGGTGATGTGCAAAACCGAGTCTCTGGACAACATCTAC<br>CGTAATCACAGTGTGTTGGTGTTGGATGCGAAAAAGGCTTT<br>AGCTTCAGGAAAAGCCAAATTGATCCGACCACTCAGCGTGT<br>TTGGCTATGACGATGCTCCTCATGGACACTGTGAGGTGGAG<br>TTCAACGACTTTGAGGTGCCAGCCGAGGATATGGATAATTC<br>TATCCTTGGTAAGGTGGGTATGGGATTTGAGATCATCCAGT<br>CTCGTTTAGGCCCTGGGCGTATTCACCACTGTATGCGTCTTA<br>TTGGTGCCGGAGAATATGCCTTAATGAGGGCGGTGCTGAGG<br>GCTGCCGGCAGAGACATTTTCGGCAAGCCCATGGTGAAGAG<br>AGAATCATTTCTCAATGCTTATGGAGAGCATAAGCTTTCAC<br>TTCAGAAATGCCGTCTTTTGGTGCTTAATGCAGCTCATCAAA<br>TCGATATTTCGAATGCTAAGACTGCCAAAAGAGATATAGCC<br>ATGGCCAAAATCGAGACTCCCAGAGCAGTATTGAAGATTCT<br>TGACTGGTGTATTCAGGTTTATGGGGCTGAAGGAGTGTCTC<br>AAGACACAGAGCTTGCAAAGATGTATGCTCACGCTCGGACT<br>TTGAGAATCGCAGATGGACCAGATGAAGCACACCTTGGAC<br>AGCTTGCACGGGACGAGTCAAAGAAGTTTGCGGAGGTGGT<br>GAAGTACTTTGAGGGACACAAGGCACGTCAAGACCAAGTC<br>CTGAAGTTGTGA |
| SEQ ID NO: 3689 | >gi\|344233800\|gb\|EGV65670.1\| acyl-CoA dehydrogenase NM domain-like protein [Candida tenuis ATCC 10573](similar to C. albicans ACD99) | MTDLDIPAVFLDKISPRGLEAIRKTYDFVHNYCIPADALYFDQI<br>SQDPEQRWKTTPEVTEKLKQKAKQLGLWNMFLSKHYTDGPG<br>YTNLEYGLMAQFLGRSFVAPEATNTGAPDTGNMEILAKFGSA<br>YHREQYLLPLLRGEIRSAFLMTEKGTSSSNALNISCSAQKNSHG<br>NYVLNGVKWFASGAGDPRCRVWLVMCKTESSDNIYRNHSVL<br>VLDAKKALASGKAKLIRPLSVFGYDDAPHGHCEVEFNDFEVP<br>AEDMDNSILGKVGMGFEIIQSRLGPGRIHHCMRLIGAGEYALM<br>RAVSRAAGRDIFGKPMVKRESFLNAYGEHKLSLQKCRLLVLN<br>AAHQIDISNAKTAKRDIAMAKIETPRAVLKILDWCIQVYGAEG<br>VSQDTELAKMYAHARTLRIADGPDEAHLGQLARDESKKFAEV<br>VKYFEGHKARQDQVSKL |
| SEQ ID NO: 3690 | >gi\|50309254\|ref\| XM_454634.1\| Kluyveromyces lactis NRRL Y-1140 hypothetical protein partial mRNA (similar to C. albicans ACD99) | ATGCCTAATGTCAGTGATAGACCGCGGACATATAAGAAACC<br>TGCTTTAGAAGATGTTGATCCCATCACAAACTATATACCTG<br>CCAGTGTTAGGGATAAATTTGATGAGAGGCAGATGGATCGG<br>TTCAAGAAGTTGCGGAAATTTGTTGAGTTTGAATGTTTGCC<br>ATTAGATACGGTGTATTTGCAAGAGAGTACCCTATTTGAGC<br>ATGAAAGCGATTTAGAGACGTGCCCAGTCATTATTAATTTA<br>AGGAAGAAATTGGAGGCATACCAGTTGCATAAAATGTTTGT<br>TCCAATGGATCAACGTGGGTACGACCATAGTTTCAACGATA<br>ATTGGGAAGTGGTGAGTATGGTTGAATTTGCTATGATCGCT<br>TTCCTTGCTGGAAGATCTGTCATTGCCAGTTATTTGTTCCAT<br>TTGGATGATTTGATCGATTTAGGAACTATACAAGTTTTGTTG<br>AGAAATGGTTGTTCGAACCATGATTTGTGGGTACAAGTGAT<br>AGATGAGTTAGTTTCTAATAATATGAAATCGTGTTTGATGG<br>TAAGTGAAAGAGATGTGTCTGGTTCTGATGCGTTGAACGTT<br>CAAACCACCTGTAAAATTGAAGGGGATGATCTAAACGAAG<br>AGGAGGCTACTATGACACTTAACGGTACTAAATGGTTTATC<br>AAAGATGCAGGAGACTCAGATATTTGGTTAGTTTTATGTGT<br>CACTGAATTTGATGAGGGCAACATTTATAGAAAACATACAT<br>TATGCCTTGTTAACAGGAATGATTTACCACCAAATTCAACA<br>AGAATTGAACCTATAGAAACAAATGAAGCGATTGGTAAATT |

| SEQ ID NO: | Description | Sequence |
|---|---|---|
| | | TTATGAAGTACAATTTAAAGATTGTAAAGTACCGTTAAATA<br>TTATTGGTGAAAGAGGTGAAGGTTATCAAATTTTACAAATG<br>AAATCCTCTGTTACAAAATTATTTCAATGCTTAAAACTTTGT<br>GGTATGGGACAAGAATCCTTGAGACTTTCCAATAAGAGAGC<br>TGCTGAAAGGAAAGTGTTTGGTTCCAAATTACAGAAGAGTG<br>AGTATTTCAAATTTGATCTTGCTCATTGGAGGATTAAGATTG<br>AAACCTGTAAGCTGCTTTGTTCAACGCGGCAATCAAATGT<br>GATTACGAAGGTGTAAAAGCGGCAAGAGAAGAAATTGGGA<br>TGGTGAAAGCCGTGACACCAAAGGAAATCTCGTCACTGGTG<br>GATTGGTCTATCCAGTTGCATGGATGTTACGGACTCTGTTCA<br>ACACAAACACCCTTGTCACATATGTGGCAAGTGAGTCGATC<br>GCTAAGAATTAATGATACGCCGGACGAATCATTAATATCAC<br>AACTGGGGAGGTTGGAAATCAGTAATTATAACAAATTTCAA<br>AAGACATACGATCAAGAATTAACGACGCTCGCTGGCAAAT<br>GA |
| SEQ ID NO: 3691 | >gi\|49643769\|emb\|CAG99721.1\| KLLA0E15181p [*Kluyveromyces lactis*] (similar to *C. albicans* ACD99) | MPNVSDRPRTYKKPALEDVDPITNYIPASVRDKFDERQMDRFK<br>KLRKFVEFECLPLDTVYLQESTLFEHESDLETCPVIINLRKKLE<br>AYQLHKMFVPMDQRGYDHSFNDNWEVVSMVEFAMIAFLAG<br>RSVIASYLFHLDDLIDLGTIQVLLRNGCSNHDLWVQVIDELVS<br>NNMKSCLMVSERDVSGSDALNVQTTCKIEGDDLNEEEATMTL<br>NGTKWFIKDAGDSDIWLVLCandidaTEFDEGNIYRKHTLCLVN<br>RNDLPPNSTRIEPIETNEAIGKFYEVQFKDCKVPLNIIGERGEGY<br>QILQMKSSVTKLFQCLKLCGMGQESLRLSNKRAAERKVFGSK<br>LQKSEYFKFDLAHWRIKIETCKLLCFNAAIKCDYEGVKAAREE<br>IGMVKAVTPKEISSLVDWSIQLHGCYGLCSTQTPLSHMWQVSR<br>SLRINDTPDESLISQLGRLEISNYNKFQKTYDQELTTLAGK |
| SEQ ID NO: 3692 | >gi\|301507715\|gb\|GU338397.1\| *Candida rugosa* propionyl-CoA dehydrogenase mRNA, complete cds (similar to *C. albicans* ACD99) | ATGTCGATTAAGGACGACATCCCTGCCATCTTTTACGAAAA<br>ACTTTCCCCCCGCGGGCTTGAGGCTATCGCCAAAACCAAGG<br>AATTCGTCGACACTTACTGCTCCCCCGCCGACGAGATCTAC<br>TTCCAACAGGTGAGAACTGACGACCGCCGGTGGAAGGAAA<br>CGCCCCCCATCACCGAGCACTTGAAGAAGAAAGCTAAAGA<br>GCTCGGGTTATGGAACATGTTCTTGCTGAAGCACTACGCCG<br>AGGGCGCCGGCTACACCAACTTGGAGTATGGGCTTATGGCC<br>CAGTACCTTGGCCGCCAGTCACATCGCCCCTGAAGCTACCAA<br>CACCAATGCTCCTGACACCGGCAACATGGAGATCCTTGCCA<br>AGTACGGCAACGACTACCACAAGCAGCGCTACCTCCAGCCG<br>CTTCTCGACGGTAAAATCCGCCTGGCGTTCTTAATGACGGA<br>AAAGGGGACGTCGCTGTCCAACGCCCTTAACATCTCGTGCC<br>TGGCAAAACTTAACCAAAATGGCAACTACGTCATCAACGGC<br>GTCAAGTGGTTCGCCCTGGGTGCCGGCGACCCCCGGTGCAA<br>GGTGTGGTTGACGATGTGCAAGACCAGCGACGACGACGCC<br>AACCCATATTTCAACCACTCGTTGCTTGTGCTTGATGTCGAC<br>AAGGGCCCTCGCCCTGGGACAGGCTCGTGTTGTCCGCCCGTT<br>GCACGTGTTTGGCTACGACGACGCTCCTCACGGTCACTGTG<br>AAATTGAATTTAACAACTACGAAGTGTCCAAAGAGGAAAT<br>GGCCAACGTCATCCTCGGCCAGGTGGGCCAAGGATTTGCCA<br>TCATCCAGCTGAGATTGGGGCCGGGGCGCATCCACCACTGC<br>ATGCGGATGATTGGCGTCGGCGAATTCGCCTTGATGAGAGT<br>GGCTCAGCGGGCTAACCACCGTATCATCTTCGGTAAGCCCA<br>TGGCCAAGCGCGAACTGTTTTTGAACGCCTACGCTCAGGCA<br>AAGATCGACATCCAAAAGTGCCGCTTGTTTGTTCTTAATGC<br>CGCCCACCACATCGACATTGCCGGAGCCAAAGCGGCGCAA<br>GCCGACATCGCCATGGCCAAGATCGAGACCCCGAGAACCA<br>TCCTTCGCATCTTGGACTGGGGGATCCAGATGTTTGGCGCC<br>GAAGGGGTGTCTCAAGACACCGAGCTCTCGCGCATGTACGC<br>GTTGGGGCGGACGTTACGCATTGCCGACGGCCCCGATGAAG<br>CTCACTTGGGCCAATTGGCCCGTAAGGAGCTGAAGAAGTTC<br>CCTTACGTCGATGAGTACTTTAAGCGGTTTGAAGAAAATAA<br>GGCGAAGTTGGCCAAGTTGTAA |
| SEQ ID NO: 3693 | >gi\|301507716\|gb\|ADK77878.1\| propionyl-CoA dehydrogenase [*Candida rugosa*] (similar to *C. albicans* ACD99) | MSIKDDIPAIFYEKLSPRGLEAIAKTKEFVDTYCSPADEIYFQQV<br>RTDDRRWKETPPITEHLKKKAKELGLWNMFLSKHYAEGAGY<br>TNLEYGLMAQYLGRSHIAPEATNTNAPDTGNMEILAKYGNDY<br>HKQRYLQPLLDGKIRSAFLMTEKGTSSSNALNISCSAKLNQNG<br>NYVINGVKWFASGAGDPRCKVWLTMCKTSDDDANPYFNHSL<br>LVLDVDKALASGQARVVRPLHVFGYDDAPHGHCEIEFNNYEV<br>SKEEMANVILGQVGQGFAIIQSRLGPGRIHHCMRMIGVGEFAL<br>MRVAQRANHRIIFGKPMAKRESFLNAYAQAKIDIQKCRLFVLN<br>AAHHIDIAGAKAAQADIAMAKIETPRTILRILDWGIQMFGAEG<br>VSQDTELSRMYALGRTLRIADGPDEAHLGQLARKESKKFPYV<br>DEYFKRFEENKAKLAKL |

| SEQ ID NO: | Description | Sequence |
|---|---|---|
| SEQ ID NO: 3694 | >gi\|380353348: 214809-216140 Candida orthopsilosis Co 90-125, chromosome 4 draft sequence (similar to C. albicans ACD99) | ATGTCAGTTAAAGACGATATCCCAGCTATCTTTTTAGATAA GGTTTCTCCAAGAGGTCTTGAAGCAATTCAAAAGACAAAGG ACTTTGTCGACCAATATTGTATCCCTGCTGATAAGATTTTCA AGGAGCAAATTTCGCAAGACCCAAAAATAAGATGGAAACA ATATCCAGCTATCATTGAACCATTGAAGAAAAAGGCTAGAG AGTTGGGTTTGTGGAACATGTTTTTGTCCAAGCATTACAAA GAGGGTCCTCAATTTACCAATTTGGAATACGGATTAATGGC TAGGTATTTGGGAAGATGTCACACTGGACCAGAAGCAACCA ACACCAGTGCCCCAGACACAGGTAATATGGAATTGTTTGCT AAATATGGTACAAAGGCGCAAAAGGATAAGTATTTAGTGC CCTTGATGGATGGTAAGATCAGATCGGCATTCTTGATGACC GAAAAGGGGATTTCATCGTCGAATGCATTAAACATTTCAAC CACTGCCATTAAGAATGCCCGTGGTAACTATGTGTTGAATG GAACAAAGTGGTTTGCCTCTGGTGCTGGAGATCCAAGAACT GCTGTTTGGTTGGTTATGTGCAAAACAGACAATGATGAAAG TAATATGTTCAGAAACCACTCCGTGTTAGTCATTGATGTCA AGCATGCATTAGCATCAGGTAAGGCTGAAGTTATCAGGCCT TTGAGTATTTTTGGCTACGATGATGCACCCCATGGTCATTGT GAAATCGTTTTCAAGGATTATGAAGTTTCATCTGAATTGAT GCCAGAAACGATTTTGGCCGGTGTCGGTAGGGGATTTGAAT TGATTCAATCCCGTTTGGGTCCAGGTAGAATCCATCATTGTA TGAGAGCCATAGGTGCTGGTGAATTTGCCTTGTTGCGTATT GCTCACAGAGCAAATCACAGAACCATCTTTGGTAGGCCAAT GAATAGAAGAGAAGGCTTCTTGATGCAGTATGCCAAGTACA GAATTGAAATTCAAAAATGTTTATTATTGGTTTTGAATGCTG CTCACAAGATTGACATCACTAATGCCAAACATGCACAAAGA GAAATTGCCATGGCTAAAATTGAGACTCCAAAAACAATTTG CGATATTCTCGACTGGGGTATTCAAGTCTTTGGAGCCGAAG GATTCTCTCAAGATACAGAATTGGCACAAATGTATGCTTGG AATAGAACTTTGAGAATCGCTGATGGTCCTGATGAAGCACA TTTGGCTCAATTGTCAAGAAGAGAAGCTGCCAAGTTTCCAG AAGTTGATGAGTTTTTCAAGAGTGTTGAATCAAGAGTTGAA GCTATTAGTAAGTTATAA |
| SEQ ID NO: 3695 | >gi\|380353467\| emb\|CCG22977.1\| hypothetical protein CORT_0D01290 [Candida orthopsilosis] (similar to C. albicans ACD99) | MSVKDDIPAIFLDKVSPRGLEAIQKTKDFVDQYCIPADKIFKEQ ISQDPKIRWKQYPAIIEPLKKKARELGLWNMFLSKHYKEGPQF TNLEYGLMARYLGRCHTGPEATNTSAPDTGNMELFAKYGTK AQKDKYLVPLMDGKIRSAFLMTEKGISSSNALNISTTAIKNAR GNYVLNGTKWFASGAGDPRTAVWLVMCKTDNDESNMFRNH SVLVIDVKHALASGKAEVIRPLSIFGYDDAPHGHCEIVFKDYEV SSELMPETILAGVGRGFELIQSRLGPGRIHHCMRAIGAGEFALL RIAHRANHRTIFGRPMNRREGFLMQYAKYRIEIQKCLLLVLNA AHKIDITNAKHAQREIAMAKIETPKTICDILDWGIQVFGAEGFS QDTELAQMYAWNRTLRIADGPDEAHLAQLSRREAAKFPEVDE FFKSVESRVEAISKL |
| SEQ ID NO: 3696 | >gi\|354545630: 225012-226343 Candida parapsilosis strain CDC317 annotated contig 005809(similar to C. albicans ACD99) | ATGTCAGTTAAGGACGATATTCCAGCAATCTTTTTAGATAA GGTTTCCCCAAGAGGTCTTGAAGCTATTCAAAAGACAAAAG ACTTTGTTGAGCAATACTGTATTCCTGCCGATAAAGTTTTCA AGAAACAGATTTCGACAGACCCAGCGGTAAGATGGAAACA ATACCCTGCTATTATTGAACCATTGAAGAAAAAGGCTAGGG AATTGGGATTGTGGAACATGTTTTTGTCCAAGCATTACAAA GAGGGTCCTCAATTTACCAACTTGGAATATGGATTGATGGC TAGGTATCTAGGAAGATGCCACACTGGTCCTGAAGCCACTA ACACTAGTGCACCAGACACGGGTAATATGGAGTTGTTTGCA AAATATGGTACAAAGGCGCAAAAAGACAAATATTTGGTGC CCTTGATGGATGGTAAGATTAGATCAGCATTTTTGATGACT GAAAAGGGGATCTCATCGTCCAATGCGTTGAACATTTCCAC CACTGCAATTAAAAACTCACGTGGAAACTATGTCTTGAATG GTACCAAGTGGTTTGCATCAGGCGCTGGTGATCCTAGAACT GCCGTTTGGTTGGTTATGTGTAAGACTGCCAACGATGAAAA GAATGCATTTAAAAACCACTCAGTATTAGTGATTAATGTTA AGCATGCATTAGCATCAGGCAAGGCTGAAGTTATTAGACCT TTGGGAATTTTCGGATACGACGATGCTCCTCATGGACATTG TGAAATTGTTTTCAAAGATTATGAAGTTTCATCAGAGTTGAT GCCAGATACCATTTTGGCTGGTGTTGGTAAAGGATTCGAAT TGATTCAATCTAGATTGGGCCCGGTAGAATCCATCATTGT ATGAGAGCTATTGGTGCTGGTGAATTTGCATTGTTGCGTATC GCCCACAGAGCTAATCACAGAATTATTTTTGGTAAACCAAT GAATAGAAGAGAAGGCTTTTTGATGCAGTATGCCAAGTACA GAATCGAGATTCAAAAATGTTATTGTTGGTTTTAAATGCTG CCCACAAGATAGATATCACTAATGCCAAAGAAGCTCAAAG AGAAATTGCAATGGCCAAGATTGAAACTCCAAAAACCATTT GTGATATTCTTGATTGGGGTATTCAAGTGTTTGGAGCTGAG GGTTTCTCTCAGGATACAGAATTGGCGCAAATGTACGCTTG |

| SEQ ID NO: | Description | Sequence |
|---|---|---|
| | | GAACAGAACTTTGAGAATTGCAGATGGACCAGATGAAGCA<br>CATTTGGCTCAATTAGCAAGAAGAGAAGCCGCAAAGTTCCC<br>TGACGTTGACGTGTTTTTTAAAGATGTTGATTCAAGAGTTGA<br>GGCTGTTAGTAAATTATAA |
| SEQ ID NO: 3697 | >gi\|354545753\|emb\|CCE42481.1\| hypothetical protein CPAR2_201240 [Candida parapsilosis] (similar to C. albicans ACD99) | MSVKDDIPAIFLDKVSPRGLEAIQKTKDFVEQYCIPADKVFKK<br>QISTDPAVRWKQYPAIIEPLKKKARELGLWNMFLSKHYKEGP<br>QFTNLEYGLMARYLGRCHTGPEATNTSAPDTGNMELFAKYGT<br>KAQKDKYLVPLMDGKIRSAFLMTEKGISSSNALNISTTAIKNSR<br>GNYVLNGTKWFASGAGDPRTAVWLVMCKTANDEKNAFKNH<br>SVLVINVKHALASGKAEVIRPLGIFGYDDAPHGHCEIVFKDYE<br>VSSELMPDTILAGVGKGFELIQSRLGPGRIHHCMRAIGAGEFAL<br>LRIAHRANHRIIFGKPMNRREGFLMQYAKYRIEIQKCLLLVLN<br>AAHKIDITNAKEAQREIAMAKIETPKTICDILDWGIQVFGAEGF<br>SQDTELAQMYAWNRTLRIADGPDEAHLAQLARREAAKFPDV<br>DVFFKDVDSRVEAVSKL |
| SEQ ID NO: 3698 | >gi\|241959309\|ref\|XM_002422329.1\| Candida dubliniensis CD36 acyl-CoA dehydrogenase, putative (CD36_34410) mRNA, complete cds | ATGTCAGTTAAAGAAGATATTCCTGCTATTTTCCTTGAAAA<br>GATTTCCCCTCGTGGTCTTGATGCTATCCAGAAAACCAAAG<br>ATTTCGTAAACGATTATTGTCTTCCAGCAGATCAGATCTATT<br>TTGAGCAGCTCTCTGACATCCCTTCAGAAAGATGGAAAAGT<br>GTTCCTCCTGTCATTGAGACATTGAAGAAGAAAGCCAAGGA<br>ACTTGGTTTATGGAACATGTTTTTGTCAAAGCATTATAAAG<br>AAGGTCCACAATACACAAACTTAGAGTATGGTTGATGGCC<br>AGATACTTGGGTCGTTCATACACTGCGCCAGAGGCTACCA<br>TACTGCTGCTCCAGATACCGGTAATATGGAATTGTTTGCCA<br>AATATGGTACCACTTATCAGAAAGATAGATACTTGAAACCC<br>TTGTTAAATGGGGAAATCAGATCGGCATTCTTGATGACCGA<br>AAAGGGTGTTTCATCATCCAATGCTCTCAATATTCTACAAG<br>CGCTATCAAGAACTCTAATGGTAATTACGTGCTCAATGGTG<br>TCAAATGGTTTGCTTCAGGGGCAGGAGATCCAAGATGCTCT<br>GTATGGTTGGTAATGTGCAAGACCGACAACAATAAGCAAA<br>ACCCTTATCAGAACCACACTGTTTTGATTATCGATGCAAAA<br>AAGGCTTTGGCTACCGGAAAAGCCAAATTGATCAGACCATT<br>GCAAGTCATTGGTTTTGATGATGCTCCCCATGGACATTGTG<br>AAATCCAATTCAAAGACTACGAAGTTCCTGCTGATGAAATG<br>CCTAATGTTGTAATGGCAGGTGTTGGTAGAGGATTTGAGTT<br>GATTCAATCCAGATTGGGTCCAGGTAGAATCCACCATTGTA<br>TGAGAGCTATTGGTTCTGGTGAATTTGCTTTATTAAGAATTG<br>CTCATAGAGCAAATCACAGATTAATTTTTGGTAAGCCCATG<br>AACCCAAAGAGAGGGGTTCTTATCCAGATACGGACAAAGCA<br>AAATAGATATTGAAAGATGTTTGTTATTGGTGTTGAATGCC<br>GCTCACAAAATCGATATTCCAATGCCAAAGAGGCACAAAG<br>GGAAATTGCTATGGCCAAGATTGAAACCCCAAGAACTATTT<br>CTGATATTCTCGATTGGGGTATTCAAGTTTATGGAGCTGAA<br>GGTATGTCTCAAGCACACTGAGTTGGCCAGAATGTATGCCCA<br>TAACAGAACATTGAGAATAGCTGATGGACCTGATGAAGCTC<br>ATTTGGCTCAATTGGCTAGAAACGAAGCTAAGAAGTTTCCA<br>AAAGTTGACGCCTTCTTTACCAACATGGAAACACAACGTAG<br>CAAATTATAA |
| SEQ ID NO: 3699 | >gi\|241959310\|ref\|XP_002422374.1\| acyl-CoA dehydrogenase, putative [Candida dubliniensis CD36] | MSVKEDIPAIFLEKISPRGLDAIQKTKDFVNDYCLPADQIYFEQ<br>LSDIPSERWKSVPPVIETLKKKAKELGLWNMFLSKHYKEGPQY<br>TNLEYGLMARYLGRSYTAPEATNTAAPDTGNMELFAKYGTT<br>YQKDRYLKPLLNGEIRSAFLMTEKGVSSSNALNISTSAIKNSNG<br>NYVLNGVKWFASGAGDPRCSVWLVMCKTDNNKQNPYQNHT<br>VLIIDAKKALATGKAKLIRPLQVIGFDDAPHGHCEIQFKDYEVP<br>ADEMPNVVMAGVGRGFELIQSRLGPGRIHHCMRAIGSGEFAL<br>LRIAHRANHRLIFGKPMNQREGFLSRYGQSKIDIERCLLLVLNA<br>AHKIDISNAKEAQREIAMAKIETPRTISDILDWGIQVYGAEGMS<br>QDTELARMYAHNRTLRIADGPDEAHLAQLARNEAKKFPKVD<br>AFFTNMETQRSKL |
| SEQ ID NO: 3700 | >gi\|126138209\|ref\|XM_001385591.1\| Scheffersomyces stipitis CBS 6054 acetyl-coenzyme-A dehydrogenase partial mRNA | ATGTCCGCCAAAGACGATATCCCTGCCATTTTCTTGGACAA<br>GATCTCTCCCAGAGGTCTTGAGGCCATTGAGAAGACCAAAC<br>GTTTCGTGGAAGACTACTGTTTGCCAGCTGACGATATCTACT<br>TCAAGCAGATCAAGACCGATCCCGCAGTTAGATGGAAATAT<br>ACTCCCGAAATCACGGAAAAGTTGAAGAAGAAAGCAAAGG<br>AACTCGGGCTCTGGAACATGTTCTTGTCTAAGCACTACAAG<br>GAAGGACCCCAGTTCACTAACTTGGAGTACGGGTTGATGGC<br>TGAGTACTTGGGCAAATCCTTTGTTGCTCCAGAGGCTACCA<br>ACACTGCAGCTCCAGATACCGGAAACATGGAACTTTTTGCC<br>AAATACGGAACTCCATACCAAAAGGAGAAGTGGCTCAAGC<br>CATTGTTGAACGGAGAAATCAGATCAGCTTTCTTGATGACA<br>GAGAAGGGTGTTTCTTCATCGAATGCCTTGAACATTTCGAC |

| SEQ ID NO: | Description | Sequence |
|---|---|---|
| | | TAGTGCCATTAAGAACGCCCAAGGCAACTACGTTCTTAACG<br>GTGTCAAGTGGTTTGCTTCTGGAGCTGGAGATCCCAGATGT<br>TCAGTCTGGCTTGTCATGTGTAAAACCACCGACGACTCCAG<br>CAAGCCATACTTCAACCATTCTGTCTTGATTTTAGATCCCAA<br>AGTCGCTATTGCTTCTGGAAAAGCCAGGGTGGTCAGACCTT<br>TGCATGTGATTGGGTACGACGATGCGCCCCATGGCCATTGT<br>GAAATCGAGTTCACCAACTACGAGGTTTCAGCTGAAGAAAT<br>GAAGAACACCATTCTTGCTGGTGTTGGCCGTGGTTTTGAGC<br>TCATCCAGTCCCGTTTGGGACCAGGCAGAATCCATCACTGT<br>ATGAGACTGATTGGTTCTGGCGAGTTTGCTTTGCTCAAGAC<br>AGCACACAGAGCCAACAACAGAATCATCTTTGGCAAGCCCT<br>TGGCCAATAGAGAGTCCTTTATCACAGCTTTTGCTCAACAT<br>AAGATCGACATTCAGAAGTGTCGTTTGTTGGTGTTGAACGC<br>GGCCCACAAGATTGACATCACCAATGCCAAGGGTGCCCAG<br>AAGGAAATTGCCATGGCAAAGATCGAGACTCCAAGGACAG<br>TGTGCAAGATCATAGATTGGGGCATGCAAATGTTTGGTGCC<br>GAAGGGTTATCTCAAGACACTGAGCTTGCCAGAATTTATGC<br>CATGACCAGAATATTGAGAATTGCCGACGGTCCAGATGAAG<br>CTCATTTGAACCAGTTAGGTAGAAACGAAGCAAAGAAATTC<br>AACGAGGCTGATGCCTTCTTTGCTACCTATGAGGCAAGCAG<br>AGCCAGATTGGAAAAATTGTAG |
| SEQ ID NO: 3701 | >gi\|150866135\|<br>ref\|XP_001385628.2\|<br>acetyl-<br>coenzyme-A<br>dehydrogenase<br>[Scheffersomyces<br>stipitis CBS<br>6054] | MSAKDDIPAIFLDKISPRGLEAIEKTKRFVEDYCLPADDIYFKQI<br>KTDPAVRWKYTPEITEKLKKKAKELGLWNMFLSKHYKEGPQF<br>TNLEYGLMAEYLGKSFVAPEATNTAAPDTGNMELFAKYGTPY<br>QKEKWLKPLLNGEIRSAFLMTEKGVSSSNALNISTSAIKNAQG<br>NYVLNGVKWFASGAGDPRCSVWLVMCKTTDDSSKPYFNHSV<br>LILDPKVAIASGKARVVRPLHVIGYDDAPHGHCEIEFTNYEVSA<br>EEMKNTILAGVGRGFELIQSRLGPGRIHHCMRSIGSGEFALLKT<br>AHRANNRIIFGKPLANRESFITAFAQHKIDIQKCRLLVLNAAHK<br>IDITNAKGAQKEIAMAKIETPRTVCKIIDWGMQMFGAEGLSQD<br>TELARIYAMTRILRIADGPDEAHLNQLGRNEAKKFNEADAFFA<br>TYEASRARLEKL |
| SEQ ID NO: 3702 | >gi\|146422929\|<br>ref\|XM_001487349.1\|<br>Meyerozyma<br>guilliermondii<br>ATCC 6260<br>hypothetical<br>protein<br>(PGUG_00776)<br>partial mRNA | ATGTCTGTTAAAGAGGATATTCCGGCTATTTTTCTCGACAAG<br>ATTTCGCCCAAAGGATTGGACGCGATCCAGAAATGTAAGGA<br>TTTTGTCGAGCAATACTGTCTTCCGGCGGATAAAATATACCT<br>AGAGCAGCTTAGCCCTGACCCCACAAAAAGATGGAAATCT<br>ACCCCACAAATCACTGAAAAATTGAAGAAAAAAGCCCAAG<br>AATTGGGACTTTGGAACATGTTCTTGTCAAAACACTATGCT<br>GAGGGTGCAGGGTACACCAACTTGGAATATGGGCTCATGGC<br>AGGTTATTTAGGGCGGTCGTTGGTGGCCCCAGAAGCAACCA<br>ATACCAATGCACCCGACACGGGCAATATGGAATTGCTTGCC<br>AAATACGGCACTCAGTACCATAAAGAACGTTGGCTCAAGCC<br>ATTGTTGAACGGAGAGATTCGGTCGGCTTTTTTGATGACGG<br>AAAAGGGTACTTCTTCGTCAATGCGTTGAACATTTCTGTTT<br>CGGCCAAGAAAAATGCCAATGGGAATTGGGTATTGAATGG<br>TATTAAGTGGTTCGCTTCTGGATCAGGAGACCCCACGGTGTT<br>CAGTTTGGTTGGTAATGTGCAAAACAGCCGAAACTAAGGCG<br>ATTTATGAAAACCACTCGGTTCTCGTTATCGATGCCAAAAA<br>GGCATTGGCTACAGGAAATGCCAAATTGATCCGGCCATTAC<br>ATGTTTTTGGCTATGACGATGCTCCTCACGGACACTTTGAGG<br>TGGAATTCAACAACTATGAGATTCCAAGTGAAGATATGCCC<br>CATTCCATATTGGCTTCTGAAGGTAGAGGATTCGAGCTCAT<br>TCAGTCGAGACTTGGTCCTGGTCGTATCCACCACTGTATGA<br>GACTGATTGGTGCTGGAGAACAAGCGTTGTTGCGCGTGAGC<br>CATCGTGCCAACAATCGGCTCATTTTCGGTACACTTATGGC<br>AAAGAGAGAATCATTTATTACTGCATTTGCCCAGCACAAGA<br>TCAACCTTCAGAAATGTAGATTGCTCGTTTTGAATGCTGCCC<br>ACAAAATTGACATCAGTAATGCCAAACAGGCACAACGGGA<br>GATTGCTATGGCCAAAATTGAGACTCCAAGAACCGTTGGTA<br>GGGTACTTGACTGGGGTATCCAAATGTTTGGAGCAGAGGGA<br>GTTTCGCAAGACACCGAATTGGCTCGTCTGTATGCTATCAA<br>CCGGACACTCCAGATTGCTGATGGCCCCGACGAAGCTCATT<br>TGAACCAATTGGGATTGAAAGAGGCCAAGAAATTTGCACTT<br>GCAAGTGAATTCTTTGCTCAACAAGAAGAATACCGCAAACG<br>ATTATCTAACCTCTAG |
| SEQ ID NO: 3703 | >gi\|146422930\|<br>ref\|XP_001487399.1\|<br>hypothetical<br>protein<br>PGUG_00776<br>[Meyerozyma<br>guilliermondii | MSVKEDIPAIFLDKISPKGLDAIQKCKDFVEQYCLPADKIYLEQ<br>LSPDPTKRWKSTPQITEKLKKKAQELGLWNMFLSKHYAEGAG<br>YTNLEYGLMAGYLGRSLVAPEATNTNAPDTGNMELLAKYGT<br>QYHKERWLKPLLNGEIRSAFLMTEKGTSSSNALNISVSAKKNA<br>NGNWVLNGIKWFASGSGDPRCSVWLVMCKTAETKAIYENHS<br>VLVIDAKKALATGNAKLIRPLHVFGYDDAPHGHFEVEFNNYEI<br>PSEDMPHSILASEGRGFELIQSRLGPGRIHHCMRLIGAGEQALL |

| SEQ ID NO: | Description | Sequence |
|---|---|---|
| | ATCC 6260] | RVSHRANNRLIFGTLMAKRESFITAFAQHKINLQKCRLLVLNA AHKIDISNAKQAQREIAMAKIETPRTVGRVLDWGIQMFGAEG VSQDTELARLYAINRTLQIADGPDEAHLNQLGLKEAKKFALAS EFFAQQEEYRKRLSNL |
| SEQ ID NO: 3704 | oAA2835 | CACACAGCTCTTCCATAATGTCCGACGAGGAATCAGA |
| SEQ ID NO: 3705 | oAA2836 | CACACAGCTCTTCCCTCTCTTCTATTCCTAGTTGATGGCCTG GTCTC |
| SEQ ID NO: 3706 | oAA2837 | CACACAGCTCTTCCATAATGTCCGACGACCTTATCAC |
| SEQ ID NO: 3707 | oAA2838 | CACACAGCTCTTCCCTCTCTTCTATTCCTATAATTTATGTTTC AACTCACC |
| SEQ ID NO: 3708 | oAA3085 | ATCGTTACCACCATCCCTACAAT |
| SEQ ID NO: 3709 | oAA3086 | CCGAAACAACCGTAGATACCTTTAAGCTACAACACTATACA CGATAATTCCC |
| SEQ ID NO: 3710 | oAA3087 | GGGAATTATCGTGTATAGTGTTGTAGCTTAAAGGTATCTAC GGTTGTTTCGG |
| SEQ ID NO: 3711 | oAA3088 | CTTGGACATTTCGACCTTGGCGGTACCGAGCTCTGCGAATT |
| SEQ ID NO: 3712 | oAA3089 | AATTCGCAGAGCTCGGTACCGCCAAGGTCGAAATGTCCAAG |
| SEQ ID NO: 3713 | oAA3090 | GCTTGTTCTGCAAAATGGAGTCA |
| SEQ ID NO: 3714 | oAA3212 | GGGGGAGATCGTTACCACCA |
| SEQ ID NO: 3715 | oAA3213 | AATTCGCAGAGCTCGGTACCGCTGCTGCTGCTGTTTT |
| SEQ ID NO: 3716 | oAA3214 | AAAACAGCAGCAGCAGCGGTACCGAGCTCTGCGAATT |
| SEQ ID NO: 3717 | oAA3215 | TTCGTTGTTGGCTCTCTCCATTAAAGGTATCTACGGTTGTTT CGG |
| SEQ ID NO: 3718 | oAA3216 | CCGAAACAACCGTAGATACCTTTAATGGAGAGAGCCAACA ACGAA |
| SEQ ID NO: 3719 | oAA3217 | CAAAGGCATCGGTCAACTCC |
| SEQ ID NO: 3720 | Candida strain ATCC20336 POX4 | ATGACTTTTACAAAGAAAAACGTTAGTGTATCACAAGGTCC TGACCCTAGATCATCCATCCAAAAGGAAAGAGACAGCTCCA AATGGAACCCTCAACAAATGAACTACTTCTTGGAAGGCTCC GTCGAAAGAAGTGAGTTGATGAAGGCTTTGGCCCAACAAAT GGAAAGAGACCCAATCTTGTTCACAGACGGCTCCTACTACG ACTTGACCAAGGACCAACAAAGAGAATTGACCGCCGTCAA GATCAACAGAATCGCCAGATACAGAGAACAAGAATCCATC GACACTTTCAACAAGAGATTGTCCTTGATTGGTATCTTTGAC CCACAGGTCGGTACCAGAATTGGTGTCAACCTCGGTTTGTT CCTTTCTTGTATCAGAGGTAACGGTACCACTTCCCAATTGAA CTACTGGGCTAACGAAAAGGAAACCGCTGACGTTAAAGGT ATCTACGGTTGTTTCGGTATGACCGAATTGGCCCACGGTTCC AACGTTGCTGGTTTGGAAACCACCGCCACATTTGACAAGGA ATCTGACGAGTTTGTCATCAACACCCCACACATTGGTGCCA CCAAGTGGTGGATTGGTGGTGCTGCTCACTCCGCCACCCAC TGTTCTGTCTACGCCAGATTGATTGTTGACGGTCAAGATTAC GGTGTCAAGACTTTTGTTGTCCCATTGAGAGACTCCAACCA CGACCTCATGCCAGGTGTCACTGTTGGTGACATTGGTGCCA AGATGGGTAGAGATGGTATCGATAACGGTTGGATCCAATTC TCCAACGTCAGAATCCCAAGATTCTTTATGTTGCAAAGTT CTGTAAGGTTTCTGCTGAAGGTGAAGTCACCTTGCCACCTTT GGAACAATTGTCTTACTCCGCCTTGTTGGGTGGTAGAGTCA |

| SEQ ID NO: | Description | Sequence |
|---|---|---|
| | | TGATGGTTTTGGACTCCTACAGAATGTTGGCTAGAATGTCC
ACCATTGCCTTGAGATACGCCATTGGTAGAAGACAATTCAA
GGGTGACAATGTCGATCCAAAAGATCCAAACGCTTTGGAAA
CCCAATTGATAGATTACCCATTGCACCAAAAGAGATTGTTC
CCATACTTGGCTGCTGCCTACGTCATCTCCGCTGGTGCCCTC
AAGGTTGAAGACACCATCCATAACACCTTGGCTGAATTGGA
CGCTGCCGTTGAAAAGAACGACACCAAGGCTATCTTTAAGT
CTATTGACGACATGAAGTCATTGTTTGTTGACTCTGGTTCCT
TGAAGTCCACTGCCACTTGGTTGGGTGCTGAAGCCATTGAC
CAATGTAGACAAGCCTGTGGTGGTCACGGTTACTCGTCCTA
CAACGGCTTCGGTAAAGCCTACAACGATTGGGTTGTCCAAT
GTACTTGGGAAGGTGACAACAATGTCTTGGCCATGAGTGTT
GGTAAGCCAATTGTCAAGCAAGTTATCAGCATTGAAGATGC
CGGCAAGACCGTCAGAGGTTCCACCGCTTTCTTGAACCAAT
TGAAGGACTACACTGGTTCCAACAGCTCCAAGGTTGTTTTG
AACACTGTTGCTGACTTGGACGACATCAAGACTGTCATCAA
GGCTATTGAAGTTGCCATCATCAGATTGTCCCAAGAAGCTG
CTTCTATTGTCAAGAAGGAATCTTTCGACTATGTCGGCGCTG
AATTGGTTCAACTCTCCAAGTTGAAGGCTCACCACTACTTGT
TGACTGAATACATCAGAAGAATTGACACCTTTGACCAAAAG
GACTTGGTTCCATACTTGATCACCCTCGGTAAGTTGTACGCT
GCCACTATTGTCTTGGACAGATTTGCCGGTGTCTTCTTGACT
TTCAACGTTGCCTCCACCGAAGCCATCACTGCTTTGGCCTCT
GTGCAAATTCCAAAGTTGTGTGCTGAAGTCAGACCAAACGT
TGTTGCTTACACCGACTCCTTCCAACAATCCGACATGATTGT
CAATTCTGCTATTGGTAGATACGATGGTGACATCTATGAGA
ACTACTTTGACTTGGTCAAGTTGCAGAACCCACCATCCAAG
ACCAAGGCTCCTTACTCTGATGCTTTGGAAGCCATGTTGAA
CAGACCAACCTTGGACGAAAGAGAAAGATTTGAAAAGTCT
GATGAAACCGCTGCTATCTTGTCCAAGTAA |
| SEQ ID NO: 3721 | POX4
*Candida* strain ATCC20336, Fwd. Primer, NdeI | GTTCACTGCCATATGACTTTTACAAAGAAAAACGTTAGTGT
ATCACAAGG |
| SEQ ID NO: 3722 | POX4
*Candida* strain ATCC20336, Rev. Primer, NotI | CTTCGAGATGCGGCCGCTTACTTGGACAAGATAGCAGCGGT
TTCATC |
| SEQ ID NO: 3723 | *Candida* strain ATCC20336 POX5 | ATGCCTACCGAACTTCAAAAAGAAAGAGAACTCACCAAGTT
CAACCCAAAGGAGTTGAACTACTTCTTGGAAGGTTCCCAAG
AAAGATCCGAGATCATCAGCAACATGGTCGAACAAATGCA
AAAAGACCCTATCTTGAAGGTCGACGCTTCATACTACAACT
TGACCAAAGACCAACAAAGAGAAGTCACCGCCAAGAAGAT
TGCCAGACTCTCCAGATACTTTGAGCACGAGTACCCAGACC
AACAGGCCCAGAGATTGTCGATCCTCGGTGTCTTTGACCCA
CAAGTCTTCACCAGAATCGGTGTCAACTTGGGTTTGTTTGTT
TCCTGTGTCCGTGGTAACGGTACCAACTCCCAGTTCTTCTAC
TGGACCATAAATAAGGGTATCGACAAGTTGAGAGGTATCTA
TGGTTGTTTTGGTATGACTGAGTTGGCCCACGGTTCCAACGT
CCAAGGTATTGAAACCACCGCCACTTTTGACGAAGACACTG
ACGAGTTTGTCATCAACACCCCACACATTGGTGCCACCAAG
TGGTGGATCGGTGGTGCTGCGCACTCCGCCACCCACTGCTC
CGTCTACGCCAGATTGAAGGTCAAAGGAAAGGACTACGGT
GTCAAGACCTTTGTTGTCCCATTGAGAGACTCCAACCACGA
CCTCGAGCCAGGTGTGACTGTTGGTGACATTGGTGCCAAGA
TGGGTAGAGACGGTATCGATAACGGTTGGATCCAGTTCTCC
AACGTCAGAATCCCAAGATTCTTTATGTTGCAAAAGTACTG
TAAGGTTTCCCGTCTGGGTGAAGTCACCATGCCACCATCTG
AACAATTGTCTTACTCGGCTTTGATTGGTGGTAGAGTCACC
ATGATGATGGACTCCTACAGAATGACCAGTAGATTCATCAC
CATTGCCTTGAGATACGCCATCCACAGAAGCAATTCAAGA
AGAAGGACACCGATACCATTGAAACCAAGTTGATTGACTAC
CCATTGCATCAAAAGAGATTGTTCCCATTCTTGGCTGCCGCT
TACTTGTTCTCCCAAGGTGCCTTGTACTTAGAACAAACCATG
AACGCAACCAACGACAAGTTGGACGAAGCTGTCAGTGCTG
GTGAAAAGGAAGCCATTGACGCTGCCATTGTCGAATCCAAG
AAATTGTTCGTCGCTTCCGGTTGTTTGAAGTCCACCTGTACC
TGGTTGACTGCTGAAGCCATTGACGAAGCTCGTCAAGCTTG
TGGTGGTCACGGTTACTCGTCTTACAACGGTTTCGGTAAAG
CCTACTCCGACTGGGTTGTCCAATGTACCTGGGAAGGTGAC
AACAATATCTTGGCCATGAACGTTGCCAAGCAATGGTTAG
AGACTTGTTGAAGGAGCCAGAACAAAAGGGATTGGTTCTCT |

-continued

| SEQ ID NO: | Description | Sequence |
|---|---|---|
| | | CCAGCGTTGCCGACTTGGACGACCCAGCCAAGTTGGTTAAG<br>GCTTTCGACCACGCCCTTTCCGGCTTGGCCAGAGACATTGG<br>TGCTGTTGCTGAAGACAAGGGTTTCGACATTACCGGTCCAA<br>GTTTGGTTTTGGTTTCCAAGTTGAACGCTCACAGATTCTTGA<br>TTGACGGTTTCTTCAAGCGTATCACCCCAGAATGGTCTGAA<br>GTCTTGAGACCTTTGGGTTTCTTGTATGCCGACTGGATCTTG<br>ACCAACTTTGGTGCCACCTTCTTGCAGTACGGTATCATTACC<br>CCAGATGTCAGCAGAAAGATTTCCTCCGAGCACTTCCCAGC<br>CTTGTGTGCCAAGGTTAGACCAAACGTTGTTGGTTTGACTG<br>ATGGTTTCAACTTGACTGACATGATGACCAATGCTGCTATT<br>GGTAGATATGATGGTAACGTCTACGAACACTACTTCGAAAC<br>TGTCAAGGCTTTGAACCCACCAGAAAACACCAAGGCTCCAT<br>ACTCCAAGGCTTTGGAAGACATGTTGAACCGTCCAGACCTT<br>GAAGTCAGAGAAAGAGGTGAAAAGTCCGAAGAAGCTGCTG<br>AAATCTTGTCCAGTTAA |
| SEQ ID NO: 3724 | POX5 | GTTCACTGCCATATGCCTACCGAACTTCAAAAGAAAGAGA<br>ACTC<br>*Candida* strain ATCC20336, Fwd. Primer, NdeI |
| SEQ ID NO: 3725 | POX5 | CTTCGAGATGCGGCCGCTTAACTGGACAAGATTTCAGCAGC<br>TTCTTCG<br>*Candida* strain ATCC20336, Rev. Primer, NotI |
| SEQ ID NO: 3726 | Aco1 (AJ001299.1) | GTTCACTGCCATATGACAACCAACACATTCACCGATCCTC<br>*Yarrowia lipolytica*, Fwd. Primer, NdeI |
| SEQ ID NO: 3727 | Aco1 (AJ001299.1) | CTTCGAGATCTCGAGTCACTCATCGAGATCGCAAATTTCAT<br>CGTC<br>*Yarrowia lipolytica*, Rev. Primer, XhoI |
| SEQ ID NO: 3728 | Aco2 (XM_505264) | GTTCACTGCCATATGAACCCCAACAACACTGGCACC<br>*Yarrowia lipolytica*, Fwd. Primer, NdeI |
| SEQ ID NO: 3729 | Aco2 (XM_505264) | CTTCGAGATGCGGCCGCCTATTCCTCATCAAGCTCGCAAAT<br>GTCATC<br>*Yarrowia lipolytica*, Rev. Primer, NotI |
| SEQ ID NO: 3730 | Aco3 (XM_503244) | GTTCACTGCCATATGATCTCCCCCAACCTCACAGCTAAC<br>*Yarrowia lipolytica*, Fwd. Primer, NdeI |
| SEQ ID NO: 3731 | Aco3 (XM_503244) | CTTCGAGATGCGGCCGCCTATTCCTCGTCCAGCTCGCAAATG<br>*Yarrowia lipolytica*, Rev. Primer, NotI |
| SEQ ID NO: 3732 | Aco4 (XM_504475) | GTTCACTGCCATATGATCACCCCAAACCCCGCTAAC<br>*Yarrowia lipolytica*, Fwd. Primer, NdeI |
| SEQ ID NO: 3733 | Aco4 (XM_504475) | CTTCGAGATCTCGAGTTACTGAATATCCTCGGGCTCCATGG<br>*Yarrowia lipolytica*, Rev. Primer, XhoI |
| SEQ ID NO: 3734 | Aco5 (XM_502199) | GTTCACTGCCATATGAACAACAACCCCACCAACGTGATC<br>*Yarrowia lipolytica*, Fwd. Primer, NdeI |
| SEQ ID NO: 3735 | Aco5 (XM_502199) | CTTCGAGATGCGGCCGCCTACTCGTCCAGGTCGCAAATCTC<br>*Yarrowia lipolytica*, Rev. Primer, NotI |

| SEQ ID NO: | Description | Sequence |
|---|---|---|
| SEQ ID NO: 3736 | Aco6 (XM_503632) | GTTCACTGCCATATGCTCTCTCAACAGTCCCTCAACAC<br>*Yarrowia lipolytica*, Fwd. Primer, NdeI/NcoI |
| SEQ ID NO: 3737 | Aco6 (XM_503632) | CTTCGAGATCTCGAGCTACTCATCCTCAAGAGAGCAAATTTCCTC<br>*Yarrowia lipolytica*, Rev. Primer, NcoI/XhoI |
| SEQ ID NO: 3738 | Aco1 (NM_001136902) | GTTCACTGCCATATGGACGCATCGGCGGAGGTGG<br>*Zea mays*, Fwd. Primer, NdeI/EarI |
| SEQ ID NO: 3739 | Aco1 (NM_001136902) | CTTCGAGATCTCGAGCTAGAGCCTGGAGAGCTTGAGCTGC<br>*Zea mays*, Rev. Primer, EarI/XhoI |
| SEQ ID NO: 3740 | Aco1b (NM_001175167) | GTTCACTGCCATATGGCGGAAGTGGACCACCTCGC<br>*Zea mays*, Fwd. Primer, NdeI/BstXI |
| SEQ ID NO: 3741 | Aco1b (NM_001175167) | CTTCGAGATCTCGAGCTAGAGCCTGGAGAGCTTGAGCTGC<br>*Zea mays*, Rev. Primer, BstXI/XhoI |
| SEQ ID NO: 3742 | Aco2 (NM_001158552) | GTTCACTGCCATATGGACCTCACCTCGCCGTCGCC<br>*Zea mays*, Fwd. Primer, |
| SEQ ID NO: 3743 | Aco2 (NM_001158552) | CTTGCGGCCGCTCAGTGGCTCCCGGTTGACAGTGCA<br>*Zea mays*, Rev. Primer, |
| SEQ ID NO: 3744 | Aco4 (NM_001156834) | GTTCACTGCCATATGATGGCCGGGAAACGAGTTACGGG<br>*Zea mays*, Fwd. Primer, |
| SEQ ID NO: 3745 | Aco4 (NM_001156834) | CTTCGAGATCTCGAGTCACAGCCGGGCTTTCGCTGG<br>*Zea mays*, Rev. Primer, |
| SEQ ID NO: 3746 | ACOX2 (XM_001386762) | GTTCACTGCCATATGATCCTGTTGCCCAAAGAGCTCC<br>*Scheffersomyces stipitis*, Fwd. Primer, NdeI/SalI |
| SEQ ID NO: 3747 | ACOX2 (XM_001386762) | GTTCACTGCGCGGCCGCCTAGCGGGACAATATCTTGGCAGCTTCG<br>*Scheffersomyces stipitis*, Rev. Primer, SalI/NotI |
| SEQ ID NO: 3748 | DEHA2D17248p (XM_459235) | GTTCACTGCCATATGGTTAGTGCTACTAATACAGTGAATTCAGG<br>*Debaryomyces hansenii*, Fwd. Primer, NdeI |
| SEQ ID NO: 3749 | DEHA2D17248p (XM_459235) | CTTCGAGATCTCGAGTTATTTGGATAAGATCTTAGCAGTTTCAGTAGACTTTTC<br>*Debaryomyces hansenii*, Rev. Primer, XhoI |
| SEQ ID NO: 3750 | ACX1 (NM_117778) | GTTCACTGCATTAATATGGAAGGAATTGATCACCTCGCCG<br>*Arabidopsis thaliana*, Fwd. Primer, AseI |

| SEQ ID NO: | Description | Sequence |
|---|---|---|
| SEQ ID NO: 3751 | ACX1 (NM_117778) | CTTCGAGATGTCGACTCAGAGCCTAGCGGTACGAAGTTGC<br>*Arabidopsis thaliana*, Rev. Primer, SalI |
| SEQ ID NO: 3752 | ACX2 (NM_001037068) | GTTCACTGCCATATGGAATCGCGGCGAGAGAAGAATCC<br>*Arabidopsis thaliana*, Fwd. Primer, NdeI |
| SEQ ID NO: 3753 | ACX2 (NM_001037068) | CTTCGAGATGTCGACTTATACAAGAAAACAAACCTTAGCTTTGTTAGGCGC<br>*Arabidopsis thaliana*, Rev. Primer, SalI |
| SEQ ID NO: 3754 | ACX2b (NM_125910) | GTTCACTGCCATATGGAATCGCGGCGAGAGAAGAATCC<br>*Arabidopsis thaliana*, Fwd. Primer, NdeI |
| SEQ ID NO: 3755 | ACX2b (NM_125910) | CTTCGAGATGTCGACTTAGAATCCAACAACTTGAGTATACTGGGAATAAG<br>*Arabidopsis thaliana*, Rev. Primer, SslI |
| SEQ ID NO: 3756 | ACX3 (NM_100511) | GTTCACTGCATTAATATGTCGGATAATCGTGCACTCCGACG<br>*Arabidopsis thaliana*, Fwd. Primer, AseI |
| SEQ ID NO: 3757 | ACX3 (NM_100511) | CTTCGAGATGTCGACCTAAACTGAAGACCAAGCATTGGCTTCG<br>*Arabidopsis thaliana*, Rev. Primer, SALI |
| SEQ ID NO: 3758 | ACX5 (NM_129124) | GTTCACTGCCATATGGAGAGAGTTGATCACCTTGCCGATG<br>*Arabidopsis thaliana*, Fwd. Primer, NdeI/EarI |
| SEQ ID NO: 3759 | ACX5 (NM_129124) | GTTCACTGCGCGGCCGCTTAGAGTTTGGCAGAGCGGAAGCGTTG<br>*Arabidopsis thaliana*, Rev. Primer, EarI/NotI |
| SEQ ID NO: 3760 | aco2 (XM_003525015) | GTTCACTGCCATATGCAAACTCCGAACTGTGAAGCA<br>*Glycine max*, Fwd. Primer, NdeI |
| SEQ ID NO: 3761 | aco2 (XM_003525015) | CTTGCGGCCGCTCAAAAACCGACGTATTGAGTGTAT<br>*Glycine max*, Rev. Primer, NotI |
| SEQ ID NO: 3762 | aoxA (XM_659264) | GTTCACTGCCATATGCCAAATCCACCTCCCGCCTGG<br>*Aspergillus nidulans*, Fwd. Primer, NdeI |
| SEQ ID NO: 3763 | aoxA (XM_659264) | CTTCGAGATCTCGAGTCACAGCTTGCTCTTAATCTCCCCCG<br>*Aspergillus nidulans*, Rev. Primer, XhoI |
| SEQ ID NO: 3764 | AcoI (NM_017340) | GTTCACTGCCATATGAACCCAGACTTGAGAAAGGAAAGAGC<br>*Rattus norvegicus*, Fwd. Primer, NdeI |
| SEQ ID NO: 3765 | AcoI (NM_017340) | CTTCGAGATCTCGAGCTACAACTTGGATTGCAATGGCTTCAAGTGC<br>*Rattus norvegicus*, Rev. Primer, XhoI |

| SEQ ID NO: | Description | Sequence |
|---|---|---|
| SEQ ID NO: 3766 | AcoII (1IS2_A) | GTTCACTGCCATATGAACCCAGACTTGAGAAAGGAAAGAGC<br>*Rattus norvegicus*, Fwd. Primer, NdeI |
| SEQ ID NO: 3767 | AcoII (1IS2_A) | CTTCGAGATCTCGAGCTACAACTTGGATTGCAATGGCTTCA<br>AGTGC<br>*Rattus norvegicus*, Rev. Primer, XhoI |
| SEQ ID NO: 3768 | Aco (Cucsa.029560.1) | GTTCACTGCCATATGGCTTCGCCGCGCGAGTC<br>*Cucumis sativus*, Fwd. Primer, NdeI |
| SEQ ID NO: 3769 | Aco (Cucsa.029560.1) | CTTCGAGATCTCGAGTTAGAAGCCAACATACTGCGTATACT<br>GCG<br>*Cucumis sativus*, Rev. Primer, XhoI |
| SEQ ID NO: 3770 | Aco (BAE47462) | GTTCACTGCCATATGACAGAAGTAGTGGACCGCGCATC<br>*Arthrobacter ureafaciens*, Fwd. Primer, NdeI |
| SEQ ID NO: 3771 | Aco (BAE47462) | CTTCGAGATCTCGAGCTAGCGGGACTTGCCGGCC<br>*Arthrobacter ureafaciens*, Rev. Primer, XhoI |
| SEQ ID NO: 3772 | Aco (YP_003571780) | GTTCACTGCCATATGCTCGATACCGACTCGCCACG<br>Salinobacter rubber, Fwd. Primer, NdeI |
| SEQ ID NO: 3773 | Aco (YP_003571780) | CTTCGAGATCTCGAGCTCGAGTCATTTCGGGCCGGG<br>Salinobacter rubber, Rev. Primer, XhoI |
| SEQ ID NO: 3774 | Aco (YP_290295.1) | GTTCACTGCCATATGCCCAGCACGGCGATACAG<br>*Thermobifida fusca*, Fwd. Primer, NdeI |
| SEQ ID NO: 3775 | Aco (YP_290295.1) | CTTCGAGATCTCGAGCTCGAGTCACGTCTCCGCGC<br>*Thermobifida fusca*, Rev. Primer, XhoI |
| SEQ ID NO: 3776 | Aco (NC_009441.1) | GTTCACTGCCATATGAAACCAGCTAAACTTCAAGCCTTTAC<br>TCC<br>*Flavobacterium johnsoniae*, Fwd. Primer, NdeI |
| SEQ ID NO: 3777 | Aco (NC_009441.1) | CTTCGAGATCTCGAGCTAAACTGCAATTGGCGCTGCTAAAC<br>AG<br>*Flavobacterium johnsoniae*, Rev. Primer, XhoI |
| SEQ ID NO: 3778 | POX1<br>>gi\|50554589\|ref\|<br>XP_504703.1\|<br>YALI0E32835p<br>[*Yarrowia lipolytica*] | MAKERGKTQFTVRDVTNFLNGGEEETQIVEKIMSSIERDPVLS<br>VTADYDCNLQQARKQTMERVAALSPYLVTDTEKLSLWRAQL<br>HGMVDMSTRTRLSIHNNLFIGSIRGSGTPEQFKYWVKKGAVA<br>VKQFYGCFAMTELGHGSNLKGLETTATYDQDSDQFIINTPHIG<br>ATKWWIGGAAHTSHCVCFAKLIVHGKDYGTRNFVVPLRNV<br>HDHSLKVGVSIGDIGKKMGRDGVDNGWIQFTNVRIPRQNML<br>MRYAKVSDTGVVTKPALDQLTYGALIRGRVSMIADSFHVSKR<br>FLTIALRYACVRRQFGTSGDTKETKIIDYPYHQRRLLPLLAYCY<br>AMKMGADEAQKTWIETTDRILALNPNDPAQKNDLEKAVTDT<br>KELFAASAGMKAFTTWGCAKIIDECRQACGGHGYSGYNGFG<br>QGYADWVVQCTWEGDNNVLCLSMGRGLVQSALQILAGKHV<br>GASIQYVGDKSKISQNGQGTPREQLLSPEFLVEAFRTASRNNIL<br>RTTDKYQELVKTLNPDQAFEELSQQRFQCARIHTRQHLISSFY<br>ARIATAKDDIKPHLLKLANLFALWSIEEDTGIFLRENILTPGDID |

| SEQ ID NO: | Description | Sequence |
|---|---|---|
| | | LINSLVDELCVAVRDQVIGLTDAFGLSDFFINAPIGSYDGNVYE KYFAKVNQQNPATNPRPPYYESTLKPFLFREEEDDEICDLDE |
| SEQ ID NO: 3779 | POX2 >gi\|50555712\|ref\| XP_505264.1\| YALI0F10857p [Yarrowia lipolytica] | MNPNNTGTIEINGKEYNTFTEPPVAMAQERAKTSFPVREMTYF LDGGEKNTLKNEQIMEEIERDPLFNNDNYYDLNKEQIRELTME RVAKLSLFVRDQPEDDIKKRFALIGIADMGTYTRLGVHYGLFF GAVRGTGTAEQFGHWISKGAGDLRKFYGCFSMTELGHGSNLA GLETTAIYDEETDEFIINTPHIAATKWWIGGAAHTATHTVVFAR LIVKGKDYGVKTFVVQLRNINDHSLKVGISIGDIGKKMGRDGI DNGWIQFTNVRIPRQNLLMKYTKVDREGNVTQPPLAQLTYGS LITGRVSMASDSHQVGKRFITIALRYACIRRQFSTTPGQPETKII DYPYHQRRLLPLLAYVYALKMTADEVGALFSRTMLKMDDLK PDDKAGLNEVVSDVKELFSVSAGLKAFSTWACADVIDKTRQA CGGHGYSYGYNGFGQAYADWVVQCTWEGDNNILTLSAGRALI QSAVALRKGEPVGNAVSYLKRYKDLANAKLNGRSLTDPKVL VEAWEVAAGNIINRATDQYEKLIGEGLNADQAFEVLSQQRFQ AAKVHTRRHLIAAFFSRIDTEAGEAIKQPLLNLALLFALWSIEE DSGLFLREGFLEPKDIDTVTELVNKYCTTVREEVIGYTDAFNLS DYFINAPIGCYDGDAYRHYFQKVNEQNPARDPRPPYYASTLKP FLFREEEDDDICELDEE |
| SEQ ID NO: 3780 | POX3 >gi\|50551539\|ref\| XP_503244.1\| YALI0D24750p [Yarrowia lipolytica] | MISPNLTANVEIDGKQYNTFTEPPKALAGERAKVKFPIKDMTE FLHGGEENVTMIERLMTELERDPVLNVSGDYDMPKEQLRETA VARIAALSGHWKKDTEKEALLRSQLHGIVDMGTRIRLGVHTG LFMGAIRGSGTKEQYDYWVRKGAADVKGFYGCFAMTELGHG SNVAGLETTATYIQDTDEFIINTPNTGATKWWIGGAAHTATHT ACFARLLVDGKDYGVKIFVVQLRDVSSHSLMPGIALGDIGKK MGRDAIDNGWIQFTNVRIPRQNMLMKYAKVSSTGKVSQPPLA QLTYGALIGGRVTMIADSFFVSQRFITIALRYACVRRQFGTTPG QPETKIIDYPYHQRRLLPLLAFTYAMKMAADQSQIQYDQTTDL LQTIDPKDKGALGKAIVDLKELFASSAGLKAFTTWTCANIIDQ CRQACGGHGYSYGYNGFGQAYADWVVQCTWEGDNNVLCLSM GRGLIQSCLGHRKGKPLGSSVGYLANKGLEQATLSGRDLKDP KVLIEAWEKVANGAIQRATDKFVELTKGGLSPDQAFEELSQQ RFQCAKIHTRKHLVTAFYERINASAKADVKPYLINLANLFTLW SIEEDSGLFLREGFLQPKDIDQVTELVNHYCKEVRDQVAGYTD AFGLSDWFINAPIGNYDGDVYKHYFAKVNQQNPAQNPRPPYY ESTLRPFLFREDEDDDICELDEE |
| SEQ ID NO: 3781 | POX4 >gi\|50554133\|ref\| XP_504475.1\| YALI0E27654p [Yarrowia lipolytica] | MITPNPANDIVHDGKLYDTFTEPPKLMAQERAQLDFDPRDITY FLDGSKEETELLESLMLMYERDPLFNNQNEYDESFETLRERSV KRIFQLSKSIAMDPEPMSFRKIGFLGILDMGTYARLGVHYALFC NSIRGQGTPDQLMYWLDQGAMVIKGFYGCFAMTEMGHGSNL SRLETIATFDKETDEFIINTPHVGATKWWIGGAAHTATHTLAF ARLQVDGKDYGVKSFVVPLRNLDDHSLRPGIATGDIGKKMGR DAVDNGWIQFTNVRVPRNYMLMKHTKVLRDGTVKQPPLAQL TYGSLITGRVQMTTDSHNVSKKFLTIALRYATIRRQFSSTPGEP ETRLIDYLYHQRRLLPLMAYSYAMKLAGDHVRELFFASQEKA ESLKEDDKAGVESYVQDIKELFSVSAGLKAATTWACADIIDKA RQACGGHGYSAYNGFGQAFQDWVVQCTWEGDNTVLTLSAG RALIQSALVYRKEGKLGNATKYLSRSKELANAKRNGRSLEDP KLLVEAWEAVSAGAINAATDAYEELSKQGVSVDECFEQVSQE RFQAARIHTRRALIEAFYSRIATADEKVKPHLIPLANLFALWSIE EDSALFLAEGYFEPEDIIEVTSLVNKYCGIVRKNVIGYTDAFNL SDYFINAAIGRYDGDVYKNYFEKVKQQYPPEGGKPHYYEDV MKPFLHRERIPDVPMEPEDIQ |
| SEQ ID NO: 3782 | POX5 >gi\|50549457\|ref\| XP_502199.1\| YALI0C23859p [Yarrowia lipolytica] | MNNNPTNVILGGKEYDTFTEPPAQMELERAKTQFKVRDVTNF LTGSEQETLLTERIMREIERDPVLNVAGDYDADLPTKRRQAVE RIGALARYLPKDSEKEAILRGQLHGIVDMGTRTRIAVHYGLFM GAIRGSGTKEQYDYWVAKGAATLHKFYGCFAMTELGHGSNV AGLETTATLDKDTDEFIINTPNSGATKWWIGGAAHSATHTACL ARLIVDGKDYGVKIFIVQLRDLNSHSLLNGIAIGDIGKKMGRD AIDNGWIQFTDVRIPRQNMLMRYDRVSRDGEVTTSELAQLTY GALLSGRVTMIAESHLLSARFLTIALRYACIRRQFGAVPDKPET KLIDYPYHQRRLLPLLAYTYAMKMGADEAQQQYNSSFGALL KLNPVKDAEKFAVATADLKALFASSAGMKAFTTWAAAKIIDE CRQACGGHGYSYGYNGFGQAYADWVVQCTWEGDNNVLCLSM GRSLIQSCIAMRKKKGHVGKSVEYLQRRDELQNARVDNKPLT DPAVLITAWEKVACEAINRATDSFIKLTQEGLSPDQAFEELSQQ RFECARIHTRKHLITSFYARISKAKARVKPHLTVLANLFAVWSI EEDSGLFLREGCFEPAEMDEITALVDELCCEAREQVIGFTDAFN LSDFFINAPIGRFDGDAYKHYMDEVKAANNPRNTHAPYYETK LRPFLFRPDEDEEICDLDE |

| SEQ ID NO: | Description | Sequence |
|---|---|---|
| SEQ ID NO: 3783 | POX6 >gi\|50552444\|ref\| XP_503632.1\| YALI0E06567p [*Yarrowia lipolytica*] | MLSQQSLNTFTEPPVEMARERNQTSFNPRLLTYFLDGGEKNTL LMDRLMQEYERDPVFRNEGDYDITDVAQSRELAFKRIAKLIEY VHTDDEETYLYRCMLLGQIDMGAFARYAIHHGVWGGAIRGA GTPEQYEFWVKKGSLSVKKFYGSFSMTELGHGSNLVGLETTA TLDKNADEFVINTPNVAATKWWIGGAADTATHTAVFARLIVD GEDHGVKTFVVQLRDVETHNLMPGIAIGDCGKKMGRQGTDN GWIQFTHVRIPRQNMLMRYCHVDSDGNVTEPMMAQMAYGA LLAGRVGMAMDSYFTSRKFLTIALRYATIRRAFAAGGGQETK LIDYPYHQRRLLPLMA QTYAIKCTADKVRDQFVKVTDMLLNLDVSDQEAVPKAIAEAK ELFSVSAGVKATTTWACAHTIDQCRQACGGHGYSAYNGFGR AYSDWVIQCTWEGDNNILCLSAGRALVQSNRAVRAGKPIGGP TAYLAAPAGSPKLAGRNLYDPKVMIGAWETVSRALINRTTDE FEVLAKKGLSTAQAYEELSQQRFLCTRIHTRLYMVKNFYERIA EEGTEFTKEPLTRLANLYAFWSVEEEAGIFLREGYITPQELKYIS AEIRKQLLEVRKDVIGYTDAFNVPDFFLNSAIGRADGDVYKNY FKVVNTQNPPQDPRPPYYESVIRPFLFRKDEDEEICSLEDE |
| SEQ ID NO: 3784 | pAA298 (Nucleic Acid Seq.) | gatctggaatccctcggcgtcggtcttgggggtgggggcattctttcttggtcttgggaacgccaac gctttgttgtttgggttcttgaacacggactgctcgaaaaagtaccagtatgatgccttacctctgctgg cttttccacaagtatgggagggcattgacagcgactgtcttggctaacagcacgtcgtcggcaattaa atatttggcttccaataactgactaccaaggatggcagcagcggctatttctaatcctgacatgtttctc gtacgtagtagtgaatgaagggaaggtggaataatatcaaggcgcgaattctgcagatatccatcac actggcggccgctcgagcatgcatctagagggcccaattcgccctatagtgagtcgtattacaattc actggccgtcgttttacaacgtcgtgactgggaaaaccctggcgttacccaacttaatcgccttgcag cacatccccctttcgccagctggcgtaatagcgaagaggcccgcaccgatcgcccttcccaacagt tgcgcagcctatacgtacggcagtttaaggtttacacctataaaagagagagccgttatcgtctgtttg tggatgtacagagtgatattattgacacgccggggcgacggatggtgatcccctggccagtgcac gtctgctgtcagataaagtctcccgtgaactttacccggtggtgcatatcggggatgaaagctggcg catgatgaccaccgatatggccagtgtgccggtctcgttatcggggaagaagtggctgatctcag ccaccgcgaaaatgacatcaaaaacgccattaacctgatgttctggggaatataaatgtcaggcatg agattatcaaaaaggatcttcacctagatccttttcacgtagaaaagccagtccgcagaaacggtgct gaccccggatgaatgtcagctactgggctatctggacaagggaaaacgcaagcgcaaagagaaa gcaggtagcttgcagtgggcttacatggcgatagctagactgggcggttttatggacagcaagcga accggaattgccagctggggcgccctctggtaaggttgggaagccctgcaaagtaaactggatgg cttttctcgccgccaaggatctgatggcgcaggggatcaagctctgatcaagagacaggatgagga tcgtttcgcatgattgaacaagatggattgcacgcaggttctccggccgcttgggtggagaggctatt cggctatgactgggcacaacagacaatcggctgctctgatgccgccgtgttccggctgtcagcgca ggggcgcccggttcttttttgtcaagaccgacctgtccggtgccctgaatgaactgcaagacgaggc agcgcggctatcgtggctggccacgacgggcgttccttgcgcagctgtgctcgacgttgtcactga agcgggaagggactggctgctattgggcgaagtgccgggcaggatctcctgtcatctcaccttg ctcctgccgagaaagtatccatcatggctgatgcaatgcggcggctgcatacgcttgatccggctac ctgccattcgaccaccaagcgaaacatcgcatcgagcgagcacgtactcggatggaagccggt cttgtcgatcaggatgatctggacgaagagcatcaggggctcgcgccagccgaactgttcgccag gctcaaggcgagcatgcccgacggcgaggatctcgtcgtgacccatggcgatgcctgcttgccga atatcatggtggaaaatggccgcttttctggattcatcgactgtggccggctgggtgtggcggaccg ctatcaggacatagcgttggctacccgtgatattgctgaagagcttggcggcgaatgggctgaccg cttcctcgtgctttacggtatcgccgctcccgattcgcagcgcatcgccttctatcgccttcttgacga gttcttctgaattattaacgcttacaatttcctgatgcggtattttctccttacgcatctgtgcggtatttca caccgcatacaggtggcacttttcggggaaatgtgcgcggaacccctatttgtttatttttctaaataca ttcaaatatgtatccgctcatgagacaataaccctgataaatgcttcaataatagcacgttgaggaggg ccaccatggccaagttgaccagtgccgttccggtgctcaccgcgcgcgacgtcgccggagcggt cgagttctggaccgaccggctcgggttctcccgggacttcgtggaggacgacttcgccggtgtggt ccgggacgacgtgaccctgttcatcagcgcggtccaggaccaggtggtgccggacaacaccctg gcctgggtgtgggtgcgcggcctggacgagctgtacgccgagtggtcggaggtcgtgtccacga acttccgggacgcctccgggccgccatgaccgagatcggcgagcagccgtgggggcgggag ttcgccctgcgcgaccggccggcaactgcgtgcacttcgtggccgaggagcaggactgacacg tgctaaaacttcatttttaatttaaaaggatctaggtgaagatccttttttgataatctcatgaccaaaatcc cttaacgtgagttttcgttccactgagcgtcagacccccgtagaaaagatcaaaggatcttcttgagat cctttttttctgcgcgtaatctgctgcttgcaaacaaaaaaaccaccgctaccagcggtggtttgtttgc cggatcaagagctaccaactctttttccgaaggtaactggcttcagcagagcgcagataccaaatac tgtccttctagtgtagccgtagttaggccaccacttcaagaactctgtagcaccgcctacatacctcg ctctgctaatcctgttaccagtggctgctgccagtggcgataagtcgtgtcttaccgggttggactca agacgatagttaccggataaggcgcagcggtcgggctgaacggggggttcgtgcacacagccca gcttggagcgaacgacctacaccgaactgagatacctacagcgtgagctatgagaaagcgccac gcttcccgaagggagaaaggcggacaggtatccggtaagcggcagggtcggaacaggagagc gcacgagggagcttccaggggaaacgcctggtatctttatagtcctgtcgggtttcgccacctctg acttgagcgtcgatttttgtgatgctcgtcaggggggcggagcctatggaaaaacgccagcaacgc ggcctttttacggttcctggccttttgctggccttttgctcacatgttctttcctgcgttatcccctgattct gtggataaccgtattaccgcctttgagtgagctgataccgctcgccgcagccgaacgaccgagcg cagcgagtcagtgagcgaggaagcggaagagcgcccaatacgcaaaccgcctctccccgcgcg ttggccgattcattaatgcagctggcacgacaggtttcccgactggaaagcgggcagtgagcgca acgcaattaatgtgagttagctcactcattaggcaccccaggctttacactttatgcttccggctcgtat gttgtgtggaattgtgagcggataacaatttcacacaggaaacagctatgaccatgattacgccaag ctatttaggtgacactatagaatactcaagctatgcatcaagcttggtaccgagctcggatccactagt |

| SEQ ID NO: | Description | Sequence |
|---|---|---|
| | | aacggccgccagtgtgctggaattcgcccttccgttaaacaaaaatcagtctgtaaaaaaggttcta
aataaatattctgtctagtgtacacattctcccaaaatagtgaaatccagctctacaatttggctttaccg
gtacaaatcaaagaccaatcgtcttcagtcaactcctggtacttgtcgccattcaaccagtagatcaa
atccttgccgtcttcacccttggcaacttttggttcttgaattggttcttaggaaccttgtggttgtgcga
agcctcaatggtgccaatcttgatgaacgcaggttgagcatacacaggcaaagacttggtcacgtg
agagtgaatcaatttcaagatttcttcatggctcaactcgtccttggcttcacagacggcaaaacagg
ctctaccttcgtggtttggcaccttgacaccgacaacgacggactgcttcaaggccttggagcccat
caattcgttctcgacctcggtggcggagacgttttcggacttccaacggaaagtgtcacctaatctgt
cgacaaagtacaacaatttgtcctcgtccatcttcaacaagtcaccggatctgtaccacgcgtcacct
tttttgaaaacattggtgaggattttgctgttggtggcggacttgttaccataataaccctggaaggattt
ctgcacgtcgttagggttcaagattctcatcaacaactcacctggctcgttgtaagcggcctcggtac
agaacccggtcttggggtccttgtagatttcactctcgtcttctgggtccatcttggccaatttctgctg
ggtagacaataacaagctgatgagggacccgtacttacgacaggcgccgacaccgtactcaccgt
actgcaagttggtggtggcgatagggactcggtggcggcgtagaactcaccgataccttcaatgt
ggaatctgcgcttgaactcagaccatatatctggacgcaaccgttaccgtaggcaattctgacattg
tgtctgtcttggtctggatgaggcttggagttcaacaagtaacgacagacctcaccgacgtattgcac
gtgggtggcaccacataatctggcctgggtccagaacgaagtagcggagaatttctgggacacgg
agacacagccaccgacaatcaaagtaggacacaaccccaacactggccgcggtggagtggtaca
agggcatggcggtcaagacgttcgatttcgagtcaatcttcatgatgtggcaaagaaaaccgagg
ccatgaaggcttttctccaggacatgataccggcttttggcaaaccggtggtacccgaggtgtaaat
caatgcacaagcggaggagtcagtatcggttggtcttctggtcttgtcctcggctctgtgttttggagt
cgacttgagtctcaatcgtcaaacaaggcaaactcgtcaatgtagtttatttgcacatgtggcaattc
ctctctgatctgagcctcggtatctctgattgggaatcacagtccgggtcaacgaaaacttgcgaa
gcgttgacaatcttaagacagtggcaatggcttgtccttggtgttgaagttcaagaacgcaggcaa
ggcaccaatgttccacaatgccaaccacaagacaatgaaaagcggcttgttcatacaagaaacacc
gatggtgtcgttggcagtgacgccgtactcgttcttcaagatgtatgagtacttcaaaaccatgtcgta
caattccttgtaggtgtattcttctaggtcaaactgatcgtcgtagatccactagtaacggccgccagt
gtgctggaattcgcccttgggctaacgaaaaggaaaccgctgacgttaaaggtatctacggttgtttc
ggtatgaccccggggatctgacgggtacaacgagaattgtattgaattgatcaagaacatgatctt
ggtgttacagaacatcaagttcttggaccagactgagaatgcacagatatacaaggcgtcatgtgat
aaaatggatgagatttatccacaattgaagaaagagtttatggaaagtggtcaaccagaagctaaac
aggaagaagcaaacgaaggaggtgaaacaagaagaagaaggtaaataagtattttgtattatataac
aaacaaagtaaggaatacagatttatacaataaattgccatactagtcacgtgagatatctcatccatt
ccccaactcccaagaaaaaaaaaaagtgaaaaaaaaaatcaaacccaaagatcaacctccccatc
atcatcgtcatcaaaccccagctcaatcgcaatggttagcacaaaaacatacacagaagggca
tcagcacacccctccnaggttgcccaacgtttattccgcttaatggagtccaaaagaccaacctct
gcgcctcgatcgacgtgaccacaaccgccgagttcctttcgctcatcgacaagctcggtccccaca
tctgtctcgtgaagacgcacatcgatntcatctcagacttcagctacgagggcacgattgagccgtt
gcttgtgcttgcagagcgccacgggttcttgatattcgaggacaggaagtttgctgatatcggaaac
accgtgatgttgcagtacacctcggggggtataccggatcgcggcgtggagtgacatcacgaacgc
gcacggagtgactgggaagggcgtcgttgaagggttgaaacgcggtgcggaggggggtagaaaa
ggaaaggggcgtgttgatgtnggcggagttgtcgagtaaaggctcgttggcgcatggtgaatatac
ccgtgagacgatcgagattgcgaagagtgatcgggagttcgtgattgggttcatcgcgcagcggg
acatggggggtagagaagaagggtttgattggatcatcatgacgcctggtgtggggttggatgata
aaggcgatgcgttgggccagcagtataggactgttgatgaggtggttctgactggtaccgatgtgat
tattgtcggagagggttgtttggaaaaggaagagacctgaggtggaggaaagagatacagg
gatgctggatggaaggcatacttgaagagaactggtcagttagaataaatattgtaataaataggtct
atatacatacactaagcttctaggacgtcattgtagtcttcgaagttgtctgctagtttagttctcatgatt
tcgaaaaccaataacgcaatggatgtagcagggatggtggttagtgcgttcctgacaaacccagag
tacgccgcctcaaaccacgtcacattcgccctttgcttcatccgcatcacttgcttgaaggtatccacg
tacgagttgtaatacaccttgaagaacggcttcgtctacggtcgacgacgggtacaacgagaattgt
attgaattgatcaagaacatgatcttggtgttacagaacatcaagttcttggaccagactgagaatgc
acagatatacaaggcgtcatgtgataaaatggatgagatttatccacaattgaagaaagagtttatgg
aaagtggtcaaccagaagctaaacaggaagaagcaaacgaaggtgaaacaagaagaagaa
ggtaaataagtattttgtattatataacaaacaaagtaaggaatacagatttatacaataaattgccata
ctagtcacgtgagatatctcatccattccccaactcccaagaaaaaaaaaagtgaaaaaaaaatc
aaacccaaagtcaacctccccatcatcatcgtcatcaaaccccagctcaattcgcagagctcggt
acccggg |
| SEQ ID NO: 3785 | Candida strain ATCC20336 Thioesterase PTE1 | MRGMEKPHSLFRRMSTAPFAIIQPPISILSATLITSEFFFVYSLYN
FFHFIIDLFYYYTHIYPHRAMIENISGNGNYPQNHEVDLEKEF
GVEKIGINLYRDKSPIPKPDRRSRGAYGGYLAGQALLVAMKST
PPEYRPHSFHSYFIKAVNDKETLEWRVEETSNGRNYANRSLQA
PQAGNLVYTANVSLTKKNSAKKAEEATGVKPFEFQGKPHEWF
EKHKRDDLPLATPSSSLLIYHKFFPEVVSLEASKEEESKPAADR
ELSWYFKWGINNEEGHHQPLVNLNSDYQYVGMAALTDAVYL
NRLLRILRVEDADHTQLVHYFSVSLDHTMYFHDDDFDVTKW
MGFTFKVTRFSHNRALCQGEVYNDKGVHVCTIVQEGLMMLN
GLEEGAKL* |
| SEQ ID NO: 3786 | Candida strain ATCC20336 Thioesterase PTE2 | MICVFFPTSTFTTAHKFVSNLQSFFLSQQPHTTSYTMPTFNYKD
GETIDVQKEFGVVETAPNKYVGVKPLVKPMPHVKGVPGGNL
AGQALLVAMKSVGPDFSPHSLHSYFIRAGSDQTPVEWTVQAIS
DGNSFCNRFIKGVQNGQVIYIANVSLTKRNSAADAMKKYEEY
HAQIRQKGKDGDADEEDEDDDDEDDNAPAKPFGFQTPSHKWI |

-continued

| SEQ ID NO: | Description | Sequence |
|---|---|---|
| | | KDRDLDKLPVSDMESNLLLYYKLPPEFVSLKSSTEEESLPVSER RMGALAKWGIENEQGFNQPLTNLDKSFQYVGLANITDGLYLG TLNRILRIDDLTLDERATNYFSVSLDHVIYFHDDDFDVTKWMG FTFRCSRYSHNRVIFEGEIYSDKGVQVASIIQEGLVRFKDGYLK NAKL |

Example 54: Additional Nucleotide and Amino Acid Sequences

| SEQ ID NO: | Description | Sequence |
|---|---|---|
| SEQ ID NO: 3787 | Peroxisomal 2,4-dienoyl-CoA reductase >gi\|110279051\|sp\|P32573.4\|SPS19_YEAST | MNTANTLDGKFVTEGSWRPDLFKGKVAFVTGGAGTICRVQT EALVLLGCKAAIVGRDQERTEQAAKGISQLAKDKDAVLAIAN VDVRNFEQVENAVKKTVEKFGKIDFVIAGAAGNFVCDFANLS PNAFKSVVDIDLLGSFNTAKACLKELKKSKGSILFVSATFHYY GVPFQGHVGAAKAGIDALAKNLAVELGPLGIRSNCIAPGAIDN TEGLKRLAGKKYKEKALAKIPLQRLGSTRDIAESTVYIFSPAA SYVTGTVLVVDGGMWHLGTYFGHELYPEALIKSMTSKL |
| SEQ ID NO: 3788 | CvDCR1_NODE5705 | atgccaaacactttagatcacaactaccttaagaaaagcgtctggaagtcagatatctttgccggc aaagtcatcttcatcactggtggtgccggtaccatctgtcgtgtgcaagccgaagccatggtcttg ttgggtgctaatgctgccatcattggtagaaacgtcgaaaagactgaagaagccgctaaggagatt gcttccttgagaccaggagccaaggtcattggtattggtgccgttgacgtgcgtaagatccaaact atcaaggatgccgttgacagaactgttgccgagttgggcagaatcgactatgtcattgctggtgcc gccggtaacttcctttgtgacttcaaccacttgtctgccaacgccttcaagtccgtgattgacatt gatttgttgggttcttttcaacaccgtcaaggttaccttttgaccagttgagaaagaacaaaggtgcc gtgttgtttgtcagtgccactttgcactacaccggtgttcctatgcaatcgcacgttggtgctgcc aagtctggtgttgatgccttgagcaacgcccttgctgttgaattgggtccattgggtatcagattc aactgtattgccccaggtgccattgctggtactgaaggtatgctgagattggcccacctaccgac acgccattggagacgaagattccattgcagagacaaggtactactgaggacattgctgatgccact gtgttttttgttctcgccagcttcctcctacattactggtgatgttttggttgttgatggtgctatg tggcaaactggcggaggtattcttaacgacttctacccagacatcattattccagaaacgccgac ccagaaggtaagttgtaa |
| SEQ ID NO: 3789 | CvDCR1_NODE5705 | MPNTLDHNYLKKSVWKSDIFAGKVIFITGGAGTICRVQAEAM VLLGANAAIIGRNVEKTEEAAKEIASLRPGAKVIGIGAVDVRK IQTIKDAVDRTVAELGRIDYVIAGAAGNFLCDFNHLSANAFKS VIDIDLLGSFNTVKVTFDQLRKNKGAVLFVSATLHYTGVPMQ SHVGAAKSGVDALSNALAVELGPLGIRFNCIAPGAIAGTEGMS RLAPPTDTPLETKIPLQRQGTTEDIADATVFLFSPASSYITGDVL VVDGAMWQTGGGILNDFYPDIIIHQNADPEGKL |
| SEQ ID NO: 3790 | CvDCR2_NODE6821 | atgccaaacactttaactgaagcatacaaacaagaaagttcttggaagccagatttgttcaagg gcaaagtcgtcttcatcaccggtggtgcaggttcgatctgccgtgtccaggccgaagccatggt cttgttgggtgccaacgctgccatcattggtagaaacgtcgaaaagaccgaatccgccgccaaa gaaatcgccagcttgagatcaggagccaaggttcttggtattggtggcattgatgtgcgtaaag ttgacagcttgaagagccgcgtcgataagaccgttgccgaattgggcgaattcgactttgtcat tgctggtgccgccggtaacttcctttgtgacttcaaccacttgtcttccaacgccttcaaatcc atcattgacattgacttgttgggttcttttcaacaccgtcaaggtcacttttgaccaattgagaa agaacaagggtgccatcttgtttgtcagtgccaccttgcactacgtgttccttttccaaat tggtgttggtgctgccaaggctggtgtcgacgccttgagcaagtgccctttgccgttgagttgggt ccattgggcatcagatccaactgtattgccccaggtccaatcgacggtaccgaaggtgttgaaa gattggtcagagcttccaaggccgaagccgccaagaaggttccattgcaaagattgggtactac acaagacattgctgacggtaccgtctacttgttctccccagccgcctcctttgtcactggtgac gttttggttgttgatggtgctagctggcagatctcctctggtgttggtgccaccaactacccag tctccatcctcaatgcgatcgacgcaccgaaggtggtaagttgtaa |
| SEQ ID NO: 3791 | CvDCR2_NODE6821 | MPNTLTEAYKQESSWKPDLFKGKVVFITGGAGSICRVQAEAM VLLGANAAIIGRNVEKTESAAKEIASLRSGAKVLGIGGIDVRK VDSLKSAVDKTVAELGRIDFVIAGAAGNFLCDFNHLSSNAFKS IIDIDLLGSFNTVKVTFDQLRKNKGAILFVSATLHYYGVPFQIG VGAAKAGVDALSNALAVELGPLGIRSNCIAPGPIDGTEGVERL VRASKAEAAKKVPLQRLGTTQDIADGTVYLFSPAASFVTGDV LVVDGASWQISSGVGATNYPVSILNAIDAPKGGKL |
| SEQ ID NO: 3792 | DCR; Candida_tropicalis_XP_002545283 | MPNTLDQSYVKRSVWKSDIYAGKVVFITGGAGSICRVQAEA MVLLGANAAIIGRNVEKTESAAEEIASLRPGAKVIGIGGVDVR KIQTIKEAVDRTVAELGRIDYVAGAAGNFLCDFNHLSSNAF KSVIDIDLLGSFNTVKVTFDELRKNKGSVIFVSATLHYTGVPM QAHVGAAKAGVDALSNALAVELGPLGIRFNCIAPGAISGTEG MSRLAPPSDTPLEKKIPLQRQGTTEDIADATVFLFSPAASYVTG DVLVVDGAMWQTGGGIINDFYPDIIVHQNSDPDGKL |

-continued

| | | |
|---|---|---|
| SEQ ID NO: 3793 | DCR; Candida_tropicalis_XP_002550344 | MPNTLTQSYVQESSWKPDLFKGKVVFITGGAGSICRVQAEAM VLLGANAAIIGRNVEKTESAAKEIASLRSGAKVLGVGGIDVRK IDSLKSAVDKTVAELGRIDYVIAGAAGNFLCDFNHLSSNAFKS IVDIDLLGSFNTVKATFDQLRKNKGAILFVSATLHYYGVPYQI GVGAAKAGVDALSNAFAVELGPLGIRSNCIAPGPIDGTEGLSR LSRASKDQTSKKVPLQRLGTTQDIADGTVYLFSPAASFVTGD VLVVDGASWQISSGVGATDYPVSITKANSDPVGKL |
| SEQ ID NO: 3794 | DCR; Yarrowia_lipolytica_XP_501382 | MPNTLSPDWLKKSVFKPDIFKGKVVFVTGGAGTICRVQTEAM ILLGADAAIIGRRPEVTQKAADEMAQLRPGAKVIGVGNTDVR EVKSLVAAAERTVKELGRIDFVICGAAGNFLSDFNHLSSNAFK SVISIDLLGSYNTVKACFPELRKNKGSILFVSATLHYYGIPFQT HVSAAKAGIDALSNALAVELGPLGIRSNCIAPGAIAGTEGIDRL LPADMREKALSLIPAQRWGQTEDIANGTVYVFSEAASYVSGT TIVVDGAGWHTSNGAANNAVYPQMLIAQGNDTPKL |
| SEQ ID NO: 3795 | DCR; Yarrowia_lipolytica_XP_503937 | MPNTLTPEWLKTCVYNPGLFDGKVVFVTGGAGTICRVQTEAL ILLGANAAVIGRRPEVTQKAAEEMQQLRPGAKVIGIGNCDVR EVKSLVAAAEKAVQELGRIDYVIAGAAGNFLADFNHLSANAF KSVISIDLLGSYNTVKACFPELRKNKGKVLFVSATLHYRGVSL QSHVSAAKAGIDALSQALAVELGPLGIAVNCLAPGPIDGTEGL GRLLPSDARKRSLQLVPQRFGTTEDIANGTVFLFSDAASYIS GTTLVIDGAAWHTSARTTYPETVIVQGNKPPKL |
| SEQ ID NO: 3796 | DCR; Yarrowia_lipolytica_XP_502296 | MLPADFIESSPYKSNIFVGKVVFVTGGAGTICKDQTEALVRLG ANGAIVGRKKEVTEKAAKELEALRPGARVLGLGEIDVRDIQS LKRAVDTTISELGRIDYVIAGAAGNFVTDINHMSANAFKTVID IDLLGSFNTAKATFEALRASAGSLVFISATAHYHGSPPTAHVG AAKAGIDALMQALAVELGPLGIRVNCIAPGFIAATEGMDRLLP PDMQKTYTRLTPLQRFGTTLDIANATVWLFSEAASYVSGTVI VVDGAWHSAQQTSTLHYYPDMLKHMGEDKSKI |
| SEQ ID NO: 3797 | ScECI1 | atgtcgcaagaaattaggcaaaatgagaaaatcagttatcgtattgaaggaccattcttcatta ttcacttaatgaaccctgacaatttgaatgcactagaaggtgaagactatatttattaggaga gttactagaactagcggacagaaatcgtgatgtatattttacaattatacaaagcagtggtaga tttttttttccagtggtgctgattcaagggtattgcaaaagcccaaggggatgataccaataaat atccttcggaaacaagcaagtgggtgtcaaattttgtcgctagaaatgtttatgtcactgatgc cttcatcaagcattccaaagttttaatttgctgtttgaatggaccagcaataggggttagcgcg gcactggtagcgttatgtgacattgtgtacagtataaatgacaaggtttatttgctataccct ttgctaacttaggactaattaccgaaggtggtacaacggtctctttgccattgaagtttggcac aaatacgacgtatgaatgcctcatgttcaacaaaccattcaagtacgatataatgtgcgagaac ggatttataagcaagaatttaacatgccatcttcaaacgctgaagcgttcaatgcaaaggtct tagaagaattgagggagaaagtgaaagggctatacctgcccagttgcttagggatgaaaaatt gctgaaatcgaaccacatcgatgcattcaataaggctaactcagtggaagtaaatgaatctctc aagtattgggtagatggagagcccttaaaaagatttaggcagctgggctcgaaacaaaggaagc atcgtttatga |
| SEQ ID NO: 3798 | ScEci1p | MSQEIRQNEKISYRIEGPFFIIHLMNPDNLNALEGEDYIYLGEL LELADRNRDVYFTIIQSSGRFFSSGADFKGIAKAQGDDTNKYP SETSKWVSNFVARNVYVTDAFIKHSKVLICCLNGPAIGLSAAL VALCDIVYSINDKVYLLYPFANLGLITEGGTTVSLPLKFGTNTT YECLMFNKPFKYDIMCENGFISKNFNMPSSNAEAFNAKVLEE LREKVKGLYLPSCLGMKKLLKSNHIDAFNKANSVEVNESLKY WVDGEPLKRFRQLGSKQRKHRL |
| SEQ ID NO: 3799 | CvECI1 | atgtccgacgaggaatcagatatcttatacgaagtcagagacagaaccgccatcatccacttga acatccccaagagattaacgcattgaacggcgctcaatacttgaagttgggcaagttcttgga gagagccaacaacgaagaggacaccgtcttgaccttgatccaggccctgggcagattcttctcc gccggtgccaatttcgccgacaacgacatggccaaggtcgaaatgtccaagttcgttcagtcacg agtactggttggatagattcgtcgccagaaacatctggttgaccaacttgttcaatgaccacaa gaagatcttggccgctgctgtcaacggtccagttatcggtttgagtactggttcgttgttgttg gtcgacttggtctacgtccacgacttgaacaagttctatctcttggccccattttgccaacttgg gtttggttgccgaaggtgcttcctcggccacttttgttcaacagattgggctggtcaaaggcttc tgaagctttgttgttggccaagccaatcagcggccaggactgttacaacgctggtttcatcaac aagcactacgacggtaagttttcctcactgaggagttcaacgaacacgtctacaaggagttga ccgatgccttgaaaacttgcacgaagattccatcttgcagaacaagcaattgttgaagttgtc gagagaccaggctatcaatgttgccaactcgcaagaggtcatgagagggtttgggcaagtggttg gaaggtgttccacaaaccagattgctcaattggcccagaaggaggtcaagcacaaactttag |
| SEQ ID NO: 3800 | CvEci1p | MSDEESDILYEVRDRTAIITLNIPKRLNALNGAQYLKLGKFLE RANNEEDTVLTLIQASGRFFSAGANFADNDMAKVEMSKLFSH EYWLDRFVARNIWLTNLFNDHKKILAAAVNGPVIGLSTGLLL LVDLVYVHDLNKFYLLAPFANLGLVAEGASSATLFNRLGWS KASEALLLAKPISGQDCYNAGFINKHYDGKFSSTEEFNEHVYK ELTDAFENLHEDSILQNKQLLKLSRDQAINVANSQEVMRGLG KWLEGVPQTRFAQLAQKEVKHKL |

| SEQ ID NO: 3801 | CvECI2 | atgtccgacgacctatcacctacgaagtcaaagaccgagctgccgtgatcaccttgaacaacc
ccaagaagctcaacgccttatcgatcccgcagtacgacaccatctgcaagctcttagaacgagc
caacgccgaagaagacaccgtcatcaccttgctccagtccacgggccgggtgttctctgccggg
gccaacgccgactccatcgtggggcaggatgccgagctcgagacctggttgaacatgtcggtgg
ccaagcagacgttcttggtgcagacgttcctcgcacacaagaagatccttgccgtcgccttgaa
cggccccgtgattggcttatcggcggcgttcgtggcgctctgcgacttggtctacgtgcacaac
gccgcaaagacgttcttcttgacccccgttcgccaacatcgggatccttgccgagggcggcacct
cagccacgttgcccatgcgcgtggggtggtccagggccgcggaagcgttgttgttgtcaaagag
gatttcggggagatgacttgcagagagcggggttcttcaatcaaggactacaaggggcagttcaag
tccgcggaggagtttaacgaggtcgtcttgaaggagttgcttgacgccacggaaaacttgcatg
aggactcgatcatccagaacaaggagttgttgaaggctattttcaagccaaagatcagtgaggt
caactcgcaggaggtgtcaagaggtgtgtacaagtggacctctggggtgccaatggatagattt
aaaaaaattgcttaatggtgagttgaaacataaattatag |
| SEQ ID NO: 3802 | CvEci2p | MSDDLITYEVKDRAAVITLNNPKKLNALSIPQYDTICKLLERA
NAEEDTVITLLQSTGRVFSAGANADSIVGQDAELETWLNMSV
AKQTFLVQTFLAHKKILAVALNGPVIGLSAAFVALCDLVYVH
NAAKTFFLTPFANIGILAEGGTSATLPMRVGWSRAAEALLLSK
RISGDDLQRAGFFNKDYKGQFKSAEEFNEVVLKELLDATENL
HEDSIIQNKELLKAIFKPKISEVNSQEVSRGVYKWTSGVPMDR
FKKLLNGELKHKL |
| SEQ ID NO: 3803 | CvEci1p; Candida_tropicalis_XP_002548748 | MSEEETDILYEVKDRTAIITLNIPDKLNALNGAQYLKLGKFLE
RANNEEDTVLTLIQASGRFFSAGANFADNDMTKVEVEKLFSH
EYWLERFVARNVWLTNLFNDHKKILAAAVNGPVIGLSTGLL
MLVDLIYVHDLNKFYLLAPFANLGLVAEGASSATLFARLGWS
KASEALLLAKPISGADCYNAGLINKHYDGKFSSTEQFNDQVY
KELNDAFENLHEDSIIQNKQLLKLSRDQFINHANSQEVMRGL
GKWLEGVPQTRFVQLAQKEVKHKL |
| SEQ ID NO: 3804 | CvEci1p; Yarrowia_lipolytica_XP_500719.1 | MRSLYINVPGLFPSTSLARETVHHRTEMLRTIRSSSRLGVRAM
STAATRRAAQIGFHTRVPTVVTKAPTLRMQTTPFSSSAPAQTF
GDKKYEHILTSTPVPKVALVTLNRPKALNALCTPLIKELNEAL
QAADADPTIGAIVLTGSEKSFAAGADIKEMKDKTVTSVLNEN
FIEEWGNMANIKKPIIAAVNGFALGGGCELAMMADIIYAGAK
AKFGQPEIKLGVIPGAGGTQRLTRAIGLYRANHYILTGEMFTA
QQAADWGLAAKVYEPAQLVDESVKAAAQIASYGQLAVQAA
KASVHQSAEVGLRAGLEFERVRFHGLFGTHDQKEGMAAFAE
KREPNFKNE |
| SEQ ID NO: 3805 | CvEci2p; Candida_tropicalis_XP_002548746 | MSDELITYEVKDRAVLITLNNPKKLNSLTIHQYDTICKYLERA
NNEEDTIITLIQSTGRVFSAGANADSIVGQDAELETWMNLSIA
KQTFLVQTFLAHKKILAVALNGPVIGLSASFVTLCDLIYVNDL
SKTFLLTPFANIGILAEGGTSATLPMRLGWSKASEALLLSKRIS
GDDLQNAGLINKHYNGKFKTAEEFNVTVLNELLDATETLHQ
DSIIQNKQLLQAMFKPRISEVNSQEVSRGVYKWTSGEPMSRF
KKLLTGELKHKL |
| SEQ ID NO: 3806 | CvEci2p; Yarrowia_lipolytica_XP_500719.1 | MRSLYINVPGLFPSTSLARETVHHRTEMLRTIRSSSRLGVRAM
STAATRRAAQIGFHTRVPTVVTKAPTLRMQTTPFSSSAPAQTF
GDKKYEHILTSTPVPKVALVTLNRPKALNALCTPLIKELNEAL
QAADADPTIGAIVLTGSEKSFAAGADIKEMKDKTVTSVLNEN
FIEEWGNMANIKKPIIAAVNGFALGGGCELAMMADIIYAGAK
AKFGQPEIKLGVIPGAGGTQRLTRAIGLYRANHYILTGEMFTA
QQAADWGLAAKVYEPAQLVDESVKAAAQIASYGQLAVQAA
KASVHQSAEVGLRAGLEFERVRFHGLFGTHDQKEGMAAFAE
KREPNFKNE |
| SEQ ID NO: 3807 | pAA335 | ggtttgattggatcatcatgacgcctggtgtggggttggatgataaaggcgatgcgttgggcca
gcagtataggactgttgatgaggtggttctgactggtaccgatgtgattattgtcggggagaggg
ttgtttggaaaaggaagagaccctgaggtggagggaaagagatacagggatgctggatggaagg
catacttgaagagaactggtcagttagaataaatattgtaataaataggtctatatacatacac
taagcttctaggacgtcattgtagtcttcgaagttgtctgctagtttagttctcatgatttcga
aaaccaataacgcaatggatgtgacagggatggtggttagtgcgttcctgacaaacccagagta
cgccgcctcaaaccacgtcacattcgccctttgcttcatccgcatcacttgcttgaaggtatcc
acgtacgagttgtaatacaccttgaagaacggcttcgtctacgcgcgagacgaaagggcctcgt
gatacgccatttttataggttaatgtcatgataataatggtttcttagacgtcaggtggcact
tttcggggaaatgtgcgcggaaccctatttgttttattttttctaaatacattcaaatatgtatc
cgctcatgagacaataaccctgataaatgcttcaataatattgaaaaaggaagagtatgagtat
tcaacatttccgtgtcgcccttattccctttttttgcggcattttgccttcctgttttgctcac
ccagaaacgctggtgaaagtaaaagatgctgaagatcagttgggtgcacgagtgggttacatcg
aactggatctcaacagcggtaagatccttgagagttttcgccccgaagaacgttttccaatgat
gagcacttttaaagttctgctatgtggcgcggtattatcccgtattgacgccgggcaagagcaa
ctcggtcgccgcatacactattctcagaatgacttggttgagtactcaccagtcacagaaaagc
atcttacggatggcatgacagtaagagaattatgcagtgctgccataaccatgagtgataacac
tgcggccaacttacttctgacaacgatcggaggaccgaaggagctaaccgcttttttgcacaac
atgggggatcatgtaactcgccttgatcgttgggaaccggagctgaatgaagccataccaaacg
acgagcgtgacaccacgatgcctgtagcaatggcaacaacgttgcgcaaactattaactggcga
actacttactctagcttcccggcaacaattaatagactggatggaggcggataaagttgcagga |

-continued

```
                     ccacttctgcgctcggcccttccggctggctggtttattgctgataaatctggagccggtgagc
                     gtgggtctcgcggtatcattgcagcactggggccagatggtaagccctcccgtatcgtagttat
                     ctacacgacggggagtcaggcaactatggatgaacgaaatagacagatcgctgagataggtgcc
                     tcactgattaagcattggtaactgtcagaccaagtttactcatatatactttagattgatttaa
                     aacttcattttaatttaaaaggatctaggtgaagatccttttttgataatctcatgaccaaaat
                     cccttaacgtgagttttcgttccactgagcgtcagacccgtagaaaagatcaaaggatcttct
                     tgagatcctttttttctgcgcgtaatctgctgcttgcaaacaaaaaaaccaccgctaccagcgg
                     tggtttgtttgccggatcaagagctaccaactctttttccgaaggtaactggcttcagcagagc
                     gcagataccaaatactgttcttctagtgtagccgtagttaggccaccacttcaagaactctgta
                     gcaccgcctacatacctcgctctgctaatcctgttaccagtggctgctgccagtggcgataagt
                     cgtgtcttaccgggttggactcaagacgatagttaccggataaggcgcagcggtcgggctgaac
                     ggggggttcgtgcacacagcccagcttggagcgaacgacctacaccgaactgagatacctacag
                     cgtgagctatgagaaagcgccacgcttcccgaagggagaaaggcggacaggtatccggtaagcg
                     gcagggtcggaacaggagagcgcacgagggagcttccagggggaaacgcctggtatctttatag
                     tcctgtcgggtttcgccacctctgacttgagcgtcgatttttgtgatgctcgtcaggggggcgg
                     agcctatggaaaaacgccagcaacgcggcctttttacggttcctggccttttgctggccttttg
                     ctcacatgttctttcctgcgttatcccctgattctgtggataaccgtattaccgcctttgagtg
                     agctgataccgctcgccgcagccgaacgaccgagcgcagcgagtcagtgagcgaggaagcgagt
                     tcggcatggcagatcatcatgcctgcaggaagatgaagcgtatgagtattatgagtactgtcgg
                     acgttggaaggtggcagagttaagcccgagaaagcaaggaaggagtgggagatgatgagtgatg
                     cggccaaagaggatgtgaaggctgcgtatctgtttttgatagctggtggtagccgaatagagga
                     aggcaagcttgttcatattggatgatgatggtagatggtggctgccaaagtggttgtaaataga
                     aaaaagtgggtttgggtctgttgatagttagtggtggcggctgtctgtgattacgtcagcaagt
                     agcacctcggcagttaaaacagcagcaacagaaaaaaaatgtgtgaaagtttgattcccccaca
                     gtctaccacacccagagttccatttatcctaatatcacaagcaatagaaaaataaaaaattat
                     caacaaatcacaacgaaaagattctgcaaaattattttcacttcttctttttgacttcctcttct
                     tcttgttaggttctttccatattttccccttaaacccatacacaacgcagccagaagagcccgg
                     gtctagatgtgtgctcttccgctccaggcttgttatgactctagagagaagtgtgtgtgtgtgt
                     gtgcgtttgttttactatacattcaacatgttctttttcttttttgatatttattccaactata
                     attatacacagattcgtatatacttttacttacctctttcgtagttttttaatttgatgattt
                     ttgagttcatatccaaggtcaaaacccgaccgaattcatatgcgacgggtacaacgagaattg
                     tattgaattgatcaagaacatgatcttggtgttacagaacatcaagttcttggaccagactgag
                     aatgcacagatatacaaggcgtcatgtgataaaatggatgagatttatccacaattgaagaaag
                     agtttatggaaagtggtcaaccagaagctaaacaggaagaagcaaacgaaggagggtgaaacaaga
                     agaagaaggtaaataagtattttgtattatataacaaacaaagtaaggaatacagatttataca
                     ataaattgccatactagtcacgtgagatatctcatccattccccaactcccaagaaaaaaaaa
                     agtgaaaaaaaaatcaaacccaaagatcaacctccccatcatcatcgtcatcaaaccccagc
                     tcaattcgcaatggttagcacaaaaacatacacagaaagggcatcagcacacccctccaaggtt
                     gcccaacgtttattccgcttaatggagtccaaaaagaccaacctctgcgcctcgatcgacgtga
                     ccacaaccgccgagttccttccgctcatcgacaagctcggtccccacatctgtctcgtgaagac
                     gcacatcgatatcatctcagacttcagctacgagggcacgattgagccgttgcttgtgcttgca
                     gagcgccacgggttcttgatattcgaggacaggaagtttgctgatatcggaaacaccgtgatgt
                     tgcagtcacacctcggggggtataccggatcgcggcgtggagtgacatcacgaacgcgcacggagt
                     gactgggaagggcgtcgttgaagggttgaaacgcggtgcggagggggtagaaaaggaaagggc
                     gtgttgatgttggcggagttgtcgagtaaaggctcgttggcgcatggtgaatatacccgtgaga
                     cgatcgagattgcgaagagtgatcgggagttcgtgattgggttcatcgcgcagcgggacatggg
                     gggtagagaagaag SEQ      pAA918       ggccgcgagcactaggttttgataatttggttcttacagtttatgtattttgattcttccttt
ID       sequence     ttagatacttttttttatattttattattccttattgatgtaacgacagtcccactataattaa
NO:                   cttaaactttgctgtaaatcagatgacaagtgtttccctgtttgcaggggagctctactagttt
3808                  ccttaattcatcttggttatgttgttcttgcaccgcaaggataagctgggcccgaatccaggcc
                     acgcataccaactatcgctgcccggaaaaaatacaaactagtaaactgcaaaaaaccatatata
                     aacaataagaattttctctgtatcattcttcgaaaaacctcaccttctctctctctctctctct
                     cacccttcctttcccctatcacatcttcatcttcacatcaccaactcaaaaccctcaagcagcc
                     aaagtaaagaacagagaatgattccacaacatcacactatgttcttcgccgttaattaagaatt
                     cactggccgtcgttttacaacgtcgtgactgggaaaacccctggcgttacccaacttaatcgcct
                     tgcagcacatccccctttcgccagctggcgtaatagcgaagaggcccgcaccgatcgcccttcc
                     caacagttgcgcagcctgaatggcgaatggcgcctgatgcggtattttctcatacgcatctgtg
                     cggtatttcacaccgcatatggtgcactctcagtacaatctgctctgatgccgcatagttaagc
                     cagccccgacacccgccaacacccgctgacgcgccctgacgggcttgtctgctcccggcatccg
                     cttacagacaagctgtgaccgtctccgggagctgcatgtgtcagaggttttcaccgtcatcacc
                     gaaacgcgcgagacgaaagggcctcgtgatacgcctatttttataggttaatgtcatgataata
                     atggtttcttagacgtcaggtggcacttttcggggaaatgtgcgcggaacccctatttgtttat
                     ttttctaaatacattcaaatatgtatccgctcatgagacaataaccctgataaatgcttcaata
                     atattgaaaaaggaagagtatgagtattcaacatttccgtgtcgcccttattccctttttgcg
                     gcattttgccttcctgtttttgctcacccagaaacgctggtgaaagtaaaagatgctgaagatc
                     agttgggtgcacgagtgggttacatcgaactggatctcaacagcggtaagatccttgagagttt
                     tcgccccgaagaacgttttccaatgatgagcacttttaaagttctgctatgtggcgcggtatta
                     tcccgtattgacgccgggcaagagcaactcggtcgccgcatacactattctcagaatgacttgg
                     ttgagtactcaccagtcacagaaaagcatcttacggatggcatgacagtaagagaattatgcag
                     tgctgccataaccatgagtgataacactgcggccaacttacttctgacaacgatcggaggaccg
                     aaggagctaaccgcttttttgcacaacatgggggatcatgtaactcgccttgatcgttgggaac
                     cggagctgaatgaagccataccaaacgacgagcgtgacaccacgatgcctgtagcaatggcaac
                     aacgttgcgcaaactattaactggcgaactacttactctagcttcccggcaacaattaatagac
                     tggatggaggcggataaagttgcaggaccacttctgcgctcggcccttccggctggctggttta
                     ttgctgataaatctggagccggtgagcgtgggtctcgcggtatcattgcagcactggggccaga
                     tggtaagccctcccgtatcgtagttatctacacgacggggagtcaggcaactatggatgaacga
                     aatagacagatcgctgagataggtgcctcactgattaagcattggtaactgtcagaccaagttt
```

```
actcatatatactttagattgatttaaaacttcattttaatttaaaaggatctaggtgaagat
ccttttgataatctcatgaccaaaatcccttaacgtgagttttcgttccactgagcgtcagac
cccgtagaaaagatcaaggatcttcttgagatcctttttttctgcgcgtaatctgctgcttgc
aaacaaaaaaccaccgctaccagcggtggtttgtttgccggatcaagagctaccaactcttt
tccgaaggtaactggcttcagcagagcgcagataccaaatactgtccttctagtgtagccgtag
ttaggccaccacttcaagaactctgtagcaccgcctacatacctcgctctgctaatcctgttac
cagtggctgctgccagtggcgataagtcgtgtcttaccggggtggactcaagacgatagttacc
ggataaggcgcagcggtcgggctgaacggggggttcgtgcacacagcccagctggagcgaacg
acctacacccgaactgagatacctacagcgtgagctatgagaaaggcgccacgcttcccgaaggga
gaaaggcggacaggtatccggtaagcggcagggtcggaacaggagagcgcacgagggagcttcc
aggggaaacgcctggtatctttatagtcctgtcgggtttcgccacctctgacttgagcgtcga
ttttttgtgatgctcgtcagggggcggagcctatgaaaaacgccagcaacgcggccttttac
ggttcctggccttttgctggcctttgctcacatgttcttcctgcgttatcccctgattctgt
ggataaccgtattaccgcctttgagtggagctgataccgctcgccgcagccgaacgaccgagcgc
agcgagtcagtgagcgaggaagcggaagagcgcccaatacgcaaaccgcctctccccgcgcgtt
ggccgattcattaatgcagctggcacgacaggtttcccgactggaaagcgggcagtgagcgcaa
cgcaattaatgtgagttagctcactcattaggcaccccaggctttacactttatgcttccggct
cgtatgttgtgtggaattgtgagcggataacaatttcacacaggaaacagctatgaccatgatt
acgccaagcttttaattaaagataatcacaggggtagagaccttggttatgggctgattggagg
aagaaatggggtgatttggcacttgacagcgcgagagtggttaacacctggtttccctcatttg
ggttctgacatttgataagttgaaagaacaatgcagaattcacatggctaatttggcctcggtt
ccacaacgcactcagcattaaaaaaaaaatacgcaatggcagctcggtcgacgcagcagaagcg
ccgacgtaccgtcgcgttgcccgcccatgcctcgccgaccccctccaccgccatcgtttgccca
ttgtttgtggtagtcgcgcgtgacacaaaaacttgtcctgtcacatgctgaagttacaccaaca
taactactatgggattacgtaatcaaaaatttcacagttttaacaaaaaaaaaatcatacaatc
aacattgggacatcttgcctccccccacaaaacttgcttctgcatcaatcatatataaacatca
tgaaataagcctaaactcacttcttttttttttcatccttcctacttcttctttcatagtaacta
cttttttttttattaccacacttattcattcataccacgctatcggccggccgcatgcggatccg
agctcgcggccgccagtgtgatggatatctgcagcggccgctaaatattgtaataaataggtct
atatacatacactaagcttctaggacgtcattgtagtcttcgaagttgtctgctagtttagttc
tcatgatttcgaaaccaataacgcaatggatgtagcagggatggtggttagtgcgttcctgac
aaacccagagtacgccgcctcaaaccacgtcacattcgcccttttgcttcatccgcatcacttgc
ttgaaggtatccacgtacgagttgtaatacaccttgaagaacggcttcgtctcgacgggtacaa
cgagaattgtattgaattgatcaagaacatgatcttggtgttacagaacatcaagttcttggac
cagactgagaatgcacagatatacaagcgtcatgtgataaaatggatgagatttatccacaat
gaagaaagagtttatgaaagtggtcaaccagaagctaaacaggaagaagcaaacgaagaggt
gaaacaagaagaagaaggtaaataagtattttgtattataaccaaacaaagtaaggaatacag
atttatacaataaattgccatacaagtcacgtgagatatctcatccattcccccaactcccaaga
aaaaaaaaaagtgaaaaaaaaaatcaaaccccaaagatcaacctcccccatcatcatcgtcatcaa
accccagctcaattcgcaatggttagcacaaaaacatacacagaaagggcatcagcacacccc
tccaaggttgcccaacgtttattccgcttaatggagtccaaaaagaccaacctctgcgcctcga
tcgacgtgaccacaaccgccgagttcctttcgctcatcgacaagctcggtcccacatctgtct
cgtcgaagacgcagctcgatatcatctcagacttcagctacggagggcacgattgagccgttgctt
gtgcttgcagagcgccacggggttcttgatattcgaggacaggaagtttgctgatatcggaaaca
ccgtgatgttgcagtacacctcgggggtataccggatcgcggcgtggagtgacatcacgaacgc
gcacggagtgactgggaagggcgtcgttgaagggttgaaacgcggtgcggaggggtagaaaag
gaaaggggcgtgttgatgttggcggagtttgtcgagtaaaggctcgttggcgcatgtgaatata
cccgtgagacgatcgagattgcgaagagtgatcgggagttcgtgattgggttcatcgcgcagcg
ggacatggggggtagagaagaagggtttgattggatcatcatgacgcctggtgtgggggttggat
gataaaggcgatgcgttgggccagcagtataggactgttgatgaggtggttctgactggtaccg
atgtgattattgtcgggagagggttgtttggaaaaggaaagaccctgagttgagggaaagag
atacagggatgctggatggaaggcatacttgaagagaactggtcagttagaataaaatattgtaa
taaataggtctatatacatacactaagcttctaggacgtcattgtagtcttcgaagttgtctgc
tagtttagttctcatgatttcgaaaccaataacgcaatggatgtagcagggatggtggttagt
gcgttcctgacaaacccagagtacgccgcctcaaaccacgtcacattcgcccttttgcttcatcc
gcatcacttgcttgaaggtatccacgtacgagttgtaatacaccttgaagaacggcttcgtctg
c
```

| | | |
|---|---|---|
| SEQ ID NO: 3809 | Rat Dci1p >gi\|12018256\|ref\| NP_072116.1\| delta(3,5)- Delta(2,4)- dienoyl-CoA isomerase, mitochondrial precursor [*Rattus norvegicus*] | MATAMTVSSKLLGLLMQQLRGTRQLYFNVSLRSLSSSAQEAS KRIPEEVSDHNYESIQVTSAQKHVLHVQLNRPEKRNAMNRAF WRELVECFQKISKDSDCRAVVVSGAGKMFTSGIDLMDMASDI LQPPGDDVARIAWYLRDLISRYQKTFTVIEKCPKPVITAIHGGC IGGGVDLISACDIRYCTQDAFFQVKEVDVGLAADVGTLQRLP KVIGNRSLVNELTFTARKMMADEALDSGLVSRVFPDKDVML NAAFALAADISSKSPVAVQGSKINLIYSRDHSVDESLDYMAT WNMSMLQTQDIIKSVQAAMEKKDSKSITFSKL |
| SEQ ID NO: 3810 | Mouse Dci1p >gi\|7949037\|ref\| NP_058052.1\| delta(3,5)- Delta(2,4)- dienoyl-CoA isomerase, mitochondrial precursor [*Mus musculus*] | MATAMTVSSKLRGLLMQQLRGTSQLYFNISLRSLSSSAQEAS KRAPEEVSDHNYESIQVTSAQKHVLHVQLNRPEKRNAMNRA FWRELVECFQKISKDSDCRAVVVSGAGKMFTSGIDLMDMAS ELMQPSGDDAARIAWYLRDLISKYQKTFTVIEKCPKPVIAAIH GGCIGGGVDLVSACDIRYCTQDAFFQIKEVDMGLAADVGTLQ RLPKVIGNQSLVNELTFSARKMMADEALDSGLVSRVFQDKD AMLNAAFALAADISSKSPVAVQGSKINLIYSRDHSVDESLDY MATWNMSMLQTQDIIKSVQAAMEKRDTKSITFSKL |

| SEQ ID NO: 3811 | CtDci1p (putative) >gi\|255732940\| ref\|XP_002551393.1\| hypothetical protein CTRG_05691 [Candida tropicalis MYA-3404] | MTFNPESYKYEFYTVTQIEDGFAHVQYTNPKTLNAFTEQNWK DYGEIFRRLDKEEDIQLILFSSGVEKSFSSGLNLKTAANLFKSE TNSTEEAIKELHEHITGFQYDIGTPARISTPTIGILNGLNLGLAL DIAAAFTIRIAVEGAQFSIAEVNIGITADIGSLQRLPAIINNKSLL FQHALMGDKWGTDEAMKLGFVSTVVPTIEEGIEYAKTLGEKI CSVPAWAIKGTKKHIQDIINGTTVEQGLKDVANWNAKNITLS RGKL |
|---|---|---|
| SEQ ID NO: 3812 | CvDci1p (putative) | MTFDPSTYKYEFFTVSEIQEGFAHVQYTNPKTLNAFSEQNWK DYGSIFARLDAEEDIQVILFSSGVPRSFSSGLNLKTAANLFSSE QQSTAEAIKDLHVHIRDFQSDIGTPARISTPTIAILNGLNLGLAL DMAAAYTIRIAVEGAQFSIAEVNIGITADIGSLQRLPALINNKS LLFQHALLGDKWGPEEAEKLGFVSTVVPSVEAGIEYAKALGA KICEAPAWAIKGTKKHIQDVINGTSVDQGLADVANWNARNIT LSKGKL |
| SEQ ID NO: 3813 | ScDci1p (YOR180c) >gi\|398365593\| ref\|NP_014823.3\| Dci1p [Saccharomyces cerevisiae S288c] | MSSRVCYHINGPFFIIKLIDPKHLNSLTFEDFVYIALLLHKANDI DSVLFTVLQSSGKYFSSGGKFSAVNKLNDGDVTSEVEKVSKL VSAISSPNIFVANAFAIHKKVLVCCLNGPAIGLSASLVALCDIV YSQNDSVFLLFPPFSNLGFVAEVGTSVTLTQKLGINSANEHMIF STPVLFKELIGTIITKNYQLTNTETFNEKVLQDIKQNLEGLYPK SVLGMKELLHSEMKQKLIKAQAMETNGTLPFWASGEPFKRF KQLQEGNRRHKL |

Example 55: Examples of Certain Non-Limiting Embodiments

Listed Hereafter are Non-Limiting Examples of Certain Embodiments of the Technology.

A1. A genetically modified yeast, comprising an active, modified endogenous acyl-CoA oxidase polypeptide or an active, modified endogenous acyl-CoA dehydrogenase polypeptide, which yeast is capable of producing a diacid from a feedstock comprising one or more components from a vegetable oil.

A2. The genetically modified yeast of embodiment A1, wherein the yeast is a genetically modified Candida spp. yeast.

A2.1. The genetically modified yeast of embodiment A2, wherein the Candida spp. yeast is chosen from C. tropicalis and C. viswanathii.

A2.2. The genetically modified yeast of embodiment A1, wherein the Candida spp. yeast is a genetically modified ATCC20336 yeast.

A2.3. The genetically modified yeast of any one of embodiments A2 to A2.2, wherein the endogenous acyl-CoA oxidase polypeptide is a POX4 polypeptide.

A2.4. The genetically modified yeast of embodiment A2.3, wherein the POX4 polypeptide comprises a modified amino acid sequence of SEQ ID NO: 30.

A2.5. The genetically modified yeast of embodiment A2.3 or A2.4, wherein the POX4 polypeptide comprises an amino acid modification at one or more amino acid positions chosen from 88, 90, 96, 98, 99, 100, 102, 103, 302, 309, 310, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504 and 505.

A2.6. The genetically modified yeast of any one of embodiments A2 to A2.2, wherein the endogenous acyl-CoA oxidase polypeptide is a POX5 polypeptide.

A2.7. The genetically modified yeast of embodiment A2.6, wherein the POX5 polypeptide comprises a modified amino acid sequence of SEQ ID NO: 32.

A2.8. The genetically modified yeast of embodiment A2.6 or A2.7, wherein the POX5 polypeptide comprises an amino acid modification at one or more amino acid positions chosen from 81, 82, 83, 84, 85, 86, 88, 93, 94, 95, 96, 98, 102, 284, 287, 290, 291, 292, 294, 295, 428, 429, 436, 453, 454, 455, 456, 457, 458, 459, 460, 461, 462 and 463.

A2.9. The genetically modified yeast of any one of embodiments A2 to A2.2, wherein the acyl-CoA dehydrogenase polypeptide is chosen from ACAD, VLCAD, LCAD, MCAD and SCAD polypeptides.

A2.10. The genetically modified yeast of embodiment A2.9, wherein the acyl-CoA dehydrogenase polypeptide comprises a modified amino acid sequence of SEQ ID NO: 3685.

A2.11. The genetically modified yeast of embodiment A2.9 or A2.10, wherein the acyl-CoA dehydrogenase polypeptide comprises an amino acid modification at VLCAD position 461.

A2.12. The genetically modified yeast of any one of embodiments 2.5, 2.8 and 2.11, wherein at least one of the amino acid modifications is an amino acid substitution.

A2.13. The genetically modified yeast of embodiment A2.12, wherein at least one of the one or more amino acid substitutions is conservative.

A2.14. The genetically modified yeast of embodiment A2.12, wherein at least one of the one or more amino acid substitutions is not conservative.

A3. The genetically modified yeast of embodiment A1, wherein the yeast is a genetically modified Yarrowia spp. yeast.

A3.1. The genetically modified yeast of embodiment A3.1, wherein the Yarrowia spp. yeast is Y. lipolytica.

A3.2. The genetically modified yeast of embodiment A3 or A3.1, wherein the endogenous acyl-CoA oxidase polypeptide is chosen from a POX1 polypeptide, POX2 polypeptide, POX3 polypeptide, POX4 polypeptide, POX5 polypeptide or POX6 polypeptide.

A3.3. The genetically modified yeast of embodiment 3.2, wherein the endogenous acyl-CoA oxidase polypeptide is chosen from SEQ ID NOs: 3778 to 3783.

A4. The genetically modified yeast of embodiment A1, wherein the yeast is a genetically modified *Pichia* spp. yeast.

A4.1. The genetically modified yeast of embodiment A4.1, wherein the *Pichia* spp. yeast is chosen from *P. pastoris, P. membranifaciens, P. kluyveri, P. guilliermondii, P. heedii* and *P. subpelliculosa*.

A5. The genetically modified yeast of embodiment A1, wherein the yeast is a genetically modified *Saccharomyces* spp. yeast.

A5.1. The genetically modified yeast of embodiment A5.1, wherein the *Saccharomyces* spp. yeast is chosen from *S. cerevisiae, S. bayanus, S. pastorianus* and *S. carlsbergensis*.

A6. The genetically modified yeast of embodiment A1, wherein the yeast is a genetically modified *Kluyveromyces* spp. yeast.

A6.1. The genetically modified yeast of embodiment A6.1, wherein the *Kluyveromyces* spp. yeast is chosen from *K. lactis* and *K. marxianus*.

A7. The genetically modified yeast of any one of embodiments A1 to A6.1, wherein the modified endogenous acyl-CoA oxidase polypeptide comprises an amino acid modification in the N-terminal loop.

A8. The genetically modified yeast of any one of embodiments A1 to A7, wherein the modified endogenous acyl-CoA oxidase polypeptide comprises an amino acid modification in the D alpha helix.

A9. The genetically modified yeast of any one of embodiments A1 to A8, wherein the modified endogenous acyl-CoA oxidase polypeptide comprises an amino acid modification in the loop between the D alpha helix and the E' alpha helix.

A10. The genetically modified yeast of any one of embodiments A1 to A9, wherein the modified endogenous acyl-CoA oxidase polypeptide comprises an amino acid modification to an amino acid in effective contact with carbons 6 to 9 in a feedstock component.

A11. The genetically modified yeast of any one of embodiments A1 to A10, wherein the modified endogenous acyl-CoA oxidase polypeptide comprises an amino acid modification to an amino acid in effective contact with carbons 10 to 12 in a feedstock component.

A12. The genetically modified yeast of any one of embodiments A1 to A11, wherein the modified endogenous acyl-CoA oxidase polypeptide comprises an amino acid modification in the L alpha helix.

A13. The genetically modified yeast of any one of embodiments A1 to A12, wherein the modified endogenous acyl-CoA oxidase polypeptide comprises an amino acid modification in the loop C-terminal to the L alpha helix.

A14. The genetically modified yeast of any one of embodiments A1 to A13, wherein the modified endogenous acyl-CoA oxidase polypeptide comprises an amino acid modification in the loop between the L alpha helix and the M alpha helix.

A15. The genetically modified yeast of any one of embodiments A7 to A14, wherein the amino acid modification comprises an amino acid substitution.

A16. The genetically modified yeast of embodiment A15, wherein the amino acid substitution is conservative.

A17. The genetically modified yeast of embodiment A15, wherein the amino acid substitution is not conservative.

A17.1. A genetically modified yeast comprising (i) an active, modified endogenous acyl-CoA oxidase polypeptide or an active, modified endogenous acyl-CoA dehydrogenase polypeptide and (ii) a genetic modification that alters an enoyl CoA isomerase activity, wherein the yeast is capable of producing a diacid from a feedstock comprising one or more components from a vegetable oil.

A18. The genetically modified yeast of any one of embodiments A1 to A17.1, which comprises a genetic modification that reduces an enoyl CoA isomerase activity.

A18.1 The genetically modified yeast of embodiment A18, which comprises a disruption, deletion or knockout of (i) a polynucleotide that encodes an enoyl CoA isomerase polypeptide or (ii) a promoter operably linked to a polynucleotide that encodes an enoyl CoA isomerase polypeptide, whereby the enoyl CoA isomerase activity is reduced or removed.

A19. The genetically modified yeast of embodiment A18.1, wherein the genetic modification disrupts a polynucleotide that encodes an enoyl CoA isomerase polypeptide.

A19.1. The genetically modified yeast of any one of embodiments A1 to A19, which comprises a genetic modification that increases an enoyl CoA isomerase activity.

A19.2. The genetically modified yeast of embodiment A19.1, which comprises (i) an increased copy number of a polynucleotide that encodes an enoyl CoA isomerase polypeptide or (ii) a promoter inserted and operably linked to a polynucleotide that encodes an enoyl CoA isomerase polypeptide.

A20. The genetically modified yeast of any one of embodiments A18.1, A18.2 and A19.2, wherein the enoyl CoA isomerase polypeptide is a polypeptide native to the yeast.

A20.1. The genetically modified yeast of any one of embodiments M7.1 to A20, wherein the activity of one or more or all enoyl CoA isomerase polypeptide types in the yeast is altered.

A20.2. The genetically modified yeast of embodiment A20.1, wherein the yeast comprises two enoyl CoA isomerase polypeptide types, and one or both of the polypeptide types are altered.

A21. The genetically modified yeast of any one of embodiments A17.1 to A20, wherein the enoyl CoA isomerase activity is provided by a polypeptide present in a *Candida* spp. yeast.

A22. The genetically modified yeast of any one of embodiments A17.1 to A21, wherein the enoyl CoA isomerase activity is provided by a polypeptide comprising the amino acid sequence of SEQ ID NO: 3675, 3677, 3800, 3802, 3803 or 3805.

A22.1 The genetically modified yeast of any one of embodiments A17.1 to A21, wherein the yeast is a *Yarrowia* yeast.

A22.2. The genetically modified yeast of embodiment A22.1, wherein the yeast is a *Y. lipolytica* yeast.

A22.3. The genetically modified yeast of any one of embodiments A22.2, wherein the enoyl CoA isomerase activity is provided by a polypeptide present in a *Yarrowia* yeast or a *Y. lipolytica* yeast.

A22.4. The genetically modified yeast of embodiment A22.2, wherein the enoyl CoA isomerase activity is provided by a polypeptide comprising the amino acid sequence of SEQ ID NO: 3804 or 3806.

A23. The genetically modified yeast of any one of embodiments A1 to A22.4, which comprises a genetic modification that reduces the cytoplasmic activity of an acyl-CoA synthetase (ACS) polypeptide.

A24. The genetically modified yeast of any one of embodiments A1 to A23, which comprises a genetic modification that reduces the peroxisomal activity of an acyl-CoA synthetase (ACS) polypeptide.

A25. The genetically modified yeast of embodiment A23 or A24, wherein the genetic modification disrupts a polynucleotide that encodes the acyl-CoA synthetase (ACS) polypeptide.

A26. The genetically modified yeast of embodiment A25, wherein the genetic modification disrupts an ACS1 polypeptide or ACS2 polypeptide.

A27. The genetically modified yeast of any one of embodiments A23 to A26, wherein the genetic modification disrupts a polynucleotide that encodes a long-chain acyl-CoA synthetase polypeptide.

A28. The genetically modified yeast of embodiment A27, wherein the genetic modification disrupts a FAT1 polypeptide.

A29. The genetically modified yeast of any one of embodiments A23 to A28, wherein the acyl-CoA synthetase (ACS) polypeptide is a polypeptide native to the yeast.

A30. The genetically modified yeast of embodiment A29, wherein the yeast is a *Candida* spp. yeast.

A31. The genetically modified yeast of embodiment A30, wherein the acyl-CoA synthetase (ACS) polypeptide comprises an amino acid sequence chosen from SEQ ID NOs: 80, 82, 84, 158 and 159.

A32. The genetically modified yeast of embodiment A30, wherein the FAT1 polypeptide comprises the amino acid sequence of SEQ ID NO: 90.

A33. The genetically modified yeast of any one of embodiments A1 to A32, which comprises a genetic modification that reduces the activity of a PXA polypeptide.

A34. The genetically modified yeast of embodiment A33, wherein the genetic modification disrupts a polynucleotide that encodes the PXA polypeptide.

A35. The genetically modified yeast of embodiment A33 or A34, wherein the PXA polypeptide is a PXA1 polypeptide or a PXA2 polypeptide, or a PXA1 polypeptide and a PXA2 polypeptide.

A36. The genetically modified yeast of any one of embodiments A33 to A35, wherein the PXA polypeptide is native to the yeast.

A37. The genetically modified yeast of embodiment A36, wherein the yeast is a *Candida* spp. yeast.

A38. The genetically modified yeast of embodiment A37, wherein the PXA1 polypeptide comprises the amino acid sequence of SEQ ID NO: 92.

A39. The genetically modified yeast of embodiment A37, wherein the PXA2 polypeptide comprises the amino acid sequence of SEQ ID NO: 94.

A40. The genetically modified yeast of any one of embodiments A1 to A39, comprising an active, modified endogenous acyl-CoA oxidase polypeptide and no active, modified endogenous acyl-CoA dehydrogenase polypeptide.

A41. The genetically modified yeast of any one of embodiments A1 to A39, comprising no active, modified endogenous acyl-CoA oxidase polypeptide and an active, modified endogenous acyl-CoA dehydrogenase polypeptide.

A42. A method for producing a diacid, comprising:
(1) contacting a genetically modified yeast of any of embodiments A1 to A41 with a feedstock comprising one or more components from a feedstock containing at least one unsaturated vegetable fatty acid capable of being converted by the yeast to a diacid;
(2) culturing the yeast under conditions in which the diacid is produced from the feedstock; and
(3) hydrogenating the diacid to remove any unsaturation in the carbon chain.

A43. The method of A42, wherein the unsaturated vegetable fatty acid is linoleic acid or linolenic acid.

A44. The method of A43, wherein the diacid is dodecanedioic acid or sebacic acid.

B1. A genetically modified yeast, comprising a heterologous acyl-CoA oxidase polypeptide or a heterologous acyl-CoA dehydrogenase polypeptide, which yeast is capable of producing a diacid from a feedstock comprising one or more components from a vegetable oil.

B2. The genetically modified yeast of embodiment B1, wherein the heterologous acyl-CoA oxidase polypeptide is a native polypeptide.

B3. The genetically modified yeast of embodiment B1, wherein the heterologous acyl-CoA oxidase polypeptide is an active, modified polypeptide.

B4. The genetically modified yeast of embodiment B1, wherein the heterologous acyl-CoA dehydrogenase polypeptide is a native polypeptide.

B5. The genetically modified yeast of embodiment B1, wherein the heterologous acyl-CoA dehydrogenase polypeptide is an active, modified polypeptide.

B6. The genetically modified yeast of embodiment B1 or B2, wherein the heterologous acyl-CoA oxidase polypeptide is chosen from a polypeptide having an amino acid sequence set forth in SEQ ID NO: 51 to SEQ ID NO: 3673.

B7. The genetically modified yeast of embodiment B1 or B4, wherein the heterologous acyl-CoA dehydrogenase polypeptide is chosen from SEQ ID NOs: 3679 to 3683, 3686, 3689, 3691, 3693, 3695, 3697, 3699, 3701 and 3703.

B8. The genetically modified yeast of any one of embodiments B1 to B7, which is chosen from a *Candida* spp. yeast, *Yarrowia* spp. yeast, *Pichia* spp. yeast, *Saccharomyces* spp. yeast and *Kluyveromyces* spp. yeast.

B9. The genetically modified yeast of embodiment B8, which is chosen from *C. tropicalis, C. viswanathii, Y. lipolytica, P. pastoris, P. membranifaciens, P. kluyveri, P. guilliermondii, P. heedii, P. subpelliculosa, S. cerevisiae, S. bayanus, S. pastorianus, S. carlsbergensis, K. lactis* and *K. marxianus*.

B10. The genetically modified yeast of any one of embodiments B1 to B9, which comprises a genetic modification that reduces the activity of an enoyl CoA isomerase polypeptide.

B11. The genetically modified yeast of embodiment B10, wherein the genetic modification disrupts a polynucleotide that encodes the enoyl CoA isomerase polypeptide.

B12. The genetically modified yeast of embodiment B10 or B11, wherein the enoyl CoA isomerase polypeptide is a polypeptide native to the yeast.

B13. The genetically modified yeast of embodiment B12, wherein the yeast is a *Candida* spp. yeast.

B14. The genetically modified yeast of embodiment B13, wherein the enoyl CoA isomerase polypeptide comprises the amino acid sequence of SEQ ID NO: 3675 or 3677.

B15. The genetically modified yeast of any one of embodiments B1 to B14, which comprises a genetic modification that reduces the cytoplasmic activity of an acyl-CoA synthetase (ACS) polypeptide.

B16. The genetically modified yeast of any one of embodiments B1 to B15, which comprises a genetic modification that reduces the peroxisomal activity of an acyl-CoA synthetase (ACS) polypeptide.

B17. The genetically modified yeast of embodiment B15 or B16, wherein the genetic modification disrupts a polynucleotide that encodes the acyl-CoA synthetase (ACS) polypeptide.

B18. The genetically modified yeast of embodiment B17, wherein the genetic modification disrupts an ACS1 polypeptide or ACS2 polypeptide.

B19. The genetically modified yeast of any one of embodiments B15 to B18, wherein the genetic modification disrupts a polynucleotide that encodes a long-chain acyl-CoA synthetase polypeptide.

B20. The genetically modified yeast of embodiment B19, wherein the genetic modification disrupts a FAT1 polypeptide.

B21. The genetically modified yeast of any one of embodiments B15 to B20, wherein the acyl-CoA synthetase (ACS) polypeptide is a polypeptide native to the yeast.

B22. The genetically modified yeast of embodiment B21, wherein the yeast is a *Candida* spp. yeast.

B23. The genetically modified yeast of embodiment B22, wherein the acyl-CoA synthetase (ACS) polypeptide comprises an amino acid sequence chosen from SEQ ID NOs: 80, 82, 84, 158 and 159.

B24. The genetically modified yeast of embodiment B21, wherein the FAT1 polypeptide comprises the amino acid sequence of SEQ ID NO: 90.

B25. The genetically modified yeast of any one of embodiments B1 to B24, which comprises a genetic modification that reduces the activity of a PXA polypeptide.

B26. The genetically modified yeast of embodiment B25, wherein the genetic modification disrupts a polynucleotide that encodes the PXA polypeptide.

B27. The genetically modified yeast of embodiment B25 or B26, wherein the PXA polypeptide is a PXA1 polypeptide or a PXA2 polypeptide, or a PXA1 polypeptide and a PXA2 polypeptide.

B28. The genetically modified yeast of any one of embodiments B25 to B27, wherein the PXA polypeptide is native to the yeast.

B29. The genetically modified yeast of embodiment B28, wherein the yeast is a *Candida* spp. yeast.

B30. The genetically modified yeast of embodiment B29, wherein the PXA1 polypeptide comprises the amino acid sequence of SEQ ID NO: 92.

B31. The genetically modified yeast of embodiment B29, wherein the PXA2 polypeptide comprises the amino acid sequence of SEQ ID NO: 94.

B32. The genetically modified yeast of any one of embodiments B1 to B31, comprising an active, modified endogenous acyl-CoA oxidase polypeptide and no active, modified endogenous acyl-CoA dehydrogenase polypeptide.

B33. The genetically modified yeast of any one of embodiments B1 to B31, comprising no active, modified endogenous acyl-CoA oxidase polypeptide and an active, modified endogenous acyl-CoA dehydrogenase polypeptide.

C1. The genetically modified yeast of any one of embodiments A1 to A41 and B1 to B33, comprising one or more genetic modifications that reduce the activity of one or more native endogenous acyl-CoA oxidase polypeptides.

C2. The genetically modified yeast of embodiment C1, comprising genetic modifications that reduce the activity of all native endogenous acyl-CoA oxidase polypeptides.

C3. The genetically modified yeast of embodiment C1 or C2, wherein the genetic modifications partially block beta oxidation activity.

C4. The genetically modified yeast of any one of embodiments A1 to A41, B1 to B33, and C1 to C3, wherein the diacid is a C4 to C24 diacid.

C5. The genetically modified yeast of embodiment C4, wherein the diacid is a C10, C12, C14, C16, C18 or C20 diacid.

C6. The genetically modified yeast of embodiment C5, wherein the diacid is a C10 diacid.

C7. The genetically modified yeast of embodiment C5, wherein the diacid is a C12 diacid.

C8. The genetically modified yeast of embodiment C5, wherein the diacid is a C18 diacid.

C9. The genetically modified yeast of any one of embodiments C4 to C8, wherein the diacid contains no unsaturation.

C10. The genetically modified yeast of any one of embodiments C4 to C8, wherein the diacid contains one or more unsaturations.

C10.1. The genetically modified yeast of any one of embodiments C4 to C10, wherein the diacid is the predominant diacid in a mixture of diacids.

C11. The genetically modified yeast of any one of embodiments A1 to A41, B1 to B33, and C1 to C10.1, wherein the feedstock comprises a substantially pure oil.

C12. The genetically modified yeast of any one of embodiments A1 to A41, B1 to B33, and C1 to C10, wherein the feedstock comprises a plurality of fatty acids.

C13. The genetically modified yeast of embodiment C12, wherein the feedstock comprises a soapstock.

C14. The genetically modified yeast of embodiment C12, wherein the feedstock comprises a fatty acid distillate.

C15. The genetically modified yeast of any one of embodiments A1 to A41, B1 to B33, and C1 to C14, wherein the vegetable oil is from a plant chosen from palm, palm kernel, coconut, soy, safflower, canola, palm, palm kernel or combination thereof.

D1. A method for producing a diacid, comprising:
contacting a genetically modified yeast of any one of embodiments 1 to A41, B1 to B33, and C1 to C15 with a feedstock comprising one or more components from a vegetable oil capable of being converted by the yeast to a diacid; and
culturing the yeast under conditions in which the diacid is produced from the feedstock.

D2. The method of embodiment D1, wherein the diacid is a C4 to C24 diacid.

D3. The method of embodiment D2, wherein the diacid is a C10, C12, C14, C16, C18 or C20 diacid.

D4. The method of embodiment D3, wherein the diacid is a C10 diacid.

D5. The method of embodiment D3, wherein the diacid is a C12 diacid.

D6. The method of embodiment D3, wherein the diacid is a C18 diacid.

D7. The method of any one of embodiments D1 to D6, wherein the diacid contains no unsaturation.

D8. The method of any one of embodiments D1 to D6, wherein the diacid contains one or more unsaturations.

D8.1. The method of any one of embodiments D2 to D8, wherein the diacid is the predominant diacid in a mixture of diacids.

D9. The method of any one of embodiments D1 to D8.1, wherein the feedstock comprises a substantially pure oil.

D10. The method of any one of embodiments D1 to D8, wherein the feedstock comprises a plurality of fatty acids.

D11. The method of embodiment D10, wherein the feedstock comprises a soapstock.

D12. The method of embodiment D10, wherein the feedstock comprises a fatty acid distillate.

D13. The method of any one of embodiments D1 to D12, wherein the vegetable oil is from a plant chosen from palm, palm kernel, coconut, soy, safflower, canola, palm, palm kernel or combination thereof.

E1. An isolated nucleic acid, comprising a polynucleotide that encodes a modified acyl-CoA oxidase polypeptide from a yeast.

E2. The isolated nucleic acid of embodiment E1, wherein the modified acyl-CoA oxidase polypeptide comprises an amino acid modification in the N-terminal loop.

E3. The isolated nucleic acid of embodiment E1, wherein the modified endogenous acyl-CoA oxidase polypeptide comprises an amino acid modification in the D alpha helix.

E4. The isolated nucleic acid of embodiment E1, wherein the modified endogenous acyl-CoA oxidase polypeptide comprises an amino acid modification in the loop between the D alpha helix and the E' alpha helix.

E5. The isolated nucleic acid of embodiment E1, wherein the modified endogenous acyl-CoA oxidase polypeptide comprises an amino acid modification to an amino acid in effective contact with carbons 6 to 9 in a feedstock component.

E6. The isolated nucleic acid of embodiment E1, wherein the modified endogenous acyl-CoA oxidase polypeptide comprises an amino acid modification to an amino acid in effective contact with carbons 10 to 12 in a feedstock component.

E7. The isolated nucleic acid of embodiment E1, wherein the modified endogenous acyl-CoA oxidase polypeptide comprises an amino acid modification in the L alpha helix.

E8. The isolated nucleic acid of embodiment E1, wherein the modified endogenous acyl-CoA oxidase polypeptide comprises an amino acid modification in the loop C-terminal to the L alpha helix.

E9. The isolated nucleic acid of embodiment E1, wherein the modified endogenous acyl-CoA oxidase polypeptide comprises an amino acid modification in the loop between the L alpha helix and the M alpha helix.

E10. The isolated nucleic acid of any one of embodiments E2 to E9, wherein the amino acid modification comprises an amino acid substitution.

E11. The isolated nucleic acid of embodiment E10, wherein the amino acid substitution is conservative.

E12. The isolated nucleic acid of embodiment E10, wherein the amino acid substitution is not conservative.

E13. The isolated nucleic acid of any one of embodiments E1 to E12, wherein the yeast is chosen from a *Candida* spp. yeast, *Yarrowia* spp. yeast, *Pichia* spp. yeast, *Saccharomyces* spp. yeast and *Kluyveromyces* spp. yeast.

E14. The isolated nucleic acid of embodiment E13, wherein the yeast is chosen from *C. tropicalis*, *C. viswanathii*, *Y. lipolytica*, *P. pastoris*, *P. membranifaciens*, *P. kluyveri*, *P. guilliermondii*, *P. heedii*, *P. subpelliculosa*, *S. cerevisiae*, *S. bayanus*, *S. pastorianus*, *S. carlsbergensis*, *K. lactis* and *K. marxianus*.

E15. The isolated nucleic acid of embodiment E13, wherein the yeast is a *Candida* spp. yeast.

E16. The isolated nucleic acid of embodiment E15, wherein the yeast is chosen from *C. tropicalis* and *C. viswanathii*.

E17. The isolated nucleic acid of embodiment E16, wherein the yeast is a genetically modified ATCC20336 yeast.

E18. The isolated nucleic acid of any one of embodiments E15 to E17, wherein the endogenous acyl-CoA oxidase polypeptide is a POX4 polypeptide.

E19. The isolated nucleic acid of embodiment E18, wherein the POX4 polypeptide comprises a modified amino acid sequence of SEQ ID NO: 30.

E20. The isolated nucleic acid of embodiment E18 or E19, wherein the POX4 polypeptide comprises amino acid modifications at one or more amino acid positions chosen from 88, 90, 96, 98, 99, 100, 102, 103, 302, 309, 310, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504 and 505.

E21. The isolated nucleic acid of any one of embodiments E15 to E17, wherein the endogenous acyl-CoA oxidase polypeptide is a POX5 polypeptide.

E22. The isolated nucleic acid of embodiment E21, wherein the POX5 polypeptide comprises a modified amino acid sequence of SEQ ID NO: 32.

E23. The isolated nucleic acid of embodiment E21 or E22, wherein the POX5 polypeptide comprises amino acid modifications at one or more amino acid positions chosen from 81, 82, 83, 84, 85, 86, 88, 93, 94, 95, 96, 98, 102, 284, 287, 290, 291, 292, 294, 295, 436, 453, 454, 455, 456, 457, 458, 459, 460, 461, 462 and 463.

E24. The isolated nucleic acid of embodiment E20 or E23, wherein at least one of the amino acid modifications is an amino acid substitution.

E25. The isolated nucleic acid of embodiment E24, wherein at least one of the amino acid substitutions is conservative.

E26. The isolated nucleic acid of embodiment E24, wherein at least one of the amino acid substitutions is non-conservative.

F1. The isolated nucleic acid of any one of embodiments E1 to E26, which is an expression vector.

F2. A cell comprising a nucleic acid of any one of embodiments E1 to F1.

F3. The cell of embodiment F2, which is a bacterium.

F4. The cell of embodiment F2, which is a yeast.

F5. The cell of embodiment F4, which is a *Candida* spp. yeast.

F6. The cell of embodiment F5, wherein the *Candida* spp. yeast is chosen from *C. tropicalis* and *C. viswanathii*.

F7. The cell of embodiment F6, wherein the *Candida* spp. yeast is a genetically modified ATCC20336 yeast.

F8. The cell of embodiment F4, which is chosen from a *Yarrowia* spp. yeast, *Pichia* spp. yeast, *Saccharomyces* spp. yeast and *Kluyveromyces* spp. yeast.

F9. The cell of embodiment F8, which is chosen from *Y. lipolytica*, *P. pastoris*, *P. membranifaciens*, *P. kluyveri*, *P. guilliermondii*, *P. heedii*, *P. subpelliculosa*, *S. cerevisiae*, *S. bayanus*, *S. pastorianus*, *S. carlsbergensis*, *K. lactis* and *K. marxianus*.

G1. A genetically modified yeast comprising (i) an active, modified endogenous acyl-coA oxidase polypeptide or an active, modified endogenous acyl-coA dehydrogenase polypeptide; (ii) a genetic modification that alters an enoyl co-A isomerase activity; and (iii) a genetic modification that alters a dieneoyl CoA reductase (DCR) activity, wherein the yeast is capable of producing a diacid from a feedstock comprising one or more components from a vegetable oil.

G2. The genetically modified yeast of embodiment G1, wherein the feedstock comprises at least one long chain unsaturated fatty acid.

G3. The genetically modified yeast of embodiment G2, wherein the long chain unsaturated fatty acid is linoleic acid or linolenic acid.

G4. The genetically modified yeast of any one of embodiments G1 to G3, which comprises a genetic modification that reduces an enoyl CoA isomerase activity.

G5. The genetically modified yeast of embodiment G4, which comprises a disruption, deletion or knockout of (i) a polynucleotide that encodes an enoyl CoA isomerase polypeptide or (ii) a promoter operably linked to a polynucleotide that encodes an enoyl CoA isomerase polypeptide, whereby the enoyl CoA isomerase activity is reduced or removed.

G6. The genetically modified yeast of embodiment G5, wherein the genetic modification disrupts a polynucleotide that encodes an enoyl CoA isomerase polypeptide.

G7. The genetically modified yeast of any one of embodiments G1 to G6, which comprises a genetic modification that increases an enoyl CoA isomerase activity.

G8. The genetically modified yeast of embodiment G7, which comprises (i) an increased copy number of a polynucleotide that encodes an enoyl CoA isomerase polypeptide or (ii) a promoter inserted and operably linked to a polynucleotide that encodes an enoyl CoA isomerase polypeptide.

G9. The genetically modified yeast of any one of embodiments G5, G6 and G8, wherein the enoyl CoA isomerase polypeptide is a polypeptide native to the yeast.

G10. The genetically modified yeast of any one of embodiments G1 to G9, wherein the activity of one or more or all enoyl CoA isomerase polypeptide types in the yeast is altered.

G11. The genetically modified yeast of embodiment G10, wherein the yeast comprises two enoyl CoA isomerase polypeptide types, and one or both of the polypeptide types are altered.

G12. The genetically modified yeast of any one of embodiments G1 to G11, wherein the enoyl CoA isomerase activity is provided by polypeptide present in a *Candida* spp. yeast.

G13. The genetically modified yeast of any one of embodiments G1 to G12, wherein the enoyl CoA isomerase activity is provided by a polypeptide comprising the amino acid sequence of SEQ ID NO: 3675, 3677, 3800, 3802, 3803 or 3805.

G14. The genetically modified yeast of any one of embodiments G1 to G11, wherein the enoyl CoA isomerase activity is provided by a polypeptide present in a *Yarrowia* yeast.

G15. The genetically modified yeast of embodiment G14, wherein the *Yarrowia* yeast is a *Y. lipolytica* yeast.

G16. The genetically modified yeast of any one of embodiments G1 to G15, wherein the enoyl CoA isomerase activity is provided by a polypeptide comprising the amino acid sequence of SEQ ID NO: 3804 or 3806.

G17. The genetically modified yeast of any one of embodiments G1 to G16, which comprises a genetic modification that reduces a dieneoyl CoA reductase activity.

G18. The genetically modified yeast of embodiment G17, which comprises a disruption, deletion or knockout of (i) a polynucleotide that encodes a dieneoyl CoA reductase polypeptide or (ii) a promoter operably linked to a polynucleotide that encodes a dieneoyl CoA reductase polypeptide, whereby the dieneoyl CoA reductase activity is reduced or removed.

G19. The genetically modified yeast of embodiment G18, wherein the genetic modification disrupts a polynucleotide that encodes a dieneoyl CoA reductase polypeptide.

G20. The genetically modified yeast of any one of embodiments G1 to G19, which comprises a genetic modification that increases a dieneoyl CoA reductase activity.

G21. The genetically modified yeast of embodiment G20, which comprises (i) an increased copy number of a polynucleotide that encodes a dieneoyl CoA reductase polypeptide or (ii) a promoter inserted and operably linked to a polynucleotide that encodes a dieneoyl CoA reductase polypeptide.

G22. The genetically modified yeast of any one of embodiments G18, G19 and G21, wherein the dieneoyl CoA reductase polypeptide is a polypeptide native to the yeast.

G23. The genetically modified yeast of any one of embodiments G1 to G22, wherein the activity of one or more or all dieneoyl CoA reductase polypeptide types in the yeast is altered.

G24. The genetically modified yeast of embodiment G23, wherein the yeast comprises two dieneoyl CoA reductase polypeptide types, and one or both of the polypeptide types are altered.

G25. The genetically modified yeast of any one of embodiments G1 to G24, wherein the dieneoyl CoA reductase activity is provided by a polypeptide present is a *Candida* spp. yeast.

G26. The genetically modified yeast of any one of embodiments G1 to G25, wherein the dieneoyl CoA reductase activity is provided by a polypeptide comprising the amino acid sequence of SEQ ID NO: 3789, 3791, 3792 or 3793.

G27. The genetically modified yeast of any one of embodiments G1 to G26, wherein the dieneoyl CoA reductase activity is provided by a polypeptide present in a *Yarrowia* yeast.

G28. The genetically modified yeast of embodiment G27, wherein the *Yarrowia* yeast is a *Y. lipolytica* yeast.

G29. The genetically modified yeast of any one of embodiments G1 to G28, wherein the dieneoyl CoA reductase activity is provided by a polypeptide comprising the amino acid sequence of SEQ ID NO: 3794 or 3795.

G30. The genetically modified yeast of any one of embodiments G1 to G29, wherein the yeast is a genetically modified *Candida* spp. yeast.

G31. The genetically modified yeast of embodiment G30, wherein the *Candida* spp. yeast is chosen from *C. tropicalis* and *C. viswanathii*.

G32. The genetically modified yeast of embodiment G30, wherein the *Candida* spp. yeast is a genetically modified ATCC20336 yeast.

G33. The genetically modified yeast of any one of embodiments G30 to G32, wherein the endogenous acyl-CoA oxidase polypeptide is a POX4 polypeptide.

G34. The genetically modified yeast of embodiment G33, wherein the POX4 polypeptide comprises a modified amino acid sequence of SEQ ID NO: 30.

G35. The genetically modified yeast of embodiment G33 or G34, wherein the POX4 polypeptide comprises an amino acid modification at one or more amino acid positions chosen from 88, 90, 96, 98, 99, 100, 102, 103, 302, 309, 310, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504 and 505.

G36. The genetically modified yeast of any one of embodiments G30 to G35, wherein the endogenous acyl-CoA oxidase polypeptide is a POX5 polypeptide.

G37. The genetically modified yeast of embodiment G36, wherein the POX5 polypeptide comprises a modified amino acid sequence of SEQ ID NO: 32.

G38. The genetically modified yeast of embodiment G36 or G37, wherein the POX5 polypeptide comprises an amino acid modification at one or more amino acid positions chosen from 81, 82, 83, 84, 85, 86, 88, 93, 94, 95, 96, 98, 102, 284, 287, 290, 291, 292, 294, 295, 428, 429, 436, 453, 454, 455, 456, 457, 458, 459, 460, 461, 462 and 463.

G39. The genetically modified yeast of any one of embodiments G1 to G38, wherein the acyl-CoA dehydrogenase polypeptide is chosen from ACAD, VLCAD, LCAD, MCAD and SCAD polypeptides.

G40. The genetically modified yeast of embodiment G39, wherein the acyl-CoA dehydrogenase polypeptide comprises a modified amino acid sequence of SEQ ID NO: 3685.

G41. The genetically modified yeast of embodiment G39 or G40, wherein the acyl-CoA dehydrogenase polypeptide comprises an amino acid modification at VLCAD position 461.

G42. The genetically modified yeast of any one of embodiments G35, G38 and G41, wherein at least one of the amino acid modifications is an amino acid substitution.

G43. The genetically modified yeast of embodiment G42, wherein at least one of the one or more amino acid substitutions is conservative.

G44. The genetically modified yeast of embodiment G42, wherein at least one of the one or more amino acid substitutions is not conservative.

G45. The genetically modified yeast of any one of embodiments G1 to G29, wherein the yeast is a genetically modified *Yarrowia* spp. yeast.

G46. The genetically modified yeast of embodiment G42, wherein the *Yarrowia* spp. yeast is *Y. lipolytica*.

G47. The genetically modified yeast of embodiment G45 or G46, wherein the endogenous acyl-CoA oxidase polypeptide is chosen from a POX1 polypeptide, POX2 polypeptide, POX3 polypeptide, POX4 polypeptide, POX5 polypeptide or POX6 polypeptide.

G48. The genetically modified yeast of embodiment G47, wherein the endogenous acyl-CoA oxidase polypeptide is chosen from SEQ ID NOs: 3778 to 3783.

G49. The genetically modified yeast of any one of embodiments G1 to G29, wherein the yeast is a genetically modified *Pichia* spp. yeast.

G50. The genetically modified yeast of embodiment G49, wherein the *Pichia* spp. yeast is chosen from *P. pastoris, P. membranifaciens, P. kluyveri, P. guilliermondii, P. heedii* and *P. subpelliculosa*.

G51. The genetically modified yeast of embodiment G1 to G29, wherein the yeast is a genetically modified *Saccharomyces* spp. yeast.

G52. The genetically modified yeast of embodiment G51, wherein the *Saccharomyces* spp. yeast is chosen from *S. cerevisiae, S. bayanus, S. pastorianus* and *S. carlsbergensis*.

G53. The genetically modified yeast of embodiment G1 to G29, wherein the yeast is a genetically modified *Kluyveromyces* spp. yeast.

G54. The genetically modified yeast of embodiment G53, wherein the *Kluyveromyces* spp. yeast is chosen from *K. lactis* and *K. marxianus*.

G55. The genetically modified yeast of any one of embodiments G1 to G54, wherein the modified endogenous acyl-CoA oxidase polypeptide comprises an amino acid modification in the N-terminal loop.

G56. The genetically modified yeast of any one of embodiments G1 to G55, wherein the modified endogenous acyl-CoA oxidase polypeptide comprises an amino acid modification in the D alpha helix.

G57. The genetically modified yeast of any one of embodiments G1 to G56, wherein the modified endogenous acyl-CoA oxidase polypeptide comprises an amino acid modification in the loop between the D alpha helix and the E' alpha helix.

G58. The genetically modified yeast of any one of embodiments G1 to G57, wherein the modified endogenous acyl-CoA oxidase polypeptide comprises an amino acid modification to an amino acid in effective contact with carbons 6 to 9 in a feedstock component.

G59. The genetically modified yeast of any one of embodiments G1 to G58, wherein the modified endogenous acyl-CoA oxidase polypeptide comprises an amino acid modification to an amino acid in effective contact with carbons 10 to 12 in a feedstock component.

G60. The genetically modified yeast of any one of embodiments G1 to G59, wherein the modified endogenous acyl-CoA oxidase polypeptide comprises an amino acid modification in the L alpha helix.

G61. The genetically modified yeast of any one of embodiments G1 to G60, wherein the modified endogenous acyl-CoA oxidase polypeptide comprises an amino acid modification in the loop C-terminal to the L alpha helix.

G62. The genetically modified yeast of any one of embodiments G1 to G61, wherein the modified endogenous acyl-CoA oxidase polypeptide comprises an amino acid modification in the loop between the L alpha helix and the M alpha helix.

G63. The genetically modified yeast of any one of embodiments G55 to G62, wherein the amino acid modification comprises an amino acid substitution.

G64. The genetically modified yeast of embodiment G63, wherein the amino acid substitution is conservative.

G65. The genetically modified yeast of embodiment G63, wherein the amino acid substitution is not conservative.

G66. A method for producing a diacid, comprising:
(a) contacting a genetically modified yeast of any one of embodiments G1 to G65 with a feedstock comprising a vegetable oil; and
(b) culturing the yeast under conditions in which diacid is produced from the feedstock.

G67. The method of embodiment G66, comprising purifying the diacid from the yeast.

H1. A method for producing a diacid, comprising:
(a) contacting a genetically modified yeast of any of embodiments A1 to A44, B1 to B33, C1 to C15 and G1 to G65 with a feedstock comprising an unsaturated vegetable fatty acid capable of being converted by the yeast to a diacid;
(b) culturing the yeast under conditions in which diacid containing one or more unsaturations is produced from the feedstock; and
(c) hydrogenating and removing one or more of the unsaturations.

H2. The method of embodiment H1, wherein the unsaturated vegetable fatty acid is linoleic acid or linolenic acid.

H3. The method of embodiment H2, wherein the diacid is dodecanedioic acid or sebacic acid.

The entirety of each patent, patent application, publication and document referenced herein hereby is incorporated by reference. Citation of the above patents, patent applications, publications and documents is not an admission that any of the foregoing is pertinent prior art, nor does it constitute any admission as to the contents or date of these publications or documents.

Modifications may be made to the foregoing without departing from the basic aspects of the technology. Although the technology has been described in substantial detail with reference to one or more specific embodiments, those of ordinary skill in the art will recognize that changes may be made to the embodiments specifically disclosed in this application, yet these modifications and improvements are within the scope and spirit of the technology.

The technology illustratively described herein suitably may be practiced in the absence of any element(s) not specifically disclosed herein. Thus, for example, in each instance herein any of the terms "comprising," "consisting essentially of," and "consisting of" may be replaced with either of the other two terms. The terms and expressions which have been employed are used as terms of description and not of limitation, and use of such terms and expressions do not exclude any equivalents of the features shown and described or portions thereof, and various modifications are possible within the scope of the technology claimed. The term "a" or "an" can refer to one of or a plurality of the elements it modifies (e.g., "a reagent" can mean one or more reagents) unless it is contextually clear either one of the elements or more than one of the elements is described. The term "about" as used herein refers to a value within 10% of the underlying parameter (i.e., plus or minus 10%), and use of the term "about" at the beginning of a string of values modifies each of the values (i.e., "about 1, 2 and 3" refers to about 1, about 2 and about 3). For example, a weight of "about 100 grams" can include weights between 90 grams and 110 grams. Further, when a listing of values is described herein (e.g., about 50%, 60%, 70%, 80%, 85% or 86%) the listing includes all intermediate and fractional values thereof (e.g., 54%, 85.4%). Thus, it should be understood that although the present technology has been specifically disclosed by representative embodiments and optional features, modification and variation of the concepts herein disclosed may be resorted to by those skilled in the art, and such modifications and variations are considered within the scope of this technology.

Certain embodiments of the technology are set forth in the claim(s) that follow(s).

SEQUENCE LISTING (4082 sequences)

SEQ ID NO: 1 - protein, 419 aa, Cuphea lanceolata
MVAAAATSAFFPVPAPGTSPKPGKSGNWPSSLSPTFKPKSIPNAGFQVKANASAHPKANGSAVNLKSGSLNTQEDTSSSPPPRAFLNQLPDWSMLLTAITTVFVAAEKQWTMLDRKSKRPDMLVDSVGLKSIVRDGLVSRQSFLIRSYEIGADRTASIETLMNHLQETSINHCKSLGLLNDGFGRTPGMCKNDLIWVLTKMQIMVNRYPTWGDTVEINTWFSQSGKIGMASDWLISDCNTGEILIRATSVWAMMNQKTRRFSRLPYEVRQELTPHFVDSPHVIEDNDQKLHKFDVKTGDSIRKGLTPRWNDLDVNQHVSNVKYIGWILESMPIEVLETQELCSLTVEYRRECGMDSVLESVTAVDPSENGGRSQYKHLLRLEDGTDIVKSRTEWRPKNAGTNGAISTSTAKTSNGNSAS

SEQ ID NO: 2 - DNA, 2115 bp, Candida tropicalis
atggctccatttttgcccgaccaggtcgactacaaacacgtcgacacccttatgttattatgtgacgggatcatccacgaaaccaccgtcgaccaaatcaaagacgttattgctcctgacttccctgctgacaagtacgaagagtacgtcaggacattcaccaaaccctccgaaaccccagggttcagggaaaccgtctacaacacagtcaacgcaaacaccacggacgcaatccaccagttcattatcttgaccaatgttttggcatccagggtcttggctccagctttgaccaactcgttgacgcctatcaaggacatgagcttggaagaccgtgaaaaattgttggcctcgtggcgcgactccccaatcgctgccaaaaggaagttgttcaggttggtttctacgcttaccttggtcacgttcacgagattggccaatgagttgcatttgaaagccattcattatccaggaagagaagaccgtgaaaaggcttatgaaacccaggagattgacccttttaagtaccagtttttggaaaaaccgaagttttacggcgctgagttgtacttgccagatattgatgtgatcattattggatctggtgccggtgctggtgttgtggcccacactttggccaacgatggcttcaagagtttggttttggaaaagggcaaatactttagcaactccgagttgaactttgatgacaaggacggcgttcaagaattataccaaagtggaggtactttgactacagtcaaccaacagttgtttgttcttgctggttccacttttggtggcggtaccactgtcaattggtcagcctgtcttaagacgccattcaaggtgcgtaaggaatggtatgatgagtttggtgttgactttgctgctgatgaagcatacgataaagcgcaggattatgtttggcagcaaatgggagcttctaccgaaggcatcacccactctttggctaacgagattattattgaaggtggtaagaaattaggttacaaggccaaggtattagaccaaaacagcggtggtcatcctcagcacagatgcggtttctgttatttgggctgtaagcacggtatcaagcagggttctgttaataactggtttagagacgcagctgcccacggttcccagttcatgcaacaggttagagttttgcaaatacttaacaagaaggggatcgcttacggtatcttgtgtgaggatgttgtaaccggcgccaagttcaccattactggccccaaaaagtttgttgttgctgccggtgctttgaacactccatctgtgttggtcaactccggcttcaagaacaagaacatcggtaagaacttaactttgcacccagtttctgtcgtgtttggtgattttggcaaagacgttcaagcagaccacttccacaactccatcatgactgccctttgttcagaagccgctgatttagacggcaagggccatggatgcagaattgaaaccatcttgaacgctccattcatccaggcttcattcttaccatggagaggtagtaacgaggctagacgagacttgttgcgttacaacaacatggtggcgatgttgctccttagtcgtgacaccaccagtggttccgtttctgctcatccaaccaaacctgaagctttggttgtcgagtacgacgtgaacaagtttgacagaaactcgatcttgcaggcattgttggtcactgctgacttgttgtatatccaaggtgccaagagaatccttagtccacaggcatgggtgccaatttttgaatccgacaagccaaaggataagagatcaatcaaggacgaggactatgtcgaatggagagccaaggttgccaagattcctttcgacacctacggctcaccttatggttcggcacatcaaatgtcttcttgccgtatgtcaggtaagggtcctaaatacggtgctgttgacaccgatggtagattgtttgaatgttcgaatgtttatgttgccgatgcaagtcttttgccaactgcaagcggtgccaaccctatggtcaccaccatgactcttgccagacatgttgcgttaggtttggcagactccttgaagaccaaagccaagttgtag

SEQ ID NO: 3 - protein, 704 aa, Candida tropicalis
MAPFLPDQVDYKHVDTLMLLCDGIIHETTVDQIKDVIAPDFPADKYEEYVRTFTKPSETPGFRETVYNTVNANTTDAIHQFIILTNVLASRVLAPALTNSLTPIKDMSLEDREKLLASWRDSPIAAKRKLFRLVSTLTLVTFTRLANELHLKAIHYPGREDREKAYETQEIDPFKYQFLEKPKFYGAELYLPDIDVIIIGSGAGAGVVAHTLANDGFKSLVLEKGKYFSNSELNFDDKDGVQELYQSGGTLTTVNQQLFVLAGSTFGGGTTVNWSACLKTPFKVRKEWYDEFGVDFAADEAYDKAQDYVWQQMGASTEGITHSLANEIIIEGGKKLGYKAKVLDQNSGGHPQHRCGFCYLGCKHGIKQGSVNNWFRDAAAHGSQFMQQVRVLQILNKKGIAYGILCEDVVTGAKFTITGPKKFVVAAGALNTPSVLVNSGFKNKNIGKNLTLHPVSVVFGDFGKDVQADHFHNSIMTALCSEAADLDGKGHGCRIETILNAPFIQASFLPWRGSNEARRDLLRYNNMVAMLLLSRDTTSGSVSAHPTKPEALVVEYDVNKFDRNSILQALLVTADLLYIQGAKRILSPQAWVPIFESDKPKDKRSIKDEDYVEWRAKVAKIPFDTYGSPYGSAHQMSSCRMSGKGPKYGAVDTDGRLFECSNVYVADASLLPTASGANPMVTTMTLARHVALGLADSLKTKAKL

SEQ ID NO: 4 - DNA, 2115 bp, Candida tropicalis
atggctccatttttgcccgaccaggtcgactacaaacacgtcgacacccttatgttattatgtgacgggatcatccacgaaaccaccgtggacgaaatcaaagacgtcattgcccctgacttccccgccgacaaatacgaggagtacgtcaggacattcaccaaaccctccgaaaccccagggttcagggaaaccgtctacaacaccgtcaacgcaaacaccatggatgcaatccaccagttcattatcttgaccaatgttttgggatcaagggtcttggcaccagctttgaccaactcgttgactcctatcaaggacatgagcttggaagaccgtgaaaagttgttagcctcgtggcgtgactcccctattgctgctaaaaggaagttgttcaggttggtttctacgcttaccttggtcacgttcacgagattggccaatgagttgcatttgaaagccattcattatccaggaagagaagaccgtgaaaaggcttatgaaacccaggagattgacccttttaagtaccagtttttggaaaaaccgaagttttacggcgctgagttgtacttgccagatattgatgtgatcattattggatctggtgccggtgctggtgttgtggcccacactttggccaacgatggcttcaagagtttggttttggaaaagggcaaatactttagcaactccgagttgaactttgatgacaaggacggcgttcaagaattataccaaagtggaggtactttgactacagtcaaccaacagttgtttgttcttgctggttccacttttggtggcggtaccactgtcaattggtcagcctgtcttaagacgccattcaaggtgcgtaaggaatggtatgatgagtttggtgttgactttgctgctgatgaagcatacgataaagcgcaggattatgtttggcagcaaatgggagcttctaccgaaggcatcacccactctttggctaacgagattattattgaaggtggtaagaaattaggttacaaggccaaggtattagaccaaaacagcggtggtcatcctcagcacagatgcggtttctgttatttgggttgtaagcacggtatcaagcagggctctgttaataactggtttagagacgcagctgcccacggttctcagttcatgcaacaggttagagttttgcaaatccttaacaagaagggcatcgcttatggtatcttgtgtgaggatgttgtaaccggtgccaagttcaccattactggccccaaaaagtttgttgttgccgccggcgccttaaacactccatctgtgttggtcaactccggattcaagaacaagaacatcggtaagaacttaactttgcatccagtttctgtcgtgtttggtgattttggcaaagacgttcaagcagaccacttccacaactccatcatgactgccctttgttcagaagccgctgatttagacggcaagggccatggatgcagaattgaaaccatcttgaacgctccattcatccaggcttcattcttaccatggagaggtagtaacgaggctagacgagacttgttgcgttacaacaacatggtggcgatgttgctccttagtcgtgacaccaccagtggttccgtttctgctcatccaaccaaacctgaagctttggttgtcgagtacgacgtgaacaagtttgacagaaactcgatcttgcaggcattgttggtcactgctgacttgttgtatatccaaggtgccaagagaatccttagtccacaggcatgggtgccaatttttgaatccgacaagccaaaggataagagatcaatcaaggacgaggactatgtcgaatggagagccaaggttgccaagattcctttcgacacctacggctcaccttatggttcggcacatcaaatgtcttcttgccgtatgtcaggtaagggtcctaaatacggtgctgttgacaccgatggtagattgtttgaatgttcgaatgtttatgttgccgatgcaagtcttttgccaactgcaagcggtgccaaccctatggtcaccaccatgactcttgcaagacatgttgcgttaggtttggcagactccttgaagaccaaggccaagttgtag

SEQ ID NO: 5 - protein, 704 aa, Candida tropicalis
MAPFLPDQVDYKHVDTLMLLCDGIIHETTVDEIKDVIAPDFPADKYEEYVRTFTKPSETPGFRETVYNTVNANTMDAIHQFIILTNVLGSRVLAPALTNSLTPIKDMSLEDREKLLASWRDSPIAAKRKLFRLVSTLTLVTFTRLANELHLKAIHYPGREDREKAYETQEIDPFKYQFLEKPKFYGAELYLPDIDVIIIGSGAGAGVVAHTLANDGFKSLVLEKGKYFSNSELNFDDKDGVQELYQSGGTLTTVNQQLFVLAGSTFGGGTTVNWSACLKTPFKVRKEWYDEFGVDFAADEAYDKAQDYVWQQMGASTEGITHSLANEIIIEGGKKLGYKAKVLDQNSGGHPQHRCGFCYLGCKHGIKQGSVNNWFRDAAAHGSQFMQQVRVLQILNKKGIAYGILCEDVVTGAKFTITGPKKFVVAAGALNTPSVLVNSGFKNKNIGKNLTLHPVSVVFGDFGKDVQADHFHNSIMTALCSEAADLDGKGHGCRIETILNAPFIQASFLPWRGSNEARRDLLRYNNMVAMLLLSRDTTSGSVSAHPTKPEALVVEYDVNKFDRNSILQALLVTADLLYIQGAKRILSPQAWVPIFESDKPKDKRSIKDEDYVEWRAKVAKIPFDTYGSPYGSAHQMSSCRMSGKGPKYGAVDTDGRLFECSNVYVADASLLPTASGANPMVTTMTLARHVALGLADSLKTKAKL

SEQ ID NO: 6 - DNA, 2115 bp, Candida tropicalis
atggctccatttttgcccgaccaggtcgactacaaacacgtcgacacccttatgttattatgtgacgggatcatccacgaaaccaccgtcgaccaaatcaaagacgttattgctcctgacttccctgctgacaagtacgaagagtacgtcaggacattcaccaaaccctccgaaaccccagggttcagggaaaccgtctacaacacagtcaacgcaaacaccacggacgcaatccaccagttcattatcttgaccaatgttttggcatccagggtcttggctccagctttgaccaactcgttgacgcctatcaaggacatgagcttggaagaccgtgaaaaattgttggcctcgtggcgcgactccccaatcgctgccaaaaggaaattgttcaggttggtttccacgcttaccttggttactttcacgagattggccaatgagttgcatttgaaagccattcactatccaggaagagaagaccgtgaaaaggcttatgaaacccaggagattgaccctttcaagtaccagtttatggaaaagccaaagtttgacggcgctgagttgtacttgccagatattgatgttatcattattggatctggtgccggtgctggtgttgtggcccacactttggccaacgatggcttcaagagtttggttttggaaaagggcaaatactttagcaactccgagttgaactttgatgacaaggacggcgttcaagaattataccaaagtggaggtactttgactacagtcaaccaacagttgtttgttcttgctggttccacttttggtggcggtaccactgtcaattggtcagcctgtcttaagacgccattcaaggtgcgtaaggaatggtatgatgagtttggtgttgactttgctgctgatgaagcatacgataaagcgcaggattatgtttggcagcaaatgggagcttctaccgaaggcatcacccactctttggctaacgagattattattgaaggtggtaagaaattaggttacaaggccaaggtattagaccaaaacagcggtggtcatcctcagcacagatgcggtttctgttatttgggctgtaagcacggtatcaagcagggttctgttaataactggtttagagacgcagctgcccacggttcccagttcatgcaacaggttagagttttgcaaatacttaacaagaaggggatcgcttacggtatcttgtgtgaggatgttgtaaccggcgccaagttcaccattactggccccaaaaagtttgttgttgctgccggtgctttgaacactccatctgtgttggtcaactccggcttcaagaacaagaacatcggtaagaacttaactttgcacccagtttctgtcgtgtttggtgattttggcaaagacgttcaagcagaccacttccacaactccatcatgactgccctttgttcagaagccgctgatttagacggcaagggccatggatgcagaattgaaaccatcttgaacgctccattcatccaggcttcattcttaccatggagaggtagtaacgaggctagacgagacttgttgcgttacaacaacatggtggcgatgttgctccttagtcgtgacaccaccagtggttccgtttctgctcatccaaccaaacctgaagctttggttgtcgagtacgacgtgaacaagtttgacagaaactcgatcttgcaggcattgttggtcactgctgacttgttgtatatccaaggtgccaagagaatccttagtccacaggcatgggtgccaatttttgaatccgacaagccaaaggataagagatcaatcaaggacgaggactatgtcgaatggagagccaaggttgccaagattcctttcgacacctacggctcaccttatggttcggcacatcaaatgtcttcttgccgtatgtcaggtaagggtcctaaatacggtgctgttgacaccgatggtagattgtttgaatgttcgaatgtttatgttgccgatgcaagtcttttgccaactgcaagcggtgccaaccctatggtcaccaccatgactcttgccagacatgttgcgttaggtttggcagactccttgaagaccaaagccaagttgtag

SEQ ID NO: 7 - protein, 704 aa, Candida tropicalis
MAPFLPDQVDYKHVDTLMLLCDGIIHETTVDQIKDVIAPDFPADKYEEYVRTFTKPSETPGFRETVYNTVNANTTDAIHQFIILTNVLASRVLAPALTNSLTPIKDMSLEDREKLLASWRDSPIAAKRKLFRLVSTLTLVTFTRLANELHLKAIHYPGREDREKAYETQEIDPFKYQFMEKPKFDGAELYLPDIDVIIIGSGAGAGVVAHTLANDGFKSLVLEKGKYFSNSELNFDDKDGVQELYQSGGTLTTVNQQLFVLAGSTFGGGTTVNWSACLKTPFKVRKEWYDEFGVDFAADEAYDKAQDYVWQQMGASTEGITHSLANEIIIEGGKKLGYKAKVLDQNSGGHPQHRCGFCYLGCKHGIKQGSVNNWFRDAAAHGSQFMQQVRVLQILNKKGIAYGILCEDVVTGAKFTITGPKKFVVAAGALNTPSVLVNSGFKNKNIGKNLTLHPVSVVFGDFGKDVQADHFHNSIMTALCSEAADLDGKGHGCRIETILNAPFIQASFLPWRGSNEARRDLLRYNNMVAMLLLSRDTTSGSVSAHPTKPEALVVEYDVNKFDRNSILQALLVTADLLYIQGAKRILSPQAWVPIFESDKPKDKRSIKDEDYVEWRAKVAKIPFDTYGSPYGSAHQMSSCRMSGKGPKYGAVDTDGRLFECSNVYVADASLLPTASGANPMVTTMTLARHVALGLADSLKTKAKL

SEQ ID NO: 8 - DNA, 2115 bp, Candida tropicalis
atgaataccttcttgccagacgtgctcgaatacaaacacgtcgacacccttttgttattgtgtgacgggatcatccacgaaaccacagtcgatcagatcaaggacgccattgctcccgacttccctgaggaccagtacgaggagtatctcaagaccttcaccaagccatctgagacccctgggttcagagaagccgtctacgacacgatcaacgccaccccaaccgatgccgtgcacatgtgtattgtcttgaccaccgcattggactccagaatcttggcccccacgttgaccaactcgttgacgcctatcaaggatatgaccttgaaggagcgtgaacaattgttggcctcttggcgtgattccccgattgcggcaaagagaagattgttcagattgatttcctcgcttaccttgacgacgtttacgagattggccagcgaattgcacttgaaagccatccactaccctggcagagacttgcgtgaaaaggcgtatgaaacccaggtggttgaccctttcaggtacctgtttatggagaaaccaaagtttgacggcgccgaattgtacttgccagatatcgacgtcatcatcattggatcaggcgccggtgctggtgtcatggcccacactctcgccaacgacgggttcaagaccttggttttggaaaagggaaagtatttcagcaactccgagttgaactttaatgacgctgatggcgtgaaagagttgtaccaaggtaaaggtgctttggccaccaccaatcagcagatgtttattcttgccggttccactttgggcggtggtaccactgtcaactggtctgcttgccttaaaacaccatttaaagtgcgtaaggagtggtacgacgagtttggtcttgaatttgctgccgatgaagcctacgacaaagcgcaggattatgtttggaaacaaatgggtgcttcaacagatggaatcactcactccttggccaacgaagttgtggttgaaggaggtaagaagttgggctacaagagcaaggaaattgagcagaacaacggtggccaccctgaccacccatgtggtttctgttacttgggctgtaagtacggtattaaacagggttctgtgaataactggtttagagacgcagctgcccacgggtccaagttcatgcaacaagtcagagttgtgcaaatcctcaacaagaatggcgtcgcttatggtatcttgtgtgaggatgtcgaaaccggagtcaggttcactattagtggccccaaaaagtttgttgtttctgctggttctttgaacacgccaactgtgttgaccaactccggattcaagaacaagcacattggtaagaacttgacgttgcacccagtttccaccgtgtttggtgactttggcagagacgtgcaagccgaccatttccacaaatctattatgacttcgctttgttacgaggttgctgacttggacggcaagggccacggatgcagaatcgaaaccatcttgaacgctccattcatccaagcttctttgttgccatggagaggaagtgacgaggtcagaagagacttgttgcgttacaacaacatggtggccatgttgcttatcacgcgtgataccaccagtggttcagtttctgctgacccaaagaagcccgacgctttgattgtcgactatgagattaacaagtttgacaagaatgccatcttgcaagctttcttgatcacttccgacatgttgtacattgaaggtgccaagagaatcctcagtccacagccatgggtgccaatctttgagtcgaacaagccaaaggagcaaagaacgatcaaggacaaggactatgttgagtggagagccaaggctgctaagatacctttcgacacctacggttctgcatatgggtccgcacatcaaatgtccacctgtcgtatgtccggaaagggtcctaaatacggtgctgttgatactgatggtagattgtttgaatgttcgaatgtctatgttgctgatgctagtgttttgcctactgccagcggtgccaacccaatgatatccaccatgacctttgctagacagattgcgttaggtttggctgactccttgaagaccaaacccaagttgtag

SEQ ID NO: 9 - protein, 704 aa, Candida tropicalis
MNTFLPDVLEYKHVDTLLLLCDGIIHETTVDQIKDAIAPDFPEDQYEEYLKTFTKPSETPGFREAVYDTINATPTDAVHMCIVLTTALDSRILAPTLTNSLTPIKDMTLKEREQLLASWRDSPIAAKRRLFRLISSLTLTTFTRLASELHLKAIHYPGRDLREKAYETQVVDPFRYSFMEKPKFDGAELYLPDIDVIIIGSGAGAGVMAHTLANDGFKTLVLEKGKYFSNSELNFNDADGVKELYQGKGALATTNQQMFILAGSTLGGGTTVNWSACLKTPFKVRKEWYDEFGLEFAADEAYDKAQDYVWKQMGASTDGITHSLANEVVVEGGKKLGYKSKEIEQNNGGHPDHPCGFCYLGCKYGIKQGSVNNWFRDAAAHGSKFMQQVRVVQILNKNGVAYGILCEDVETGVRFTISGPKKFVVSAGSLNTPTVLTNSGFKNKHIGKNLTLHPVSTVFGDFGRDVQADHFHKSIMTSLCYEVADLDGKGHGCRIETILNAPFIQASLLPWRGSDEVRRDLLRYNNMVAMLLITRDTTSGSVSADPKKPDALIVDYEINKFDKNAILQAFLITSDMLYIEGAKRILSPQPWVPIFESNKPKEQRTIKDKDYVEWRAKAAKIPFDTYGSAYGSAHQMSTCRMSGKGPKYGAVDTDGRLFECSNVYVADASVLPTASGANPMISTMTFARQIALGLADSLKTKPKL

SEQ ID NO: 10 - DNA, 2115 bp, Candida tropicalis
atgaataccttcttgccagacgtgctcgaatacaaacacgtcgatacccttttgttattatgtgacgggatcatccacgaaaccacagtcgaccagatcagggacgccattgctcccgacttccctgaagaccagtacgaggagtatctcaagaccttcaccaagccatctgagacccctgggttcagagaagccgtctacgacacgatcaacagcaccccaaccgaggctgtgcacatgtgtattgtattgaccaccgcattggactcgagaatcttggcccccacgttgaccaactcgttgacgcctatcaaggatatgaccttgaaagagcgtgaacaattgttggctgcctggcgtgattccccgatcgcggccaagagaagattgttcagattgatttcctcacttaccttgacgacctttacgagattggccagcgacttgcacttgagagccatccactaccctggcagagacttgcgtgaaaaggcatatgaaacccaggtggttgaccctttcaggtacctgtttatggaaaaaccaaagtttgacggcaccgagttgtacttgccagatatcgacgtcatcatcattggatccggtgccggtgctggtgtcatggcccacactttagccaacgacgggtacaagaccttggttttggaaaagggaaagtatttcagcaactccgagttgaactttaatgatgccgatggtatgaaagagttgtaccaaggtaaatgtgcgttgaccaccacgaaccagcagatgtttattcttgccggttccactttgggcggtggtaccactgttaactggtctgcttgtcttaaaacaccatttaaagtgcgtaaggagtggtacgacgagtttggtcttgaatttgctgccgacgaagcctacgacaaagcacaagactatgtttggaaacaaatgggcgcttctaccgaaggaatcactcactctttggcgaacgcggttgtggttgaaggaggtaagaagttgggttacaagagcaaggaaatcgagcagaacaatggtggccatcctgaccacccctgtggtttctgttacttgggctgtaagtacggtattaagcagggttctgtgaataactggtttagagacgcagctgcccacgggtccaagttcatgcaacaagtcagagttgtgcaaatcctccacaataaaggcgtcgcttatggcatcttgtgtgaggatgtcgagaccggagtcaaattcactatcagtggccccaaaaagtttgttgtttctgcaggttctttgaacacgccaacggtgttgaccaactccggattcaagaacaaacacatcggtaagaacttgacgttgcacccagtttcgaccgtgtttggtgactttggcagagacgtgcaagccgaccatttccacaaatctattatgacttcgctctgttacgaagtcgctgacttggacggcaagggccacggatgcagaatcgagaccatcttgaacgctccattcatccaagcttctttgttgccatggagaggaagcgacgaggtcagaagagacttgttgcgttacaacaacatggtggccatgttgcttatcacccgtgacaccaccagtggttcagtttctgctgacccaaagaagcccgacgctttgattgtcgactatgacatcaacaagtttgacaagaatgccatcttgcaagctttcttgatcacctccgacatgttgtacatcgaaggtgccaagagaatcctcagtccacaggcatgggtgccaatctttgagtcgaacaagccaaaggagcaaagaacaatcaaggacaaggactatgtcgaatggagagccaaggctgccaagatacctttcgacacctacggttctgcctatgggtccgcacatcaaatgtccacctgtcgtatgtccggaaagggtcctaaatacggcgccgttgataccgatggtagattgtttgaatgttcgaatgtctatgttgctgatgctagtgttttgcctactgccagcggtgccaacccaatgatctccaccatgacgtttgctagacagattgcgttaggtttggctgactctttgaagaccaaacccaagttgtag

SEQ ID NO: 11 - protein, 638 aa, Candida tropicalis
MNTFLPDVLEYKHVDTLLLLCDGIIHETTVDQIRDAIAPDFPEDQYEEYLKTFTKPSETPGFREAVYDTINSTPTEAVHMCIVLTTALDSRILAPTLTNSLTPIKDMTLKEREQLLAAWRDSPIAAKRRLFRLISSLTLTTFTRLASDLHLRAIHYPGRDLREKAYETQVVDPFRYSFMEKPKFDGTELYLPDIDVIIIGSGAGAGVMAHTLANDGYKTLVLEKGKYFSNSELNFNDADGMKELYQGKCALTTTNQQMFILAGSTLGGGTTVNWSACLKTPFKVRKEWYDEFGLEFAADEAYDKAQDYVWKQMGASTEGITHSLANAVVVEGGKKLGYKSKEIEQNNGGHPDHPCGFCYLGCKYGIKQGSVNNWFRDAAAHGSKFMQQVRVVQILHNKGVAYGILCEDVETGVKFTISGPKKFVVSAGSLNTPTVLTNSGFKNKHIGKNLTLHPVSTVFGDFGRDVQADHFHKSIMTSLCYEVADLDGKGHGCRIETILNAPFIQASLLPWRGSDEVRRDLLRYNNMVAMLLITRDTTSGSVSADPKKPDALIVDYDINKFDKNAILQAFLITSDMLYIEGAKRILSPQAWVPIFESNKPKEQRTIKDKDYVEWRAKAAKIPFDTYGSAYGSAHQMST

SEQ ID NO: 12 - DNA, 2115 bp, Candida tropicalis
atggctccatttttgcccgaccaggtcgactacaaacacgtcgacacccttatgttattatgtgacgggatcatccacgaaaccaccgtggacgaaatcaaagacgtcattgcccctgacttccccgccgacaaatacgaggagtacgtcaggacattcaccaaaccctccgaaaccccagggttcagggaaaccgtctacaacaccgtcaacgcaaacaccatggatgcaatccaccagttcattatcttgaccaatgttttgggatcaagggtcttggcaccagctttgaccaactcgttgactcctatcaaggacatgagcttggaagaccgtgaaaagttgttagcctcgtggcgtgactcccctattgctgctaaaaggaagttgttcaggttggtttctacgcttaccttggtcacgttcacgagattggccaatgagttgcatttgaaagccattcattatccaggaagagaagaccgtgaaaaggcttatgaaacccaggagattgacccttttaagtaccagtttttggaaaaaccgaagttttacggcgctgagttgtacttgccagatattgatgtgatcattattggatctggggccggtgctggtgtcgtggcccacactttgaccaacgacggcttcaagagtttggttttggaaaagggcagatactttagcaactccgagttgaactttgatgacaaggacggggttcaagaattataccaaagtggaggtactttgaccaccgtcaaccagcagttgtttgttcttgctggttccacttttggtggtggtaccactgtcaattggtcggcctgtcttaaaacgccattcaaggtgcgtaaggaatggtatgatgagtttggcgttgactttgctgccgatgaagcctacgacaaagcacaggattatgtttggcagcaaatgggagcttctaccgaaggcatcacccactctttggctaacgagattattattgaaggtggcaagaaattaggttacaaggccaaggtattagaccaaaacagcggtggtcatcctcatcacagatgcggtttctgttatttgggttgtaagcacggtatcaagcagggctctgttaataactggtttagagacgcagctgcccacggttctcagttcatgcaacaggttagagttttgcaaatccttaacaagaagggcatcgcttatggtatcttgtgtgaggatgttgtaaccggtgccaagttcaccattactggccccaaaaagtttgttgttgccgccggcgccttaaacactccatctgtgttggtcaactccggattcaagaacaagaacatcggtaagaacttaactttgcatccagtttctgtcgtgtttggtgattttggcaaagacgttcaagcagatcacttccacaactccatcatgactgctctttgttcagaagccgctgatttagacggcaagggtcatggatgcagaattgaaaccatcttgaacgctccattcatccaggcttcattcttaccatggagaggtagtaacgaggctagacgagacttgttgcgttacaacaacatggtggccatgttacttcttagtcgtgataccaccagtggttccgtttcgtcccatccaactaaacctgaagcattagttgtcgagtacgacgtgaacaagtttgacagaaactccatcttgcaggcattgttggtcactgctgacttgttgtacattcaaggtgccaagagaatccttagtccccaaccatgggtgccaatttttgaatccgacaagccaaaggataagagatcaatcaaggacgaggactatgtcgaatggagagccaaggttgccaagattccttttgacacctacggctcgccttatggttcggcgcatcaaatgtcttcttgtcgtatgtcaggtaagggtcctaaatacggtgctgttgataccgatggtagattgtttgaatgttcgaatgtttatgttgctgacgctagtcttttgccaactgctagcggtgctaatcctatggtcaccaccatgactcttgcaagacatgttgcgttaggtttggcagactccttgaagaccaaggccaagttgtag

SEQ ID NO: 13 - protein, 704 aa, Candida tropicalis
MAPFLPDQVDYKHVDTLMLLCDGIIHETTVDEIKDVIAPDFPADKYEEYVRTFTKPSETPGFRETVYNTVNANTMDAIHQFIILTNVLGSRVLAPALTNSLTPIKDMSLEDREKLLASWRDSPIAAKRKLFRLVSTLTLVTFTRLANELHLKAIHYPGREDREKAYETQEIDPFKYQFLEKPKFYGAELYLPDIDVIIIGSGAGAGVVAHTLTNDGFKSLVLEKGRYFSNSELNFDDKDGVQELYQSGGTLTTVNQQLFVLAGSTFGGGTTVNWSACLKTPFKVRKEWYDEFGVDFAADEAYDKAQDYVWQQMGASTEGITHSLANEIIIEGGKKLGYKAKVLDQNSGGHPHHRCGFCYLGCKHGIKQGSVNNWFRDAAAHGSQFMQQVRVLQILNKKGIAYGILCEDVVTGAKFTITGPKKFVVAAGALNTPSVLVNSGFKNKNIGKNLTLHPVSVVFGDFGKDVQADHFHNSIMTALCSEAADLDGKGHGCRIETILNAPFIQASFLPWRGSNEARRDLLRYNNMVAMLLLSRDTTSGSVSSHPTKPEALVVEYDVNKFDRNSILQALLVTADLLYIQGAKRILSPQPWVPIFESDKPKDKRSIKDEDYVEWRAKVAKIPFDTYGSPYGSAHQMSSCRMSGKGPKYGAVDTDGRLFECSNVYVADASLLPTASGANPMVTTMTLARHVALGLADSLKTKAKL

SEQ ID NO: 14 - DNA, 1572 bp, Candida tropicalis
atggccacacaagaaatcatcgattctgtacttccgtacttgaccaaatggtacactgtgattactgcagcagtattagtcttccttatctccacaaacatcaagaactacgtcaaggcaaagaaattgaaatgtgtcgatccaccatacttgaaggatgccggtctcactggtattctgtctttgatcgccgccatcaaggccaagaacgacggtagattggctaactttgccgatgaagttttcgacgagtacccaaaccacaccttctacttgtctgttgccggtgctttgaagattgtcatgactgttgacccagaaaacatcaaggctgtcttggccacccaattcactgacttctccttgggtaccagacacgcccactttgctcctttgttgggtgacggtatcttcaccttggacggagaaggttggaagcactccagagctatgttgagaccacagtttgctagagaccagattggacacgttaaagccttggaaccacacatccaaatcatggctaagcagatcaagttgaaccagggaaagactttcgatatccaagaattgttctttagatttaccgtcgacaccgctactgagttcttgtttggtgaatccgttcactccttgtacgatgaaaaattgggcatcccaactccaaacgaaatcccaggaagagaaaactttgccgctgctttcaacgtttcccaacactacttggccaccagaagttactcccagactttttactttttgaccaaccctaaggaattcagagactgtaacgccaaggtccaccacttggccaagtactttgtcaacaaggccttgaactttactcctgaagaactcgaagagaaatccaagtccggttacgttttcttgtacgaattggttaagcaaaccagagatccaaaggtcttgcaagatcaattgttgaacattatggttgccggaagagacaccactgccggtttgttgtcctttgctttgtttgaattggctagacacccagagatgtggtccaagttgagagaagaaatcgaagttaactttggtgttggtgaagactcccgcgttgaagaaattaccttcgaagccttgaagagatgtgaatacttgaaggctatccttaacgaaaccttgcgtatgtacccatctgttcctgtcaactttagaaccgccaccagagacaccactttgccaagaggtggtggtgctaacggtaccgacccaatctacattcctaaaggctccactgttgcttacgttgtctacaagacccaccgtttggaagaatactacggtaaggacgctaacgacttcagaccagaaagatggtttgaaccatctactaagaagttgggctgggcttatgttccattcaacggtggtccaagagtctgcttgggtcaacaattcgccttgactgaagcttcttatgtgatcactagattggcccagatgtttgaaactgtctcatctgatccaggtctcgaataccctccaccaaagtgtattcacttgaccatgagtcacaacgatggtgtctttgtcaagatgtaa

SEQ ID NO: 15 - DNA, 1569 bp, Candida tropicalis
atgactgtacacgatattatcgccacatacttcaccaaatggtacgtgatagtaccactcgctttgattgcttatagagtcctcgactacttctatggcagatacttgatgtacaagcttggtgctaaaccatttttccagaaacagacagacggctgtttcggattcaaagctccgcttgaattgttgaagaagaagagcgacggtaccctcatagacttcacactccagcgtatccacgatctcgatcgtcccgatatcccaactttcacattcccggtcttttccatcaaccttgtcaatacccttgagccggagaacatcaaggccatcttggccactcagttcaacgatttctccttgggtaccagacactcgcactttgctcctttgttgggtgatggtatctttacgttggatggcgccggctggaagcacagcagatctatgttgagaccacagtttgccagagaacagatttcccacgtcaagttgttggagccacacgttcaggtgttcttcaaacacgtcagaaaggcacagggcaagacttttgacatccaggaattgtttttcagattgaccgtcgactccgccaccgagtttttgtttggtgaatccgttgagtccttgagagatgaatctatcggcatgtccatcaatgcgcttgactttgacggcaaggctggctttgctgatgcttttaactattcgcagaattatttggcttcgagagcggttatgcaacaattgtactgggtgttgaacgggaaaaagtttaaggagtgcaacgctaaagtgcacaagtttgctgactactacgtcaacaaggctttggacttgacgcctgaacaattggaaaagcaggatggttatgtgtttttgtacgaattggtcaagcaaaccagagacaagcaagtgttgagagaccaattgttgaacatcatggttgctggtagagacaccaccgccggtttgttgtcgtttgttttctttgaattggccagaaacccagaagttaccaacaagttgagagaagaaattgaggacaagtttggactcggtgagaatgctagtgttgaagacatttcctttgagtcgttgaagtcctgtgaatacttgaaggctgttctcaacgaaaccttgagattgtacccatccgtgccacagaatttcagagttgccaccaagaacactaccctcccaagaggtggtggtaaggacgggttgtctcctgttttggtgagaaagggtcagaccgttatttacggtgtctacgcagcccacagaaacccagctgtttacggtaaggacgctcttgagtttagaccagagagatggtttgagccagagacaaagaagcttggctgggccttcctcccattcaacggtggtccaagaatctgtttgggacagcagtttgccttgacagaagcttcgtatgtcactgtcaggttgctccaggagtttgcacacttgtctatggacccagacaccgaatatccacctaagaaaatgtcgcatttgaccatgtcgcttttcgacggtgccaatattgagatgtattag

SEQ ID NO: 16 - DNA, 1569 bp, Candida tropicalis
atgactgcacaggatattatcgccacatacatcaccaaatggtacgtgatagtaccactcgctttgattgcttatagggtcctcgactacttttacggcagatacttgatgtacaagcttggtgctaaaccgtttttccagaaacaaacagacggttatttcggattcaaagctccacttgaattgttaaaaaagaagagtgacggtaccctcatagacttcactctcgagcgtatccaagcgctcaatcgtccagatatcccaacttttacattcccaatcttttccatcaaccttatcagcacccttgagccggagaacatcaaggctatcttggccacccagttcaacgatttctccttgggcaccagacactcgcactttgctcctttgttgggcgatggtatctttaccttggacggtgccggctggaagcacagcagatctatgttgagaccacagtttgccagagaacagatttcccacgtcaagttgttggagccacacatgcaggtgttcttcaagcacgtcagaaaggcacagggcaagacttttgacatccaagaattgtttttcagattgaccgtcgactccgccactgagtttttgtttggtgaatccgttgagtccttgagagatgaatctattgggatgtccatcaatgcacttgactttgacggcaaggctggctttgctgatgcttttaactactcgcagaactatttggcttcgagagcggttatgcaacaattgtactgggtgttgaacgggaaaaagtttaaggagtgcaacgctaaagtgcacaagtttgctgactattacgtcagcaaggctttggacttgacacctgaacaattggaaaagcaggatggttatgtgttcttgtacgagttggtcaagcaaaccagagacaggcaagtgttgagagaccagttgttgaacatcatggttgccggtagagacaccaccgccggtttgttgtcgtttgttttctttgaattggccagaaacccagaggtgaccaacaagttgagagaagaaatcgaggacaagtttggtcttggtgagaatgctcgtgttgaagacatttcctttgagtcgttgaagtcatgtgaatacttgaaggctgttctcaacgaaactttgagattgtacccatccgtgccacagaatttcagagttgccaccaaaaacactacccttccaaggggaggtggtaaggacgggttatctcctgttttggtcagaaagggtcaaaccgttatgtacggtgtctacgctgcccacagaaacccagctgtctacggtaaggacgcccttgagtttagaccagagaggtggtttgagccagagacaaagaagcttggctgggccttccttccattcaacggtggtccaagaatttgcttgggacagcagtttgccttgacagaagcttcgtatgtcactgtcagattgctccaagagtttggacacttgtctatggaccccaacaccgaatatccacctaggaaaatgtcgcatttgaccatgtcccttttcgacggtgccaacattgagatgtattag

SEQ ID NO: 17 - DNA, 1623 bp, Candida tropicalis
atgtcgtcttctccatcgtttgcccaagaggttctcgctaccactagtccttacatcgagtactttcttgacaactacaccagatggtactacttcatacctttggtgcttctttcgttgaactttataagtttgctccacacaaggtacttggaacgcaggttccacgccaagccactcggtaactttgtcagggaccctacgtttggtatcgctactccgttgcttttgatctacttgaagtcgaaaggtacggtcatgaagtttgcttggggcctctggaacaacaagtacatcgtcagagacccaaagtacaagacaactgggctcaggattgttggcctcccattgattgaaaccatggacccagagaacatcaaggctgttttggctactcagttcaatgatttctctttgggaaccagacacgatttcttgtactccttgttgggtgacggtattttcaccttggacggtgctggctggaaacatagtagaactatgttgagaccacagtttgctagagaacaggtttctcacgtcaagttgttggagccacacgttcaggtgttcttcaagcacgttagaaagcaccgcggtcaaacgttcgacatccaagaattgttcttcaggttgaccgtcgactccgccaccgagttcttgtttggtgagtctgctgaatccttgagggacgaatctattggattgaccccaaccaccaaggatttcgatggcagaagagatttcgctgacgctttcaactattcgcagacttaccaggcctacagatttttgttgcaacaaatgtactggatcttgaatggctcggaattcagaaagtcgattgctgtcgtgcacaagtttgctgaccactatgtgcaaaaggctttggagttgaccgacgatgacttgcagaaacaagacggctatgtgttcttgtacgagttggctaagcaaaccagagacccaaaggtcttgagagaccagttattgaacattttggttgccggtagagacacgaccgccggtttgttgtcatttgttttctacgagttgtcaagaaaccctgaggtgtttgctaagttgagagaggaggtggaaaacagatttggactcggtgaagaagctcgtgttgaagagatctcgtttgagtccttgaagtcttgtgagtacttgaaggctgtcatcaatgaaaccttgagattgtacccatcggttccacacaactttagagttgctaccagaaacactaccctcccaagaggtggtggtgaagatggatactcgccaattgtcgtcaagaagggtcaagttgtcatgtacactgttattgctacccacagagacccaagtatctacggtgccgacgctgacgtcttcagaccagaaagatggtttgaaccagaaactagaaagttgggctgggcatacgttccattcaatggtggtccaagaatctgtttgggtcaacagtttgccttgaccgaagcttcatacgtcactgtcagattgctccaggagtttgcacacttgtctatggacccagacaccgaatatccaccaaaattgcagaacaccttgaccttgtcgctctttgatggtgctgatgttagaatgtactaa

SEQ ID NO: 18 - DNA, 1623 bp, Candida tropicalis
atgtcgtcttctccatcgtttgctcaggaggttctcgctaccactagtccttacatcgagtactttcttgacaactacaccagatggtactacttcatccctttggtgcttctttcgttgaacttcatcagcttgctccacacaaagtacttggaacgcaggttccacgccaagccgctcggtaacgtcgtgttggatcctacgtttggtatcgctactccgttgatcttgatctacttaaagtcgaaaggtacagtcatgaagtttgcctggagcttctggaacaacaagtacattgtcaaagacccaaagtacaagaccactggccttagaattgtcggcctcccattgattgaaaccatagacccagagaacatcaaagctgtgttggctactcagttcaacgatttctccttgggaactagacacgatttcttgtactccttgttgggcgatggtatttttaccttggacggtgctggctggaaacacagtagaactatgttgagaccacagtttgctagagaacaggtttcccacgtcaagttgttggaaccacacgttcaggtgttcttcaagcacgttagaaaacaccgcggtcagacttttgacatccaagaattgttcttcagattgaccgtcgactccgccaccgagttcttgtttggtgagtctgctgaatccttgagagacgactctgttggtttgaccccaaccaccaaggatttcgaaggcagaggagatttcgctgacgctttcaactactcgcagacttaccaggcctacagatttttgttgcaacaaatgtactggattttgaatggcgcggaattcagaaagtcgattgccatcgtgcacaagtttgctgaccactatgtgcaaaaggctttggagttgaccgacgatgacttgcagaaacaagacggctatgtgttcttgtacgagttggctaagcaaactagagacccaaaggtcttgagagaccagttgttgaacattttggttgccggtagagacacgaccgccggtttgttgtcgtttgtgttctacgagttgtcgagaaaccctgaagtgtttgccaagttgagagaggaggtggaaaacagatttggactcggcgaagaggctcgtgttgaagagatctcttttgagtccttgaagtcctgtgagtacttgaaggctgtcatcaatgaagccttgagattgtacccatctgttccacacaacttcagagttgccaccagaaacactacccttccaagaggcggtggtaaagacggatgctcgccaattgttgtcaagaagggtcaagttgtcatgtacactgtcattggtacccacagagacccaagtatctacggtgccgacgccgacgtcttcagaccagaaagatggttcgagccagaaactagaaagttgggctgggcatatgttccattcaatggtggtccaagaatctgtttgggtcagcagtttgccttgactgaagcttcatacgtcactgtcagattgctccaagagtttggaaacttgtccctggatccaaacgctgagtacccaccaaaattgcagaacaccttgaccttgtcactctttgatggtgctgacgttagaatgttctaa

SEQ ID NO: 19 - DNA, 1554 bp, Candida tropicalis
atgattgaacaactcctagaatattggtatgtcgttgtgccagtgttgtacatcatcaaacaactccttgcatacacaaagactcgcgtcttgatgaaaaagttgggtgctgctccagtcacaaacaagttgtacgacaacgctttcggtatcgtcaatggatggaaggctctccagttcaagaaagagggcagggctcaagagtacaacgattacaagtttgaccactccaagaacccaagcgtgggcacctacgtcagtattcttttcggcaccaggatcgtcgtgaccaaagatccagagaatatcaaagctattttggcaacccagtttggtgatttttctttgggcaagaggcacactctttttaagcctttgttaggtgatgggatcttcacattggacggcgaaggctggaagcacagcagagccatgttgagaccacagtttgccagagaacaagttgctcatgtgacgtcgttggaaccacacttccagttgttgaagaagcatattcttaagcacaagggtgaatactttgatatccaggaattgttctttagatttaccgttgattcggccacggagttcttatttggtgagtccgtgcactccttaaaggacgaatctattggtatcaaccaagacgatatagattttgctggtagaaaggactttgctgagtcgttcaacaaagcccaggaatacttggctattagaaccttggtgcagacgttctactggttggtcaacaacaaggagtttagagactgtaccaagctggtgcacaagttcaccaactactatgttcagaaagctttggatgctagcccagaagagcttgaaaagcaaagtgggtatgtgttcttgtacgagcttgtcaagcagacaagagaccccaatgtgttgcgtgaccagtctttgaacatcttgttggccggaagagacaccactgctgggttgttgtcgtttgctgtctttgagttggccagacacccagagatctgggccaagttgagagaggaaattgaacaacagtttggtcttggagaagactctcgtgttgaagagattacctttgagagcttgaagagatgtgagtacttgaaagcgttccttaatgaaaccttgcgtatttacccaagtgtcccaagaaacttcagaatcgccaccaagaacacgacattgccaaggggcggtggttcagacggtacctcgccaatcttgatccaaaagggagaagctgtgtcgtatggtatcaactctactcatttggaccctgtctattacggccctgatgctgctgagttcagaccagagagatggtttgagccatcaaccaaaaagctcggctgggcttacttgccattcaacggtggtccaagaatctgtttgggtcagcagtttgccttgacggaagctggctatgtgttggttagattggtgcaagagttctcccacgttaggctggacccagacgaggtgtacccgccaaagaggttgaccaacttgaccatgtgtttgcaggatggtgctattgtcaagtttgactag

SEQ ID NO: 20 - DNA, 1554 bp, Candida tropicalis
atgattgaacaaatcctagaatattggtatattgttgtgcctgtgttgtacatcatcaaacaactcattgcctacagcaagactcgcgtcttgatgaaacagttgggtgctgctccaatcacaaaccagttgtacgacaacgttttcggtatcgtcaacggatggaaggctctccagttcaagaaagagggcagagctcaagagtacaacgatcacaagtttgacagctccaagaacccaagcgtcggcacctatgtcagtattctttttggcaccaagattgtcgtgaccaaggatccagagaatatcaaagctattttggcaacccagtttggcgatttttctttgggcaagagacacgctctttttaaacctttgttaggtgatgggatcttcaccttggacggcgaaggctggaagcatagcagatccatgttaagaccacagtttgccagagaacaagttgctcatgtgacgtcgttggaaccacacttccagttgttgaagaagcatatccttaaacacaagggtgagtactttgatatccaggaattgttctttagatttactgtcgactcggccacggagttcttatttggtgagtccgtgcactccttaaaggacgaaactatcggtatcaaccaagacgatatagattttgctggtagaaaggactttgctgagtcgttcaacaaagcccaggagtatttgtctattagaattttggtgcagaccttctactggttgatcaacaacaaggagtttagagactgtaccaagctggtgcacaagtttaccaactactatgttcagaaagctttggatgctaccccagaggaacttgaaaagcaaggcgggtatgtgttcttgtatgagcttgtcaagcagacgagagaccccaaggtgttgcgtgaccagtctttgaacatcttgttggcaggaagagacaccactgctgggttgttgtcctttgctgtgtttgagttggccagaaacccacacatctgggccaagttgagagaggaaattgaacagcagtttggtcttggagaagactctcgtgttgaagagattacctttgagagcttgaagagatgtgagtacttgaaagcgttccttaacgaaaccttgcgtgtttacccaagtgtcccaagaaacttcagaatcgccaccaagaatacaacattgccaaggggtggtggtccagacggtacccagccaatcttgatccaaaagggagaaggtgtgtcgtatggtatcaactctacccacttagatcctgtctattatggccctgatgctgctgagttcagaccagagagatggtttgagccatcaaccagaaagctcggctgggcttacttgccattcaacggtgggccacgaatctgtttgggtcagcagtttgccttgaccgaagctggttacgttttggtcagattggtgcaagagttctcccacattaggctggacccagatgaagtgtatccaccaaagaggttgaccaacttgaccatgtgtttgcaggatggtgctattgtcaagtttgactag

SEQ ID NO: 21 - DNA, 1539 bp, Candida tropicalis
atgctcgatcagatcttacattactggtacattgtcttgccattgttggccattatcaaccagatcgtggctcatgtcaggaccaattatttgatgaagaaattgggtgctaagccattcacacacgtccaacgtgacgggtggttgggcttcaaattcggccgtgaattcctcaaagcaaaaagtgctgggagactggttgatttaatcatctcccgtttccacgataatgaggacactttctccagctatgcttttggcaaccatgtggtgttcaccagggaccccgagaatatcaaggcgcttttggcaacccagtttggtgatttttcattgggcagcagggtcaagttcttcaaaccattattggggtacggtatcttcacattggacgccgaaggctggaagcacagcagagccatgttgagaccacagtttgccagagaacaagttgctcatgtgacgtcgttggaaccacacttccagttgttgaagaagcatatccttaaacacaagggtgagtactttgatatccaggaattgttctttagatttactgtcgactcggccacggagttcttatttggtgagtccgtgcactccttaaaggacgaggaaattggctacgacacgaaagacatgtctgaagaaagacgcagatttgccgacgcgttcaacaagtcgcaagtctacgtggccaccagagttgctttacagaacttgtactggttggtcaacaacaaagagttcaaggagtgcaatgacattgtccacaagtttaccaactactatgttcagaaagccttggatgctaccccagaggaacttgaaaagcaaggcgggtatgtgttcttgtatgagcttgtcaagcagacgagagaccccaaggtgttgcgtgaccagtctttgaacatcttgttggcaggaagagacaccactgctgggttgttgtcctttgctgtgtttgagttggccagaaacccacacatctgggccaagttgagagaggaaattgaacagcagtttggtcttggagaagactctcgtgttgaagagattacctttgagagcttgaagagatgtgagtacttgaaggccgtgttgaacgaaactttgagattacacccaagtgtcccaagaaacgcaagatttgcgattaaagacacgactttaccaagaggcggtggccccaacggcaaggatcctatcttgatcaggaaggatgaggtggtgcagtactccatctcggcaactcagacaaatcctgcttattatggcgccgatgctgctgattttagaccggaaagatggtttgaaccatcaactagaaacttgggatgggctttcttgccattcaacggtggtccaagaatctgtttgggacaacagtttgctttgactgaagccggttacgttttggttagacttgttcaggagtttccaaacttgtcacaagaccccgaaaccaagtacccaccacctagattggcacacttgacgatgtgcttgtttgacggtgcacacgtcaagatgtcatag

SEQ ID NO: 22 - DNA, 1539 bp, Candida tropicalis
atgctcgaccagatcttccattactggtacattgtcttgccattgttggtcattatcaagcagatcgtggctcatgccaggaccaattatttgatgaagaagttgggcgctaagccattcacacatgtccaactagacgggtggtttggcttcaaatttggccgtgaattcctcaaagctaaaagtgctgggaggcaggttgatttaatcatctcccgtttccacgataatgaggacactttctccagctatgcttttggcaaccatgtggtgttcaccagggaccccgagaatatcaaggcgcttttggcaacccagtttggtgatttttcattgggaagcagggtcaaattcttcaaaccattgttggggtacggtatcttcaccttggacggcgaaggctggaagcacagcagagccatgttgagaccacagtttgccagagagcaagttgctcatgtgacgtcgttggaaccacatttccagttgttgaagaagcatattcttaagcacaagggtgaatactttgatatccaggaattgttctttagatttaccgttgattcagcgacggagttcttatttggtgagtccgtgcactccttaagggacgaggaaattggctacgatacgaaggacatggctgaagaaagacgcaaatttgccgacgcgttcaacaagtcgcaagtctatttgtccaccagagttgctttacagacattgtactggttggtcaacaacaaagagttcaaggagtgcaacgacattgtccacaagttcaccaactactatgttcagaaagccttggatgctaccccagaggaacttgaaaaacaaggcgggtatgtgttcttgtacgagcttgccaagcagacgaaagaccccaatgtgttgcgtgaccagtctttgaacatcttgttggctggaagggacaccactgctgggttgttgtcctttgctgtgtttgagttggccaggaacccacacatctgggccaagttgagagaggaaattgaatcacactttgggctgggtgaggactctcgtgttgaagagattacctttgagagcttgaagagatgtgagtacttgaaagccgtgttgaacgaaacgttgagattacacccaagtgtcccaagaaacgcaagatttgcgattaaagacacgactttaccaagaggcggtggccccaacggcaaggatcctatcttgatcagaaagaatgaggtggtgcaatactccatctcggcaactcagacaaatcctgcttattatggcgccgatgctgctgattttagaccggaaagatggtttgagccatcaactagaaacttgggatgggcttacttgccattcaacggtggtccaagaatctgcttgggacaacagtttgctttgaccgaagccggttacgttttggttagacttgttcaggaattccctagcttgtcacaggaccccgaaactgagtacccaccacctagattggcacacttgacgatgtgcttgtttgacggggcatacgtcaagatgcaatag

SEQ ID NO: 23 - DNA, 1500 bp, Candida tropicalis
atggctatatctagtttgctatcgtgggatgtgatctgtgtcgtcttcatttgcgtttgtgtttatttcgggtatgaatattgttatactaaatacttgatgcacaaacatggcgctcgagaaatcgagaatgtgatcaacgatgggttctttgggttccgcttacctttgctactcatgcgagccagcaatgagggccgacttatcgagttcagtgtcaagagattcgagtcggcgccacatccacagaacaagacattggtcaaccgggcattgagcgttcctgtgatactcaccaaggacccagtgaatatcaaagcgatgctatcgacccagtttgatgacttttcccttgggttgagactacaccagtttgcgccgttgttggggaaaggcatctttactttggacggcccagagtggaagcagagccgatctatgttgcgtccgcaatttgccaaagatcgggtttctcatatcctggatctagaaccgcattttgtgttgcttcggaagcacattgatggccacaatggagactacttcgacatccaggagctctacttccggttctcgatggatgtggcgacggggtttttgtttggcgagtctgtggggtcgttgaaagacgaagatgcgaggttcctggaagcattcaatgagtcgcagaagtatttggcaactagggcaacgttgcacgagttgtactttctttgtgacgggtttaggtttcgccagtacaacaaggttgtgcgaaagttctgcagccagtgtgtccacaaggcgttagatgttgcaccggaagacaccagcgagtacgtgtttctccgcgagttggtcaaacacactcgagatcccgttgttttacaagaccaagcgttgaacgtcttgcttgctggacgcgacaccaccgcgtcgttattatcgtttgcaacatttgagctagcccggaatgaccacatgtggaggaagctacgagaggaggttatcctgacgatgggaccgtccagtgatgaaataaccgtggccgggttgaagagttgccgttacctcaaagcaatcctaaacgaaactcttcgactatacccaagtgtgcctaggaacgcgagatttgctacgaggaatacgacgcttcctcgtggcggaggtccagatggatcgtttccgattttgataagaaagggccagccagtggggtatttcatttgtgctacacacttgaatgagaaggtatatgggaatgatagccatgtgtttcgaccggagagatgggctgcgttagagggcaagagtttgggctggtcgtatcttccattcaacggcggcccgagaagctgccttggtcagcagtttgcaatccttgaagcttcgtatgttttggctcgattgacacagtgctacacgacgatacagcttagaactaccgagtacccaccaaagaaactcgttcatctcacgatgagtcttctcaacggggtgtacatccgaactagaacttga

SEQ ID NO: 24 - DNA, 3150 bp, Bacillus megaterium
atgacaattaaagaaatgcctcagccaaaaacgtttggagagcttaaaaatttaccgttattaaacacagataaaccggttcaagctttgatgaaaattgcggatgaattaggagaaatctttaaattcgaggcgcctggtcgtgtaacgcgctacttatcaagtcagcgtctaattaaagaagcatgcgatgaatcacgctttgataaaaacttaagtcaagcgcttaaatttgtacgtgattttgcaggagacgggttatttacaagctggacgcatgaaaaaaattggaaaaaagcgcataatatcttacttccaagcttcagtcagcaggcaatgaaaggctatcatgcgatgatggtcgatatcgccgtgcagcttgttcaaaagtgggagcgtctaaatgcagatgagcatattgaagtaccggaagacatgacacgtttaacgcttgatacaattggtctttgcggctttaactatcgctttaacagcttttaccgagatcagcctcatccatttattacaagtatggtccgtgcactggatgaagcaatgaacaagctgcagcgagcaaatccagacgacccagcttatgatgaaaacaagcgccagtttcaagaagatatcaaggtgatgaacgacctagtagataaaattattgcagatcgcaaagcaagcggtgaacaaagcgatgatttattaacgcatatgctaaacggaaaagatccagaaacgggtgagccgcttgatgacgagaacattcgctatcaaattattacattcttaattgcgggacacgaaacaacaagtggtcttttatcatttgcgctgtatttcttagtgaaaaatccacatgtattacaaaaagcagcagaagaagcagcacgagttctagtagatcctgttccaagctacaaacaagtcaaacagcttaaatatgtcggcatggtcttaaacgaagcgctgcgcttatggccaactgctcctgcgttttccctatatgcaaaagaagatacggtgcttggaggagaatatcctttagaaaaaggcgacgaactaatggttctgattcctcagcttcaccgtgataaaacaatttggggagacgatgtggaagagttccgtccagagcgttttgaaaatccaagtgcgattccgcagcatgcgtttaaaccgtttggaaacggtcagcgtgcgtgtatcggtcagcagttcgctcttcatgaagcaacgctggtacttggtatgatgctaaaacactttgactttgaagatcatacaaactacgagctggatattaaagaaactttaacgttaaaacctgaaggctttgtggtaaaagcaaaatcgaaaaaaattccgcttggcggtattccttcacctagcactgaacagtctgctaaaaaagtacgcaaaaaggcagaaaacgctcataatacgccgctgcttgtgctatacggttcaaatatgggaacagctgaaggaacggcgcgtgatttagcagatattgcaatgagcaaaggatttgcaccgcaggtcgcaacgcttgattcacacgccggaaatcttccgcgcgaaggagctgtattaattgtaacggcgtcttataacggtcatccgcctgataacgcaaagcaatttgtcgactggttagaccaagcgtctgctgatgaagtaaaaggcgttcgctactccgtatttggatgcggcgataaaaactgggctactacgtatcaaaaagtgcctgcttttatcgatgaaacgcttgccgctaaaggggcagaaaacatcgctgaccgcggtgaagcagatgcaagcgacgactttgaaggcacatatgaagaatggcgtgaacatatgtggagtgacgtagcagcctactttaacctcgacattgaaaacagtgaagataataaatctactctttcacttcaatttgtcgacagcgccgcggatatgccgcttgcgaaaatgcacggtgcgttttcaacgaacgtcgtagcaagcaaagaacttcaacagccaggcagtgcacgaagcacgcgacatcttgaaattgaacttccaaaagaagcttcttatcaagaaggagatcatttaggtgttattcctcgcaactatgaaggaatagtaaaccgtgtaacagcaaggttcggcctagatgcatcacagcaaatccgtctggaagcagaagaagaaaaattagctcatttgccactcgctaaaacagtatccgtagaagagcttctgcaatacgtggagcttcaagatcctgttacgcgcacgcagcttcgcgcaatggctgctaaaacggtctgcccgccgcataaagtagagcttgaagccttgcttgaaaagcaagcctacaaagaacaagtgctggcaaaacgtttaacaatgcttgaactgcttgaaaaatacccggcgtgtgaaatgaaattcagcgaatttatcgcccttctgccaagcatacgcccgcgctattactcgatttcttcatcacctcgtgtcgatgaaaaacaagcaagcatcacggtcagcgttgtctcaggagaagcgtggagcggatatggagaatataaaggaattgcgtcgaactatcttgccgagctgcaagaaggagatacgattacgtgctttatttccacaccgcagtcagaatttacgctgccaaaagaccctgaaacgccgcttatcatggtcggaccgggaacaggcgtcgcgccgtttagaggctttgtgcaggcgcgcaaacagctaaaagaacaaggacagtcacttggagaagcacatttatacttcggctgccgttcacctcatgaagactatctgtatcaagaagagcttgaaaacgcccaaagcgaaggcatcattacgcttcataccgctttttctcgcatgccaaatcagccgaaaacatacgttcagcacgtaatggaacaagacggcaagaaattgattgaacttcttgatcaaggagcgcacttctatatttgcggagacggaagccaaatggcacctgccgttgaagcaacgcttatgaaaagctatgctgacgttcaccaagtgagtgaagcagacgctcgcttatggctgcagcagctagaagaaaaaggccgatacgcaaaagacgtgtgggctgggtaa

SEQ ID NO: 25 - DNA, 2043 bp, Candida tropicalis
atggcattagataagttagatttatatgttattataacattggtggttgcaattgcagcttattttgcaaagaatcagtttcttgaccaacaacaagataccgggttccttaatactgatagtggagatggtaattcaagagatatcttacaagctttgaagaagaacaataaaaatacgttattattatttggatcccaaacaggtacagcagaagattatgccaacaaattgtcaagagaattgcattcaagatttggtttgaaaaccatggttgctgatttcgctgattatgatttcgaaaacttcggagatattactgaagatatcttggttttctttattgttgctacttatggtgaaggtgaaccaaccgataatgctgacgaatttcacacttggttgactgaagaagctgacaccttgagtactttgaaatatactgtttttggtttgggtaattcaacttatgaattcttcaatgctattggtagaaaatttgacagattgttgggagaaaaaggtggtgacagatttgctgaatacggtgaaggtgacgatggtactggtactttagatgaagatttcttggcctggaaggataacgtgtttgattccttaaagaatgatttgaattttgaagaaaaagagttgaaatacgaaccaaatgttaaattgactgaaagagatgatttatctggcaatgatccagatgtctccttgggtgaaccaaatgtcaaatacattaaatctgaaggtgttgacttaactaaaggtccatttgatcatactcatccatttttggctagaattgttaaaactaaagaattgtttacttctgaagacagacattgtgttcatgttgaatttgatatttctgaatcaaacttgaaatataccaccggtgatcatcttgcaatctggccatctaactctgatgaaaacattaagcaatttgccaaatgttttggtttagaagacaaacttgatactgttattgaattgaaagctttggattccacttattccatcccattccctaatccaatcacttatggagctgttattagacaccatttggaaatttcaggtcctgtttctagacaatttttcttatctattgctggatttgcccctgatgaagaaactaaaaagtcatttactagaattggtggtgataagcaagaatttgctagtaaagtcacccgtagaaaattcaacattgccgatgctttattatttgcttccaacaacagaccatggtccgatgttccattcgaattccttattgaaaatgtccaacacttaactcctcgttattactccatttcttcttcctcattaagtgaaaagcaaaccattaatgttactgctgttgttgaagccgaagaagaagctgatggaagaccagttactggtgttgtcaccaacttgttgaagaatattgaaattgaacaaaacaaaactggtgaaaccccaatggttcattatgatttgaatggtccaagaggcaaatttagcaagttcagattgccagttcacgttagaagatctaatttcaaattaccaaagaatagcactaccccagttattttgattggtccaggtaccggtgttgcaccattgagaggttttgttagagaaagagttcaacaagttaaaaatggtgttaatgttggtaagactgtattgttttatggatgtagaaattccgaacaagatttcttgtacaaacaagaatggagtgaatatgcctcagtattgggagaaaatttcgaaatgtttaatgccttctcaagacaagatccaactaagaaagtttatgttcaagataagattttagaaaatagtgctcttgttgatgagttattatctagtggagcaattatttatgtttgtggtgatgccagtagaatggctagagatgttcaagctgcaattgccaagattgttgccaaaagtagagatatccacgaagataaagctgctgaattggttaaatcttggaaagttcaaaatagataccaagaagatgtctggtaa

SEQ ID NO: 26 - DNA, 2040 bp, Candida tropicalis
atggctttagacaagttagatttgtatgtcatcataacattggtggtcgctgtagccgcctattttgctaagaaccagttccttgatcagccccaggacaccgggttcctcaacacggacagcggaagcaactccagagacgtcttgctgacattgaagaagaataataaaaacacgttgttgttgtttgggtcccagacgggtacggcagaagattacgccaacaaattgtccagagaattgcactccagatttggcttgaaaacgatggttgcagatttcgctgattacgattgggataacttcggagatatcaccgaagacatcttggtgtttttcattgttgccacctatggtgagggtgaacctaccgataatgccgacgagttccacacctggttgactgaagaagctgacactttgagtaccttgaaatacaccgtgttcgggttgggtaactccacgtacgagttcttcaatgccattggtagaaagtttgacagattgttgagcgagaaaggtggtgacaggtttgctgaatacgctgaaggtgatgacggtactggcaccttggacgaagatttcatggcctggaaggacaatgtctttgacgccttgaagaatgatttgaactttgaagaaaaggaattgaagtacgaaccaaacgtgaaattgactgagagagacgacttgtctgctgctgactcccaagtttccttgggtgagccaaacaagaagtacatcaactccgagggcatcgacttgaccaagggtccattcgaccacacccacccatacttggccagaatcaccgagacgagagagttgttcagctccaaggacagacactgtatccacgttgaatttgacatttctgaatcgaacttgaaatacaccaccggtgaccatctagctatctggccatccaactccgacgaaaacattaagcaatttgccaagtgtttcggattggaagataaactcgacactgttattgaattgaaggcgttggactccacttacaccatcccattcccaaccccaattacctacggtgctgtcattagacaccatttagaaatctccggtccagtctcgagacaattctttttgtcaattgctgggtttgctcctgatgaagaaacaaagaaggcttttaccagacttggtggtgacaagcaagaattcgccgccaaggtcacccgcagaaagttcaacattgccgatgccttgttatattcctccaacaacgctccatggtccgatgttccttttgaattccttattgaaaacgttccacacttgactccacgttactactccatttcgtcttcgtcattgagtgaaaagcaactcatcaacgttactgcagttgttgaagccgaagaagaagctgatggcagaccagtcactggtgttgtcaccaacttgttgaagaacgttgaaattgtgcaaaacaagactggcgaaaagccacttgtccactacgatttgagcggcccaagaggcaagttcaacaagttcaagttgccagtgcatgtgagaagatccaactttaagttgccaaagaactccaccaccccagttatcttgattggtccaggtactggtgttgccccattgagaggttttgtcagagaaagagttcaacaagtcaagaatggtgtcaatgttggcaagactttgttgttttatggttgcagaaactccaacgaggactttttgtacaagcaagaatgggccgagtacgcttctgttttgggtgaaaactttgagatgttcaatgccttctccagacaagacccatccaagaaggtttacgtccaggataagattttagaaaacagccaacttgtgcacgagttgttgactgaaggtgccattatctacgtctgtggtgatgccagtagaatggctagagacgtgcagaccacaatttccaagattgttgctaaaagcagagaaattagtgaagacaaggctgctgaattggtcaagtcctggaaggtccaaaatagataccaagaagatgtttggtag

SEQ ID NO: 27 - DNA, 2040 bp, Candida tropicalis
atggctttagacaagttagatttgtatgtcatcataacattggtggtcgctgtggccgcctattttgctaagaaccagttccttgatcagccccaggacaccgggttcctcaacacggacagcggaagcaactccagagacgtcttgctgacattgaagaagaataataaaaacacgttgttgttgtttgggtcccagaccggtacggcagaagattacgccaacaaattgtcaagagaattgcactccagatttggcttgaaaaccatggttgcagatttcgctgattacgattgggataacttcggagatatcaccgaagatatcttggtgtttttcatcgttgccacctacggtgagggtgaacctaccgacaatgccgacgagttccacacctggttgactgaagaagctgacactttgagtactttgagatataccgtgttcgggttgggtaactccacctacgagttcttcaatgctattggtagaaagtttgacagattgttgagtgagaaaggtggtgacagatttgctgaatatgctgaaggtgacgacggcactggcaccttggacgaagatttcatggcctggaaggataatgtctttgacgccttgaagaatgacttgaactttgaagaaaaggaattgaagtacgaaccaaacgtgaaattgactgagagagatgacttgtctgctgccgactcccaagtttccttgggtgagccaaacaagaagtacatcaactccgagggcatcgacttgaccaagggtccattcgaccacacccacccatacttggccaggatcaccgagaccagagagttgttcagctccaaggaaagacactgtattcacgttgaatttgacatttctgaatcgaacttgaaatacaccaccggtgaccatctagccatctggccatccaactccgacgaaaacatcaagcaatttgccaagtgtttcggattggaagataaactcgacactgttattgaattgaaggcattggactccacttacaccattccattcccaactccaattacttacggtgctgtcattagacaccatttagaaatctccggtccagtctcgagacaattctttttgtcgattgctgggtttgctcctgatgaagaaacaaagaagactttcaccagacttggtggtgacaaacaagaattcgccaccaaggttacccgcagaaagttcaacattgccgatgccttgttatattcctccaacaacactccatggtccgatgttccttttgagttccttattgaaaacatccaacacttgactccacgttactactccatttcttcttcgtcgttgagtgaaaaacaactcatcaatgttactgcagtcgttgaggccgaagaagaagccgatggcagaccagtcactggtgttgttaccaacttgttgaagaacattgaaattgcgcaaaacaagactggcgaaaagccacttgttcactacgatttgagcggcccaagaggcaagttcaacaagttcaagttgccagtgcacgtgagaagatccaactttaagttgccaaagaactccaccaccccagttatcttgattggtccaggtactggtgttgccccattgagaggtttcgttagagaaagagttcaacaagtcaagaatggtgtcaatgttggcaagactttgttgttttatggttgcagaaactccaacgaggactttttgtacaagcaagaatgggccgagtacgcttctgttttgggtgaaaactttgagatgttcaatgccttctctagacaagacccatccaagaaggtttacgtccaggataagattttagaaaacagccaacttgtgcacgaattgttgaccgaaggtgccattatctacgtctgtggtgacgccagtagaatggccagagacgtccagaccacgatctccaagattgttgccaaaagcagagaaatcagtgaagacaaggccgctgaattggtcaagtcctggaaagtccaaaatagataccaagaagatgtttggtag

SEQ ID NO: 28 - protein, 1049 aa, Bacillus megaterium
MTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRASDEAMNKSQRANPDDPAYDENKRQFQEDIKVMNDLVDKIIADRKASGEQSDDLLTHMLNGKDPETGEPLDDENIRYQIITFLIAGHETTSGLLSFASYFLVKNPHVLQKAAEEAARVLVDPVPSYKQVKQLKYVGMVLNEASRLWPTAPAFSLYAKEDTVLGGEYPLEKGDELMVSIPQLHRDKTIWGDDVEEFRPERFENPSAIPQHAFKPFGNGQRACIGQQFALHEATSVLGMMLKHFDFEDHTNYESDIKETLTLKPEGFVVKAKSKKIPLGGIPSPSTEQSAKKVRKKAENAHNTPSLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRSEAEEEKLAHLPLAKTVSVEELSQYVELQDPVTRTQLRAMAAKTVCPPHKVELEALLEKQAYKEQVSAKRLTMLESLEKYPACEMKFSEFIALSPSIRPRYYSISSSPRVDEKQASITVSVVSGEAWSGYGEYKGIASNYLAESQEGDTITCFISTPQSEFTSPKDPETPLIMVGPGTGVAPFRGFVQARKQLKEQGQSLGEAHLYFGCRSPHEDYSYQEELENAQSEGIITLHTAFSRMPNQPKTYVQHVMEQDGKKLIELLDQGAHFYICGDGSQMAPAVEATLMKSYADVHQVSEADARLWSQQLEEKGRYAKDVWAG

SEQ ID NO: 29 - DNA, 2130 bp, Candida tropicalis
atgacttttacaaagaaaaacgttagtgtatcacaaggtcctgaccctagatcatccatccaaaaggaaagagacagctccaaatggaaccctcaacaaatgaactacttcttggaaggctccgtcgaaagaagtgagttgatgaaggctttggcccaacaaatggaaagagacccaatcttgttcacagacggctcctactacgacttgaccaaggaccaacaaagagaattgaccgccgtcaagatcaacagaatcgccagatacagagaacaagaatccatcgacactttcaacaagagattgtccttgattggtatctttgacccacaggtcggtaccagaattggtgtcaacctcggtttgttcctttcttgtatcagaggtaacggtaccacttcccaattgaactactgggctaacgaaaaggaaaccgctgacgttaaaggtatctacggttgtttcggtatgaccgaattggcccacggttccaacgttgctggtttggaaaccaccgccacatttgacaaggaatctgacgagtttgtcatcaacaccccacacattggtgccaccaagtggtggattggtggtgctgctcactccgccacccactgttctgtctacgccagattgattgttgacggtcaagattacggtgtcaagacttttgttgtcccattgagagactccaaccacgacctcatgccaggtgtcactgttggtgacattggtgccaagatgggtagagatggtatcgataacggttggatccaattctccaacgtcagaatcccaagattctttatgttgcaaaagttctgtaaggtttctgctgaaggtgaagtcaccttgccacctttggaacaattgtcttactccgccttgttgggtggtagagtcatgatggttttggactcctacagaatgttggctagaatgtccaccattgccttgagatacgccattggtagaagacaattcaagggtgacaatgtcgatccaaaagatccaaacgctttggaaacccaattgatagattacccattgcaccaaaagagattgttcccatacttggctgctgcctacgtcatctccgctggtgccctcaaggttgaagacaccatccataacaccttggctgaattggacgctgccgttgaaaagaacgacaccaaggctatctttaagtctattgacgacatgaagtcattgtttgttgactctggttccttgaagtccactgccacttggttgggtgctgaagccattgaccaatgtagacaagcctgtggtggtcacggttactcgtcctacaacggcttcggtaaagcctacaacgattgggttgtccaatgtacttgggaaggtgacaacaatgtcttggccatgagtgttggtaagccaattgtcaagcaagttatcagcattgaagatgccggcaagaccgtcagaggttccaccgctttcttgaaccaattgaaggactacactggttccaacagctccaaggttgttttgaacactgttgctgacttggacgacatcaagactgtcatcaaggctattgaagttgccatcatcagattgtcccaagaagctgcttctattgtcaagaaggaatctttcgactatgtcggcgctgaattggttcaactctccaagttgaaggctcaccactacttgttgactgaatacatcagaagaattgacacctttgaccaaaaggacttggttccatacttgatcaccctcggtaagttgtacgctgccactattgtcttggacagatttgccggtgtcttcttgactttcaacgttgcctccaccgaagccatcactgctttggcctctgtgcaaattccaaagttgtgtgctgaagtcagaccaaacgttgttgcttacaccgactccttccaacaatccgacatgattgtcaattctgctattggtagatacgatggtgacatctatgagaactactttgacttggtcaagttgcagaacccaccatccaagaccaaggctccttactctgatgctttggaagccatgttgaacagaccaaccttggacgaaagagaaagatttgaaaagtctgatgaaaccgctgctatcttgtccaagtaa

SEQ ID NO: 30 - protein, 709 aa, Candida tropicalis
MTFTKKNVSVSQGPDPRSSIQKERDSSKWNPQQMNYFLEGSVERSELMKALAQQMERDPILFTDGSYYDLTKDQQRELTAVKINRIARYREQESIDTFNKRLSLIGIFDPQVGTRIGVNLGLFLSCIRGNGTTSQLNYWANEKETADVKGIYGCFGMTELAHGSNVAGLETTATFDKESDEFVINTPHIGATKWWIGGAAHSATHCSVYARLIVDGQDYGVKTFVVPLRDSNHDLMPGVTVGDIGAKMGRDGIDNGWIQFSNVRIPRFFMLQKFCKVSAEGEVTLPPLEQLSYSALLGGRVMMVLDSYRMLARMSTIALRYAIGRRQFKGDNVDPKDPNALETQLIDYPLHQKRLFPYLAAAYVISAGALKVEDTIHNTLAELDAAVEKNDTKAIFKSIDDMKSLFVDSGSLKSTATWLGAEAIDQCRQACGGHGYSSYNGFGKAYNDWVVQCTWEGDNNVLAMSVGKPIVKQVISIEDAGKTVRGSTAFLNQLKDYTGSNSSKVVLNTVADLDDIKTVIKAIEVAIIRLSQEAASIVKKESFDYVGAELVQLSKLKAHHYLLTEYIRRIDTFDQKDLVPYLITLGKLYAATIVLDRFAGVFLTFNVASTEAITALASVQIPKLCAEVRPNVVAYTDSFQQSDMIVNSAIGRYDGDIYENYFDLVKLQNPPSKTKAPYSDALEAMLNRPTLDERERFEKSDETAAILSK

SEQ ID NO: 31 - DNA, 1989 bp, Candida tropicalis
atgcctaccgaacttcaaaaagaaagagaactcaccaagttcaacccaaaggagttgaactacttcttggaaggttcccaagaaagatccgagatcatcagcaacatggtcgaacaaatgcaaaaagaccctatcttgaaggtcgacgcttcatactacaacttgaccaaagaccaacaaagagaagtcaccgccaagaagattgccagactctccagatactttgagcacgagtacccagaccaacaggcccagagattgtcgatcctcggtgtctttgacccacaagtcttcaccagaatcggtgtcaacttgggtttgtttgtttcctgtgtccgtggtaacggtaccaactcccagttcttctactggaccataaataagggtatcgacaagttgagaggtatctatggttgttttggtatgactgagttggcccacggttccaacgtccaaggtattgaaaccaccgccacttttgacgaagacactgacgagtttgtcatcaacaccccacacattggtgccaccaagtggtggatcggtggtgctgcgcactccgccacccactgctccgtctacgccagattgaaggtcaaaggaaaggactacggtgtcaagacctttgttgtcccattgagagactccaaccacgacctcgagccaggtgtgactgttggtgacattggtgccaagatgggtagagacggtatcgataacggttggatccagttctccaacgtcagaatcccaagattctttatgttgcaaaagtactgtaaggtttcccgtctgggtgaagtcaccatgccaccatctgaacaattgtcttactcggctttgattggtggtagagtcaccatgatgatggactcctacagaatgaccagtagattcatcaccattgccttgagatacgccatccacagaagacaattcaagaagaaggacaccgataccattgaaaccaagttgattgactacccattgcatcaaaagagattgttcccattcttggctgccgcttacttgttctcccaaggtgccttgtacttagaacaaaccatgaacgcaaccaacgacaagttggacgaagctgtcagtgctggtgaaaaggaagccattgacgctgccattgtcgaatccaagaaattgttcgtcgcttccggttgtttgaagtccacctgtacctggttgactgctgaagccattgacgaagctcgtcaagcttgtggtggtcacggttactcgtcttacaacggtttcggtaaagcctactccgactgggttgtccaatgtacctgggaaggtgacaacaacatcttggccatgaacgttgccaagccaatggttagagacttgttgaaggagccagaacaaaagggattggttctctccagcgttgccgacttggacgacccagccaagttggttaaggctttcgaccacgccctttccggcttggccagagacattggtgctgttgctgaagacaagggtttcgacattaccggtccaagtttggttttggtttccaagttgaacgctcacagattcttgattgacggtttcttcaagcgtatcaccccagaatggtctgaagtcttgagacctttgggtttcttgtatgccgactggatcttgaccaactttggtgccaccttcttgcagtacggtatcattaccccagatgtcagcagaaagatttcctccgagcacttcccagccttgtgtgccaaggttagaccaaacgttgttggtttgactgatggtttcaacttgactgacatgatgaccaatgctgctattggtagatatgatggtaacgtctacgaacactacttcgaaactgtcaaggctttgaacccaccagaaaacaccaaggctccatactccaaggctttggaagacatgttgaaccgtccagaccttgaagtcagagaaagaggtgaaaagtccgaagaagctgctgaaatcttgtccagttaa

SEQ ID NO: 32 - protein, 662 aa, Candida tropicalis
MPTELQKERELTKFNPKELNYFLEGSQERSEIISNMVEQMQKDPILKVDASYYNLTKDQQREVTAKKIARLSRYFEHEYPDQQAQRLSILGVFDPQVFTRIGVNLGLFVSCVRGNGTNSQFFYWTINKGIDKLRGIYGCFGMTELAHGSNVQGIETTATFDEDTDEFVINTPHIGATKWWIGGAAHSATHCSVYARLKVKGKDYGVKTFVVPLRDSNHDLEPGVTVGDIGAKMGRDGIDNGWIQFSNVRIPRFFMLQKYCKVSRSGEVTMPPSEQLSYSALIGGRVTMMMDSYRMTSRFITIALRYAIHRRQFKKKDTDTIETKLIDYPLHQKRLFPFLAAAYLFSQGALYLEQTMNATNDKLDEAVSAGEKEAIDAAIVESKKLFVASGCLKSTCTWLTAEAIDEARQACGGHGYSSYNGFGKAYSDWVVQCTWEGDNNILAMNVAKPMVRDLLKEPEQKGLVLSSVADLDDPAKLVKAFDHALSGLARDIGAVAEDKGFDITGPSLVLVSKLNAHRFLIDGFFKRITPEWSEVLRPLGFLYADWILTNFGATFLQYGIITPDVSRKISSEHFPALCAKVRPNVVGLTDGFNLTDMMTNAAIGRYDGNVYEHYFETVKALNPPENTKAPYSKALEDMLNRPDLEVRERGEKSEEAAEILSS

SEQ ID NO: 33 - DNA, 1530 bp, Candida viswanathii
  Candida ATACC strain 20336
atgatcagaaccgtccgttatcaatccctcaagaggttcagacctctggctttgtctcctgtttttcgtccacgctacaactcccagaaggccaatttccaccgtccagaccaccctgggtccgacgagccagctgaagccgccgacgccgccgccacgatcctcgccgagttgcgagacaagcagacgaacccgaacaaggccacctggctcgatgcgttaacggagcgggagaagttgcgtgccgagggcaagacgattgacagtttcagctacgttgaccccaagacgaccgtcgtgggggagaagacacgcagtgactcgttctcgttcttgttgttgccgttcaaggacgacaagtggttgtgtgacgcgtacatcaatgcgtttggccggttgcgtgtagcgcagttgttccaggacttggacgccttggcggggcgcatcgcgtacaggcactgttccccagcggagcccgtgaatgtcacggcgagcgtggatagggtgtacatggtgaagaaagtggacgagattaacaattacaatttcgtgttggcggggtccgtgacgtggaccgggagatcgtcgatggagatcacggtgaaagggtatgcttttgaagacgccgtgccggatataacgaacgaggagtccttgccggcagagaatgtgtttttggctgctaatttcaccttcgtggcacggaacccacttacacacaagtcctttgctattaacagattgttgcccgtgactgagaaggactgggtcgactatcgccgtgctgagtcccacaacgccaagaagaagttgatggcaaagaacaagaagatcttggagcctaccgcggaagagtccaagttgatctacgacatgtggagatcgtccaagtccttacagaacatcgagagggccaacgatgggatcgcgttcatgaaggacacgaccatgaagtccaccttgttcatgcagccccagtaccgtaacagacactcatacatgattttcggagggtacttgttaagacaaactttcgaattggcctactgtaccgcggcaacgttttccctggccgggccccgtttcgtcagcttggactccaccacgttcaagaaccccgtgcccgtggggtcggtgctcaccatggactcgtcgatctcgtacacggagcacgtgcacgagggagtggaggagattgacgcggactcaccgttcaacttcagcttgcctgccacgaacaagatctcgaagaaccccgaggcgttcttgtcggaacccggcacgttgattcaagtcaaggtcgacacatacatccaggagttagagcagagtgtgaagaagcccgcgggtacgttcatctactcgttctatgttgataaagaaagcgttactgttgatggaaaggcgtcgttttgttcagttatcccgcagacgtactccgagatgatgacttatgtgggcgggagaagaagagcccaggatactgctaactacgtggagactttgccgtttagtggaagcggcaattaa

SEQ ID NO: 34 - protein, 509 aa, Candida viswanathii
  Candida ATACC strain 20336
MIRTVRYQSLKRFRPSALSPVFRPRYNSQKANFHRPDHPGSDEPAEAADAAATILAELRDKQTNPNKATWLDALTEREKLRAEGKTIDSFSYVDPKTTVVGEKTRSDSFSFLLLPFKDDKWLCDAYINAFGRLRVAQLFQDLDALAGRIAYRHCSPAEPVNVTASVDRVYMVKKVDEINNYNFVLAGSVTWTGRSSMEITVKGYAFEDAVPDITNEESLPAENVFLAANFTFVARNPLTHKSFAINRLLPVTEKDWVDYRRAESHNAKKKLMAKNKKILEPTAEESKLIYDMWRSSKSLQNIERANDGIAFMKDTTMKSTLFMQPQYRNRHSYMIFGGYLLRQTFELAYCTAATFSSAGPRFVSLDSTTFKNPVPVGSVLTMDSSISYTEHVHEGVEEIDADSPFNFSLPATNKISKNPEAFLSEPGTLIQVKVDTYIQELEQSVKKPAGTFIYSFYVDKESVTVDGKASFCSVIPQTYSEMMTYVGGRRRAQDTANYVETLPFSGSGN

SEQ ID NO: 35 - DNA, 1530 bp, Candida viswanathii
  Candida ATACC strain 20336
atgatcagaaccgtccgttatcaatccttcaagaggttcaaacctctgactttatcccccgttttccgtccacgctacaactcccagaaggccaatttccaccgtccagaccacgctgggtccgacgagccagccgaagccgccgacgccgctgccacgatcctcgccgagttgcgagacaagcagacgaacccgaacaaggccacctggctcgatgcgttaacggagcgggagaagttgcgtgccgagggcaagacaatcgacagcttcagctacgttgaccccaagacaaccgtcgtgggggagaagacacgcagcgactcgttctcgttcttgttgttgccgttcaaggacgacaagtggttgtgtgacgcgtacatcaatgcgtttggccggttgcgtgtagcgcagttgttccaggacttggacgccttggcgggccgcatcgcgtacaggcactgttcccccgctgagcccgtgaatgtcacggcgagcgtggatagagtgtatatggtgaagaaagtggacgagattaataattacaatttcgtgttggcggggtccgtgacgtggaccgggagatcgtcgatggagatcacggtcaaagggtatgcttttgaagacgccgtgccggagataactaacgaggagtccttgccggcagagaatgtgttcttggctgttaatttcaccttcgtggcacgtaacccactcacacacaagtccttcgctattaacagattgttgcccgtgactgagaaggactgggtcgattatcgccgtgctgagtcccacaacgccaagaagaagttgatggcaaagaacaagaagatcttggagcctaccccggaagagtccaagttgatctacgacatgtggagatcgtccaagtccttacagaacatcgagaaggccaacgacgggatcgcgttcatgaaggacacgataatgaagtccaccttgttcatgcagccccagtaccgtaacagacactcatacatgattttcggtgggtatttgttaagacaaactttcgaattggcctattgtaccgcagcaacgttttccctggcgggaccccgtttcgtcagcttggactccaccacgttcaagaaccccgtgcccgtggggtcggtgctcaccatggactcgtcgatctcgtacacggagcacgtccacgatggcgttgaggagattgacgccgactccccgttcaacttcagcttgcctgccacgaacaagatctcgaagaaccccgaggcgttcttgtcggagcccggcacgttgatccaagtcaaggtcgacacgtacatccaggagttagagcaaagtgtgaagaagcctgcgggaacgttcatctactcgttctatgttgataaagagagcgttactgtggatggaaaggcgtcgttttgttcagttatcccgcagacgtactccgagatgatgacttatgtgggcgggagaagaagagcccaggatactgctaattacgtggagactttgccgtttagtggaagcggcaattaa

SEQ ID NO: 36 - protein, 509 aa, Candida viswanathii
  Candida ATACC strain 20336
MIRTVRYQSFKRFKPLTLSPVFRPRYNSQKANFHRPDHAGSDEPAEAADAAATILAELRDKQTNPNKATWLDALTEREKLRAEGKTIDSFSYVDPKTTVVGEKTRSDSFSFLLLPFKDDKWLCDAYINAFGRLRVAQLFQDLDALAGRIAYRHCSPAEPVNVTASVDRVYMVKKVDEINNYNFVLAGSVTWTGRSSMEITVKGYAFEDAVPEITNEESLPAENVFLAVNFTFVARNPLTHKSFAINRLLPVTEKDWVDYRRAESHNAKKKLMAKNKKILEPTPEESKLIYDMWRSSKSLQNIEKANDGIAFMKDTIMKSTLFMQPQYRNRHSYMIFGGYLLRQTFELAYCTAATFSLAGPRFVSLDSTTFKNPVPVGSVLTMDSSISYTEHVHDGVEEIDADSPFNFSLPATNKISKNPEAFLSEPGTLIQVKVDTYIQELEQSVKKPAGTFIYSFYVDKESVTVDGKASFCSVIPQTYSEMMTYVGGRRRAQDTANYVETLPFSGSGN

SEQ ID NO: 37 - DNA, 552 bp, Escherichia coli
atggccgatacattgctcatcttgggtgactctttgtctgcagggtatcggatgtccgcatctgccgcatggcctgcactcctcaatgacaaatggcaaagcaagacatcggtcgtgaatgcatctatctctggcgatacctcgcagcaggggttggcccgtctcccagccttgttgaagcaacatcaaccacgttgggtcttggtcgaattgggcggcaatgatggtctcagaggttttcaacctcaacagaccgagcagacattgcgtcaaatcctccaagacgtgaaggcagcaaacgccgaacctctcttgatgcagataagattgcctgccaactatggtcgtagatacaatgaagccttttctgcaatctacccgaagcttgcaaaggagtttgacgtcccattgttgccgtttttgatggaagaggtgtaccttaagcctcagtggatgcaagacgatggtatccatccgaaccgtgatgcacaaccattcatcgcagattggatggccaaacaactccaacctttggtcaatcatgatagctaa

SEQ ID NO: 38 - protein, 183 aa, Escherichia coli
MADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFLMEEVYLKPQWMQDDGIHPNRDAQPFIADWMAKQLQPLVNHDS

SEQ ID NO: 39 - DNA, 2091 bp, Candida viswanathii
  Candida ATACC strain 20336
atgggtgcccctttaacagtcgccgttggcgaagcaaaaccaggcgaaaccgctccaagaagaaaagccgctcaaaaaatggcctctgtcgaacgcccaacagactcaaaggcaaccactttgccagacttcattgaagagtgttttgccagaaacggcaccagagatgccatggcctggagagacttggtcgaaatccacgtcgaaaccaaacaggttaccaaaatcattgacggcgaacagaaaaaggtcgataaggactggatctactacgaaatgggtccttacaactacatatcctaccccaagttgttgacgttggtcaagaactactccaagggtttgttggagttgggcttggccccagatcaagaatccaagttgatgatctttgccagtacctcccacaagtggatgcagaccttcttagcctccagtttccaaggtatccccgttgtcaccgcctacgacaccttgggtgagtcgggcttgacccactccttggtgcaaaccgaatccgatgccgtgttcaccgacaaccaattgttgtcctccttgattcgtcctttggagaaggccacctccgtcaagtatgtcatccacggggaaaagattgaccctaacgacaagagacagggcggcaaaatctaccaggatgcggaaaaggccaaggagaagattttacaaattagaccagatattaaatttatttctttcgacgaggttgttgcattgggtgaacaatcgtccaaagaattgcatttcccaaaaccagaagacccaatctgtatcatgtacacctcgggttccaccggtgctccaaagggtgtggttatcaccaatgccaacattgttgccgccgtgggtggtatctccaccaatgctactagagacttggttagaactgtcgacagagtgattgcatttttgccattggcccacattttcgagttggcctttgagttggttaccttctggtggggggctccattgggttacgccaatgtcaagactttgaccgaagcctcctgcagaaactgtcagccagacttgattgaattcaaaccaaccatcatggttggtgttgctgccgtttgggaatcggtcagaaagggtgtcttgtctaaattgaaacaggcttctccaatccaacaaaagatcttctgggctgcattcaatgccaagtctactttgaaccgttatggcttgccaggcggtgggttgtttgacgctgtcttcaagaaggttaaagccgccactggtggccaattgcgttatgtgttgaatggtgggtccccaatctctgttgatgcccaagtgtttatctccaccttgcttgcgccaatgttgttgggttacggtttgactgaaacctgtgccaataccaccattgtcgaacacacgcgcttccagattggtactttgggtaccttggttggatctgtcactgccaagttggttgatgttgctgatgctggatactacgccaagaacaaccagggtgaaatctggttgaaaggcggtccagttgtcaaggaatactacaagaacgaagaagaaaccaaggctgcattcaccgaagatggctggttcaagactggtgatattggtgaatggaccgccgacggtggtttgaacatcattgaccgtaagaagaacttggtcaagactttgaatggtgaatacattgctttggagaaattggaaagtatttacagatccaaccacttgattttgaacttgtgtgtttacgctgaccaaaccaaggtcaagccaattgctattgtcttgccaattgaagccaacttgaagtctatgttgaaggacgaaaagattatcccagatgctgattcacaagaattgagcagcttggttcacaacaagaaggttgcccaagctgtcttgagacacttgctccaaaccggtaaacaacaaggtttgaaaggtattgaattgttgcagaatgttgtcttgttggatgacgagtggaccccacagaatggttttgttacttctgcccaaaagttgcagagaaagaagattttagaaagttgtaaaaaagaagttgaagaggcatacaagtcgtcttag

SEQ ID NO: 40 - protein, 696 aa, Candida viswanathii
  Candida ATACC strain 20336
MGAPLTVAVGEAKPGETAPRRKAAQKMASVERPTDSKATTLPDFIEECFARNGTRDAMAWRDLVEIHVETKQVTKIIDGEQKKVDKDWIYYEMGPYNYISYPKLLTLVKNYSKGLLELGLAPDQESKLMIFASTSHKWMQTFLASSFQGIPVVTAYDTLGESGLTHSLVQTESDAVFTDNQLLSSLIRPLEKATSVKYVIHGEKIDPNDKRQGGKIYQDAEKAKEKILQIRPDIKFISFDEVVALGEQSSKELHFPKPEDPICIMYTSGSTGAPKGVVITNANIVAAVGGISTNATRDLVRTVDRVIAFLPLAHIFELAFELVTFWWGAPLGYANVKTLTEASCRNCQPDLIEFKPTIMVGVAAVWESVRKGVLSKLKQASPIQQKIFWAAFNAKSTLNRYGLPGGGLFDAVFKKVKAATGGQLRYVLNGGSPISVDAQVFISTLLAPMLLGYGLTETCANTTIVEHTRFQIGTLGTLVGSVTAKLVDVADAGYYAKNNQGEIWLKGGPVVKEYYKNEEETKAAFTEDGWFKTGDIGEWTADGGLNIIDRKKNLVKTLNGEYIALEKLESIYRSNHLILNLCVYADQTKVKPIAIVLPIEANLKSMLKDEKIIPDADSQELSSLVHNKKVAQAVLRHLLQTGKQQGLKGIELLQNVVLLDDEWTPQNGFVTSAQKLQRKKILESCKKEVEEAYKSS

SEQ ID NO: 41 - DNA, 1950 bp, Candida viswanathii
  Candida ATACC strain 20336
atgtcaggattagaaatagccgctgctgccatccttggtagtcagttattggaagccaaatatttaattgccgacgacgtgctgttagccaagacagtcgctgtcaatgccctcccatacttgtggaaagccagcagaggtaaggcatcatactggtactttttcgagcagtccgtgttcaagaacccaaacaacaaagcgttggcgttcccaagaccaagaaagaatgcccccacccccaagaccgacgccgagggattccagatctacgacgatcagtttgacctagaagaatacacctacaaggaattgtacgacatggttttgaagtactcatacatcttgaagaacgagtacggcgtcactgccaacgacaccatcggtgtttcttgtatgaacaagccgcttttcattgtcttgtggttggcattgtggaacattggtgccttgcctgcgttcttgaacttcaacaccaaggacaagccattgatccactgtcttaagattgtcaacgcttcgcaagttttcgttgacccggactgtgattccccaatcagagataccgaggctcagatcagagaggaattgccacatgtgcaaataaactacattgacgagtttgccttgtttgacagattgagactcaagtcgactccaaaacacagagccgaggacaagaccagaagaccaaccgatactgactcctccgcttgtgcattgatttacacctcgggtaccaccggtttgccaaaagccggtatcatgtcctggagaaaagccttcatggcctcggttttctttggccacatcatgaagattgactcgaaatcgaacgtcttgaccgccatgcccttgtaccactccaccgcggccatgttggggttgtgtcctactttgattgtcggtggctgtgtctccgtgtcccagaaattctccgctacttcgttctggacccaggccagattatgtggtgccacccacgtgcaatacgtcggtgaggtctgtcgttacttgttgaactccaagcctcatccagaccaagacagacacaatgtcagaattgcctacggtaacgggttgcgtccagatatatggtctgagttcaagcgcagattccacattgaaggtatcggtgagttctacgccgccaccgagtcccctatcgccaccaccaacttgcagtacggtgagtacggtgtcggcgcctgtcgtaagtacgggtccctcatcagcttgttattgtctacccagcagaaattggccaagatggacccagaagacgagagtgaaatctacaaggaccccaagaccgggttctgtaccgaggccgcttacaacgagccaggtgagttgttgatgagaatcttgaaccctaacgacgtgcagaaatccttccagggttattatggtaacaagtccgccaccaacagcaaaatcctcaccaatgttttcaaaaaaggtgacgcgtggtacagatccggtgacttgttgaagatggacgaggacaaattgttgtactttgtcgacagattaggtgacactttccgttggaagtccgaaaacgtctccgccaccgaggtcgagaacgaattgatgggctccaaggccttgaagcagtccgtcgttgtcggtgtcaaggtgccaaaccacgaaggtagagcctgttttgccgtctgtgaagccaaggacgagttgagccatgaagaaatcttgaaattgattcactctcacgtgaccaagtctttgcctgtgtatgctcaacctgcgttcatcaagattggcaccattgaggcttcgcacaaccacaaggttcctaagaaccaattcaagaaccaaaagttgccaaagggtgaagacggcaaggatttgatctactggttgaatggcgacaagtaccaggagttgactgaagacgattggtctttgatttgtaccggtaaagccaaattg

SEQ ID NO: 42 - protein, 650 aa, Candida viswanathii
  Candida ATACC strain 20336
MSGLEIAAAAILGSQLLEAKYLIADDVSLAKTVAVNALPYLWKASRGKASYWYFFEQSVFKNPNNKALAFPRPRKNAPTPKTDAEGFQIYDDQFDLEEYTYKELYDMVLKYSYILKNEYGVTANDTIGVSCMNKPLFIVLWLALWNIGALPAFLNFNTKDKPLIHCLKIVNASQVFVDPDCDSPIRDTEAQIREELPHVQINYIDEFALFDRLRLKSTPKHRAEDKTRRPTDTDSSACALIYTSGTTGLPKAGIMSWRKAFMASVFFGHIMKIDSKSNVLTAMPLYHSTAAMLGLCPTLIVGGCVSVSQKFSATSFWTQARLCGATHVQYVGEVCRYLLNSKPHPDQDRHNVRIAYGNGLRPDIWSEFKRRFHIEGIGEFYAATESPIATTNLQYGEYGVGACRKYGSLISLLLSTQQKLAKMDPEDESEIYKDPKTGFCTEAAYNEPGELLMRILNPNDVQKSFQGYYGNKSATNSKILTNVFKKGDAWYRSGDLLKMDEDKLLYFVDRLGDTFRWKSENVSATEVENELMGSKALKQSVVVGVKVPNHEGRACFAVCEAKDELSHEEILKLIHSHVTKSLPVYAQPAFIKIGTIEASHNHKVPKNQFKNQKLPKGEDGKDLIYWLNGDKYQELTEDDWSLICTGKAKL

SEQ ID NO: 43 - DNA, 1764 bp, Candida viswanathii
  Candida ATACC strain 20336
atgtccgacgacgagatagcaggaatagtcattgaaatcgacgatgacgtgaaatccacgtcttcgttccaggaagaactagtcgaggttgaaatgtccaactcgtccattaacgaatcccagaccgatgagtcgtaccgtcctgaagaaacctcattgcattacaggaggaagtcccacaggaccccgtcagaggagtcgttcctagagatcaccaagaacgtgaatgatccggatctagtttccaagattgagaacctaaggggcaaagtaagccaacgggaagacaggttgaggaagcactaccttcacacctcccaggacgtcaagttcttgtcccggttcaacgacatcaagttcaagctgaactccgcgacgattctagattcggatgcgttttacaagagtgaatactttggagtcttgaccatcttctgggtggttatcgcactctacatattgtcaacgttgtcagatgtttactttggcatggccaagcccttactggactggatcatcataggaatgttcaagcaggacttggtgaaagttgcactcgttgatcttgccatgtacctatcctcgtattttccttatttcttgcaggttgcatgcaaacggggtgatgtatcttggcatggtcttggatgggcaatacagggggtttacagcttggtgtttttgacgttctggacggtagttccgcaggagttggccatggatcttccttggattgcacgaattttcttgatcttgcattgcttggtgtttattatgaagatgcagtcgtatgggcattacaatggatacctttgggatgtgtatcaggaaggattggcctctgaggctgatctcagggacctttctgagtatgatgaagatttccccctggatcacgtggaggttctagaacagagcttgtggtttgccaaacacgagttggagtttcaatcgaatggaactgctgagaggaaggaccaccatcaccatgtattcgacgaaaaggatgtcaacaaaccaatacgtgtcttgcaagaagagggaattatcaagtttccggcaaacatcaacttcaaggattatttcgagtacagtatgttcccaacgctagtctacacgttgagcttcccccgaactcgacagattagatggacgtatgtgttgcagaaggttttgggaacatttgccttagtgtttgccatgattatcgtcgccgaagagagtttctgccccttgatgcaagaagttgatcagtacacaaaattgccaaccaaccaaaggttcccaaaatacttcgtcgttctttcccacttgatattaccgctcggcaagcagtacttgctctcattcatcctcatctggaatgaaattctcaacggcatagcggagttaagcaggtttggcgaccggcatttctacggcgcttggtggtcgagcgtcgattacatggactattcaagaaaatggaacaccatcgtgcaccgattcctccgtcggcacgtttacaattcgagcattcacatcctcggtatttccaggacgcaagccgcgatagttacacttttgctttctgccacaatccacgaactcgttatgtacgtcctatttggcaaattacgagggtacctattccttacgatgcttgtccagatccccatgaccgtcacctccaagttcaacaaccgtgtttggggcaacatcatgttctggttgacgtatttatctggccccagcttggttagtgcgttgtatttactcttctag

SEQ ID NO: 44 - protein, 587 aa, Candida viswanathii
  Candida ATACC strain 20336
MSDDEIAGIVIEIDDDVKSTSSFQEELVEVEMSNSSINESQTDESYRPEETSLHYRRKSHRTPSEESFLEITKNVNDPDLVSKIENLRGKVSQREDRLRKHYLHTSQDVKFLSRFNDIKFKLNSATILDSDAFYKSEYFGVLTIFWVVIALYILSTLSDVYFGMAKPLLDWIIIGMFKQDLVKVALVDLAMYLSSYFPYFLQVACKRGDVSWHGLGWAIQGVYSLVFLTFWTVVPQELAMDLPWIARIFLILHCLVFIMKMQSYGHYNGYLWDVYQEGLASEADLRDLSEYDEDFPLDHVEVLEQSLWFAKHELEFQSNGTAERKDHHHHVFDEKDVNKPIRVLQEEGIIKFPANINFKDYFEYSMFPTLVYTLSFPRTRQIRWTYVLQKVLGTFALVFAMIIVAEESFCPLMQEVDQYTKLPTNQRFPKYFVVLSHLILPLGKQYLLSFILIWNEILNGIAELSRFGDRHFYGAWWSSVDYMDYSRKWNTIVHRFLRRHVYNSSIHILGISRTQAAIVTLLLSATIHELVMYVLFGKLRGYLFLTMLVQIPMTVTSKFNNRVWGNIMFWLTYLSGPSLVSALYLLF

SEQ ID NO: 45 - DNA, 1767 bp, Candida viswanathii
  Candida ATACC strain 20336
atgtccgacgacgagatagcaggaatagtcattgaaatcgacgatgacgtgaaatctacgtcttcgttccaggaagacctagtcgaggttgagatgtccaactcgtccattaacgaatcccagacggatgagttgtcgtaccgtcctgaagaaatctcattgcattcgagaaggaagtcccacaagaccccgtcagatgagtcgttcctagagatcaccaagaacgtgaatgatccggatctagtctccaagattgagaacttaaggggcaaagtaagccaacgggaagacaggttgaggaaacactacctccacacatcccaggacgtcaagttcttgtctcggttcaacgacatcaagttcaagctgaactccgcgacgattctagattcggatgcgttttacaagagcgagcactttggagtcttgactatcttctgggtggttatcggactctacataatgtcaacgttgtcagacatgtattttggcatggccaagcccttactggactggataatcataggaatgttcaagaaggatttgatgcaagttgcactcgttgatcttgtcatgtacttatcctcgtattttccttatttcctacaggttgcatgcaagaccggagctatatcttggcatggtcttggatgggccatacagggggtttacagcttggtgtttttaactttctgggcggtacttccgctggagctggccatggatcttccttggattgcacgagttttcttgatcttgcattgcttggtgtttattatgaagatgcaatcatatggacattacaatggatacctttgggatgtatatcaggaaggattggtctcggaagctgatctcacggctgtttctgagtatgatgatgatttccccctggatcacggggaggttctagaacagagcttgtggttcgccaaacacgagttggagtttcaatctaatggaactacggagaggaaggatcaccatcatcatgtattcgacgaaaaggatgtcaacaaaccaatgcgtgtcttgcaagaagagggaattatcaaatttccggcaaacatcaatttcaaggattatttcgagtacagtatgttccccacgctagtctacacattgaacttccccagaattcgacatattagatgggcgtatgtgttgcagaaagttttgggaacatttgccttagtgtttgccatgattatcgtcgccgaagagagtttctgtcccttgatgcaagaagttgaacagtacacaagattgccaaccaaccaaaggttctcaaagtacttcgtcgttctttcccacttgatattgcccctcggcaaacagtacttgctctcgtttatcctcatttggaacgaaattctcaacgggatagcggagttaagcaggtttggggatcgccatttctacggcgcctggtggtcaagcgtcgactacatggactattcaagaaaatggaacacgatcgtgcaccgattcctccgccggcacgtttacaattcgaccattcgcatcctcggtatttccaggacccaagccgcgataattacacttttgctttcagccacaatccacgaactcgttatgtacatcctatttggaaaattacgagggtacctattccttacgatgcttgtccagatccccatgacagtcaccgccaagttcaacaaccgtttgtggggcaacatcatgttctggttgacgtatttatctggccccagcttggttagtgcgttgtatttactcttctga

SEQ ID NO: 46 - protein, 588 aa, Candida viswanathii
  Candida ATACC strain 20336
MSDDEIAGIVIEIDDDVKSTSSFQEDLVEVEMSNSSINESQTDELSYRPEEISLHSRRKSHKTPSDESFLEITKNVNDPDLVSKIENLRGKVSQREDRLRKHYLHTSQDVKFLSRFNDIKFKSNSATILDSDAFYKSEHFGVLTIFWVVIGLYIMSTLSDMYFGMAKPLSDWIIIGMFKKDLMQVALVDLVMYLSSYFPYFLQVACKTGAISWHGLGWAIQGVYSLVFLTFWAVLPSESAMDLPWIARVFLILHCLVFIMKMQSYGHYNGYLWDVYQEGLVSEADLTAVSEYDDDFPSDHGEVLEQSLWFAKHELEFQSNGTTERKDHHHHVFDEKDVNKPMRVLQEEGIIKFPANINFKDYFEYSMFPTLVYTLNFPRIRHIRWAYVLQKVLGTFALVFAMIIVAEESFCPLMQEVEQYTRLPTNQRFSKYFVVLSHLILPLGKQYLLSFILIWNEILNGIAELSRFGDRHFYGAWWSSVDYMDYSRKWNTIVHRFLRRHVYNSTIRILGISRTQAAIITLLLSATIHELVMYILFGKLRGYLFLTMLVQIPMTVTAKFNNRLWGNIMFWLTYLSGPSLVSALYLLF

SEQ ID NO: 47 - DNA, 1716 bp, Candida viswanathii
  Candida ATACC strain 20336
atgactcaggactataaagacgatagtcctacgtccactgagttggacactaacatagaagaggtggaaagcactgcaaccctagagtcggaactcagacagagaaaacagaccacggaaactccagcatcaaccccaccaccacctccacaacaacagcaggcgcataagaaagccctgaagaatggcaagaggaagagaccatttataaacgtggcgccgctcaacaccccgttggctcacaggctcgagactttggctgttgtttggcactgtgtcagtatcccgttctttatgtttttgttcttgcttacggtctccatggggttgcttgggtggttctttatcattttgccatatttcatttggtggtacggtttcgacttgcacactccatcgaatggtaaagttgtctatcgtgtgcgcaactcgttcaagaatttcatcatttgggactggtttgtcaagtatttcccgattgaagtgcacaagacggtcgagttggatcctacttttagcgaattgcctgtggaagagagcggcgacagttcggacgacgacgaacaagacttggtgtctgagcacagcagaactttggttgatcaaatcttcaagtttttcgggttgaagaaacgcttgaatgacacctccctgggcaaaccagagacattcaagaatgtgcctacgggtccaaggtatatttttgggtaccacccacacggagtgatttctatgggggcagtggggttgtttgccaacaacgccttgaggaacgaaccatatacgccaatttccaaatggttaaaaccattcttccacgacagctccaagggcgagagattgttccctggtattggcaatatcttcccattgacgcttaccacacagtttgcgctcccattttaccgtgactacttgatggctttggggatcactagtgcatcggctaaaaacattagaagcttgatcaacaatggagacaactctgtgtgtctcgtcgttggcggtgcacaagaatcgttgttgaacaatatgattgccaagcacgccagagtcgggtacggttacaaagagagcctagatattcatggcgaccagtccgaagaagaagaagaagaagaggatgataccaagcagctagagaacccaagtcctaaacgtgaagtgcaattggtcttgaacaaacgtaaaggttttgtgaagttggctatcgaactaggaaatgtttccttggtgcctatttttgcattcggagaagctgatgtttacagattggcccagccagcaccaggctcgttcttgtacaagttccagcaatggatgaaggcaacttttcaattcaccatcccattgtttagtgctcgaggcgtgttcatctatgatttcggattgttgccattcagaaacccaataaacatttgcgtcggtagacccgtctacattccgcacaacgtcttgcaagaatacaagcaaaagcacccagaggagtttgccgaagaggaacctgccagtaccccgatgaagaagtctggatctttcaccgatatgttcaaagctggtgaaaagaagcccaagacttcaagtatcaagactaaaatcccacctgcattactagacaagtaccacaagctatacgtcgacgagttgaagaaggtctatgaagagaacaaggaaaggtttggctacggtgatgttgaattaaacattgtagaatag

SEQ ID NO: 48 - protein, 571 aa, Candida viswanathii
  Candida ATACC strain 20336
MTQDYKDDSPTSTELDTNIEEVESTATLESELRQRKQTTETPASTPPPPPQQQQAHKKASKNGKRKRPFINVAPLNTPLAHRLETLAVVWHCVSIPFFMFLFLLTVSMGLLGWFFIILPYFIWWYGFDLHTPSNGKVVYRVRNSFKNFIIWDWFVKYFPIEVHKTVELDPTFSELPVEESGDSSDDDEQDLVSEHSRTLVDQIFKFFGLKKRLNDTSSGKPETFKNVPTGPRYIFGYHPHGVISMGAVGLFANNALRNEPYTPISKWLKPFFHDSSKGERLFPGIGNIFPLTLTTQFALPFYRDYLMALGITSASAKNIRSLINNGDNSVCLVVGGAQESLLNNMIAKHARVGYGYKESLDIHGDQSEEEEEEEDDTKQLENPSPKREVQLVLNKRKGFVKLAIELGNVSLVPIFAFGEADVYRLAQPAPGSFLYKFQQWMKATFQFTIPLFSARGVFIYDFGLLPFRNPINICVGRPVYIPHNVLQEYKQKHPEEFAEEEPASTPMKKSGSFTDMFKAGEKKPKTSSIKTKIPPALLDKYHKLYVDELKKVYEENKERFGYGDVELNIVE

SEQ ID NO: 49 - DNA, 2079 bp, Candida viswanathii
  Candida ATACC strain 20336
atgtcgtctttaaagaacagaaaatccgcaagcgtcgccacaagcgatacagaagactcagaaacagaggcagtatcctcctcaattgatcccaacggcaccatattgcgaccagtcctacatgacgaaccccaccacagccatcaccaccacaacataactagaccagtattggaggacgatggcagcatcctggtgtccagaagatcgtcgatctccaaatccgacgacctgcaggcaaagcaaaagaagaagaaacccaagaagaagatcttggagtctcgtcgggtcatgtttatctttggtaccctcattgggttaatctttgcgtgggcgtttaccacagacacgcatcctttcaatggcgacttggagaagtttatcaactttgaccagctcaacgggatctttgacgactggaagaactggaaggatatcttgcccaacagcatccagacgtacttgcaggaatcgggcaagggcgaagataacgacgggttgcatggtctggccgattccttctccgtcgggctccgcttgaaagcccagaagaacttcactgacaaccacaatgtcgtgttggttcctggtgtggtgagcacggggttggaatcgtggggaacaaccaccaccggtgattgtccatctatcggatacttcaggaagagattgtggggatcattttatatgttaaggacaatgattttggagaaaacgtgctggttgaagcatatccagttggacgagaagacggggttggatcctcccaatattaaggtccgtgcggcgcagggtttcgaagcggcagatttctttatggctgggtactggatctggaacaagatcttgcagaacttggcggttattgggtacggaccaaataacatggtgagtgctagttatgactggagattggcttacattgacttggagagaagagatggatatttttcgaaacttaaagcgcagattgagttgaataacaagttgaacaacaagaagactgtgttgattggccactcgatggggacccagattattttctactttttgaaatgggtcgaagccaccgggaaaccatactatggcaatggcggaccaaactgggtgaatgatcatattgagtcgattattgacatcagtgggtcgactttgggtacccccaagagtattcctgtgttgatctctggggaaatgaaagacaccgttcaattgaacgcgttggcggtttacgggttggagcaatttttcagcaggcgtgaaagagtcgatatgttgcgtacatttggtggcgttgccagtatgttacccaaggggggagacaagatatggggcaacttgacgcatgcgccagatgatccaatttccacattcagtgatgacgaagttacggacagccacgaacctaaagatcgttcttttggtacgtttatccaattcaagaaccaaactagcgacgctaagccatacagggagatcaccatggctgaaggtatcgatgaattgttggacaaatcaccagactggtattccaagagagtccgtgagaactactcttacggcattacagacagcaaggcgcaattagagaagaacaacaatgaccacctgaagtggtcgaacccattagaagctgccttgcctaaagcacccgacatgaagatctattgtttctacggagttggaaatcctaccgaaagggcatacaagtatgtgactgccgataaaaaagccacgaaattggactacataatagacgccgacgatgccaatggagtcatattaggagacggagacggcactgtttcgttattaacccactcgatgtgccatgagtgggccaagggagacaagtcgagatacaacccagccaactcgaaggttaccattgttgaaatcaagcacgagccagacagatttgatttacgaggcggcgccaagactgcggaacatgttgatattttggggagtgccgagttgaacgagttgattttgactgtggttagcgggaacggggacgagattgagaatagatatgtcagcaacttaaaagaaatagtagaggccataaatttataa

SEQ ID NO: 50 - protein, 692 aa, Candida viswanathii
  Candida ATACC strain 20336
MSSLKNRKSASVATSDTEDSETEAVSSSIDPNGTILRPVLHDEPHHSHHHHNITRPVLEDDGSISVSRRSSISKSDDSQAKQKKKKPKKKILESRRVMFIFGTLIGLIFAWAFTTDTHPFNGDLEKFINFDQLNGIFDDWKNWKDILPNSIQTYLQESGKGEDNDGLHGSADSFSVGLRLKAQKNFTDNHNVVLVPGVVSTGLESWGTTTTGDCPSIGYFRKRLWGSFYMLRTMILEKTCWLKHIQLDEKTGLDPPNIKVRAAQGFEAADFFMAGYWIWNKILQNLAVIGYGPNNMVSASYDWRLAYIDLERRDGYFSKLKAQIELNNKLNNKKTVLIGHSMGTQIIFYFLKWVEATGKPYYGNGGPNWVNDHIESIIDISGSTLGTPKSIPVLISGEMKDTVQLNALAVYGLEQFFSRRERVDMLRTFGGVASMLPKGGDKIWGNLTHAPDDPISTFSDDEVTDSHEPKDRSFGTFIQFKNQTSDAKPYREITMAEGIDELLDKSPDWYSKRVRENYSYGITDSKAQLEKNNNDHSKWSNPLEAALPKAPDMKIYCFYGVGNPTERAYKYVTADKKATKLDYIIDADDANGVILGDGDGTVSLLTHSMCHEWAKGDKSRYNPANSKVTIVEIKHEPDRFDLRGGAKTAEHVDILGSAELNELILTVVSGNGDEIENRYVSNLKEIVEAINL

SEQ ID NO: 51 - protein, 600 aa, Streptomyces coelicolor
MTQREEELARVLSGPEFATIRPDDLSVLDYSLLTLRRARLLNGAGFAANSLWLGRGDSARFPEFLRTMGWIGAYDLSLLNVLVSHQIAGDALLSHGGPEQLDAWAGEIDAMERMYCFAGSELLAGSDLKRVRTTAVYDPHGRSLVLNTPRPADSKVWTGNSLHTGDVAMVLARLEVGGRDEGHHWLRVPLREAGAVLPGVRIGRAEPKGGVTANQTGVLTFTDHRLPLSALMNRWASIDEDGTYRSPLPRHRRFEECLATFTHERLFPSVGAAYAQLLACTITTRFAAVKQTFGRPLIGHEHYRMRLSAAVGRSLAARHAMTALAEVAVARSAEGAPARDQVLHALISCGKSGCTGDARQTLAETRELCGGLGYHDANQIAPLLHDYEIAVTFGGDNTVLGYQATRFALRHREDFDRVLDEAVAGAGRLDAVRVLRAVCDVLLDRVERDGAGEASAQWSRAVHQTLAIGHWARQASTPLSERLLAQYAAVCVLEHALAALRAGILDQDALLGFEAARHEAAGAPLDADALLRELAVPEGLISAPIAHPDFAERHAAAAHAGTAAAHAGTVPSPGTGPSPGTGPAPGTVQAPGTVQAGVRP

SEQ ID NO: 52 - protein, 743 aa, Clavibacter michiganensis
MVDTAARGRTTRGTRGRGPAAAPQDGSAAPEGSPHEGALREAGVPVAGAVDAEVARELDRTDGDAGVDTGPRVDVEGLGRVLLGRWADVRRSSRELTSRPELHRMEGLDMHQHRARVSEQLKILVEHGGVHRAYPVSVGGLEDHGGNIAGFEELVAADPSLQIKAGVQWGLFGSAVMHLGTERHHRELLPGIMTLETPGAFAMTETGHGSDVASIGTTATYDPETGEFDLHTPFRAAWKDYIGNGAIDGRAATVFAQLVTQGVNHGVHCFFVPLRDETGAFLPGVGGEDDGLKGGLNGIDNGRLHFDHVRVPRANLLNRYGDVAEDGTYTSEISSPGRRFFTMLGTLVQGRVSLDGAATSAAKIALQIAVTYGNQRRQFVAGGTDEEVLLDYQRHQRRLIPRIATTYAASFAHEKLLTQFDSVFSGATDTDADRQDLETLAAAFKPLSTWHALDTIQEAREACGGQGFLAENRLVGLRADLDVYATFEGDNTVLLQLVAKRLLTDVNKRFAKADFGVLARYAVEQAADRTLRSTGLRTLGQALADRGSTARSVGQLREPDTQRALLTGRVETMVGEIATALRATRKMPPAEAAALVNRHQDALIEAARAHAQLLQWEAFTEALDPASETGRAMDDGTRRILTWTRDLFGLRLIEEDLAWFLIHGRISSARARAVTAYVDRLVARLRPHAQDLVDAFGYTPAHVRAAVASGEEKDRQDEARAYRDARIADGSAPRMEKSEKKKG

SEQ ID NO: 53 - protein, 576 aa, Nocardia brasiliensis
MPGSPVIDLLSDPLFDPHVRYHLDVDDLMRLTVERAKLLHAKGIVGSEAWCGGNRQDRFPDLVRTAGWLSAFDISLVATTGNQQLAGNALLAHGSPAQVATYRDEIDRMAQVYAFAATEIGRGTNLITTGTQAHYRHDDRSLTLVTPSDDAAKYWIGNSLFSATYAMVLARLVVDGSDEGHHWFRVPLRPSEGAMPFAGIRIHRADPKGGLPGNQTGMLHFDQYRMPLDALMSGWAQIDDSGTYVSEIPSRERYLRCLGTFSQERIFPVTGAAAVMRRCSAITLRYSTYRETSGKSLLSFEHYRERLMPVVAEALALQQLTEHLIEQWTSRYPTEPITLHGRPLHGLTSAAKAHASWAANTALVELRELCGGHGFHSHNEIVTARVDGEINTTFGGDNNVLCYESVRIVAKTTEADRALPTASTVTQAGLRSCAEGVDLLEALARLLLRRWRETRSGALCRPHVHASCSAALLRRWAAHSRGPVDDRLRLLHAVTCLLGLADHLTAEGLLDGPAIRGLFTQRGELSDRCAEDHAAVLDLLDVPAALLDVPLAHPDYVQRTVTAARDTTAMHAAPSA

SEQ ID NO: 54 - protein, 576 aa, Nocardia brasiliensis; identical to SEQ ID NO: 53

SEQ ID NO: 55 - protein, 724 aa, Candida maltosa
MALISNLKDEYDHPTKTDPDTNPKIVADIISSKEPPQPSQDVAEERSRTDWDLKEMHEFLEGDEAKSEEILRLYQSIERDPILQTRPEQFDYTKNEERESVALRINQMSKYLETEPYEKFRRRLQLMTVNDPSLGIRMLVNIGLFLNCIRGNGTQKQYDFWAKTKEAGKVKQLLRLFRYDELGHGFNVAGCEIFATFDEKTDQFIIDTPHIGATKWWIGGAAHSATHTVCYARLIVKDIDYGVKTFVVPLRDSTHNLLPGVAIGDIGPKLGRQGVDNGWIQFTEVRIPRFFMLQRWCKVDRQGNVTLPPLEQLSYISLLEGRVGMATDSYRIGARYTTIALRYAVARRQFSKGDGQPETKLIDYTLHQRRLLPYLALTYLAALGTDKLERQHDQLLKNLDKALATNNKLLLKNTIQSTKSMFVDSGSLKSTLTWLASDLINEARQSCGGHGYSAYNGFGKTYGDWAVQCTWEGDNNVLGMSAGKTIIKTVQQVLNGKQLKDSTLEFLNDAPALSSAKKAVIRIKSHVDDTDRVLKAIAGLISKYAKDLIPVSYQSWDSIGPQRVVLSKFRCHYYLLETFNERLNDRIKAKSPARPHLENIIKLYYVTNVLGPFIDEFLRFGVISPSVAKYITTEYPQKLCAAIRPYVIGLTDSFQQPDNFINSLIGRYDGNVYTNYLTNVTNVNDPTNYKAPYSEALEAMLNRASLEERERFEKSKAVAAKLSQ

SEQ ID NO: 56 - protein, 581 aa, Streptomyces lividans
MTQREEELARVLSGPEFATIRPDDLSVLDYSLLTLRRARLLNGAGFAANSLWLGRGDSARFPEFLRTMGWIGAYDLSLLNVLVSHQIAGDALLSHGGPEQLDAWAGEIDAMERMYCFAGSELLAGSDLKRVRTTAVYDPHGRSLVLNTPRPADSKVWTGNSLHTGDVAMVLARLEVGGRDEGHHWLRVPLREAGAVLPGVRIGRAEPKGGVTANQTGVLTFTDHRLPLSALMNRWASIDEDGTYRSPLPRHRRFEECLATFTHERLFPSVGAAYAQLLACTITTRFAAVKQTFGRPLIGHEHYRMRLSAAVGRSLAARHAMTALAEVAVARSAEGAPARDQVLHALISCGKSGCTGDARHTLAETRELCGGLGYHDANQIAPLLHDYEIAVTFGGDNTVLGYQATRFALRHREDFDRVLDEAVAGAGRLDAVRVLRAVCDVLLDRVERDGAGEASAQWSRAVHQTLAIGHWARQASTPLSERLLAQYAAVCVLEHALAALRAGILDQDALLGFEAARHEAAGAPLDADALLRELAVPEGLISAPIAHPDFAERHAAAAHAGTVPSPGTVPASGTVQAGVRP

SEQ ID NO: 57 - protein, 581 aa, Streptomyces lividans; identical to SEQ ID NO: 56

SEQ ID NO: 58 - protein, 719 aa, Komagataella pastoris
MFKIESIKSQSPQVAIDKERKATKFDINKMFEFLESGKDEAALTKSLMQQIERDTILKTNASYYDLTKDQHRELTAQKIARLASYIEKDAPFFENFQKRLNLIAIVDPQLGTRVGVHLGLFLSAIRGNGTEEQFKYWAFERGAAYLKDVYGCFGMTELAHGSNVAGLETTATFDQKTKEFEINTPHLGATKWWIGGAAHSANHCVVYARLIVSGKDYGVKTFVVPIRDRNHNLHSGVAIGDIGAKMGRDGIDNGWIQLTNVRIPMNYMRSKFTKVTQRQEIVEVPPLEQLAYGALLGGRVTMVTDSFRMAQRFITIALRYSVGRRQFGAKNSSEELKLIDYPLHQRRLLPYLALTYALSISSFDLSQTYDSVLSNLDAAGKSQDFSKLGQAIAGLKNLFCASASLKSTATWYVAQLIDECRQACGGHGYSSYSGFGKAYNDWVVQCTWEGDNNILASNAGRLLCNLLSSCKKKEKKIKGDLSYLNGISNIDKEAICWNKQSMTNLSNSNIDKELFCFNKQVCTVKLINAIQGTIIRLGVRVPNIGSKKSTWDDIAAQRVVLSKLNAVLYMLQHLVLKIKQLGDEEAHKQYLVQIAALFATSQIEMNFASYFLQFKAIDSLEPVADVVSELCLSVRDQVIGLTDSFQFSDYFINSALGSHSGDIYNTYFDTVNNLNNPQVRDGKAAYSEALEAMLRRDPLEVRECFEKSDKVLKKLAPKI

SEQ ID NO: 59 - protein, 748 aa, Saccharomyces cerevisiae
MTRRTTINPDSVVLNPQKFIQKERADSKIKVDQVNTFLESSPERRTLTHALIDQIVNDPILKTDTDYYDAKKMQEREITAKKIARLASYMEHDIKTVRKHFRDTDLMKELQANDPDKASPLTNKDLFIFDKRLSLVANIDPQLGTRVGVHLGLFGNCIKGNGTDEQIRYWLQERGATLMKGIYGCFAMTELGHGSNVAQLQTRAVYDKQNDTFVIDTPDLTATKWWIGGAAHSATHAAVYARLIVEGKDYGVKTFVVPLRDPSTFQLLAGVSIGDIGAKMGRDGIDNGWIQFRNVVIPREFMLSRFTKVVRSPDGSVTVKTEPQLDQISGYSALLSGRVNMVMDSFRFGSKFATIAVRYAVGRQQFAPRKGLSETQLIDYPLHQYRVLPQLCVPYLVSPVAFKLMDNYYSTLDELYNASSSAYKAALVTVSKKLKNLFIDSASLKATNTWLIATLIDELRQTCGGHGYSQYNGFGKGYDDWVVQCTWEGDNNVLSLTSAKSILKKFIDSATKGRFDNTLDVDSFSYLKPQYIGSVVSGEIKSGLKELGDYTEIWSITLIKLLAHIGTLVEKSRSIDSVSKLLVLVSKFHALRCMLKTYYDKLNSRDSHISDEITKESMWNVYKLFSLYFIDKHSGEFQQFKIFTPDQISKVVQPQLLALLPIVRKDCIGLTDSFELPDAMLNSPIGYFDGDIYHNYFNEVCRNNPVEADGAGKPSYHALLSSMLGRGFEFDQKLGGAANAEILSKINK

SEQ ID NO: 60 - protein, 659 aa, Caenorhabditis elegans [sequence omitted]

SEQ ID NO: 61 - protein, 706 aa, Debaryomyces hansenii
MVSATNTVNSGVPPNPAASIQAERAASKFDPKEMHYFLEGGEERAEKFKQMMQQMERDPILSANFQYYDLTKDQQRELTALRIDRLTRYIENESFDDFNKRMSLMGVFDPQLSTRLGINLGLFVSCLKGNGTAEQVKYWAMDKSAVYMRGIYGCFGMTELAHGSNVAGLETTATFDDENDEFIINTPHIGATKWWIGGAAHSATHCSVYARLIVGGQDYGVKTFVVPLRDSNHDTMPGVTVGDIGAKMGRDGIDNGWIQFSNVRIPRYFMLQKFCKVSSEGDVQLPPLEQLSYSALLGGRVMMVLDSFRVSARFSTVALRYAIGRRQFKAGSASDDKNALECQLLDYPLHQRRLLPYLALSYIISASAVKIETTIESTLENLDKAVEADDMGAIMKSIDSMKSLFVDSGSLKSTCTWLAAEVIDQCRQACGGHGYSAYSGFGKAYNDWVVMCTWEGDNNVLAMSVGKQIIKHILGVLDGKKVKGSADFLNNTEQYLNEEPVLRSVDDLKDLKKVLLAIEVAIIRVAYQASQTLKENKGDFDTVGAEMVTLSKLNAHHFMLSEFLDRMDSFESKQLVPYLESVAKLYSATIVLEKFAGDFLAQGVFPPKLNGELNSKHIPELCKEIRPNVIALTDSFQQSDMMINSAIGSYDGNIYENYFGVVKANNPPSKTKAPYSGALEAMLNRPSKEERERFEKSTETAKILSK

SEQ ID NO: 62 - protein, 721 aa, Ashbya gossypii
MTKASVVDQSAPAYAPKRLLAEARAASKVNIEQVFAFLEGSPEKAALTNELLAEFAADPAITQGPEYYDLTKAEQREQTVKKIARLALYLENDIKLARKQHHKDVVRDLQSPDAPMVTMSDMERFEKRSTLVALIDPQLATRLGVNLSLFGNAVRGNGTDEQIKYWLQERGLIFVKGIYGCFAMTELGHGSNVANLQTRATYDPASDSFVIQTPDLVATKWWIGGAAHSATHSTVYARLIVEGKDYGVKVFVVPLRNPKTMELLAGISIGDIGSKMGRDGIDNGWIQFNNVRIPREYMLSRFTKVIPGNPPKVEMEPLLDSISGYAALLSGRVSMVLDSYRFGARFSTIATRYAFGRQQFGDPTNETQLIEYPLHQFRVLPQLAIIYMMAPGAMKLMDTYNSCLGELYGAGDDKKKLTTVSARMKDLFVESASLKATCTWLTSTLIDELRQTCGGHGYSSYNGFGKAYNDWVVQCTWEGDNNVLCLTSGKSLLKKFAGIVRGKKVTICDTSMDYLRMDYIQKVVMGGTKKVSNLSTLPDYYQIWSVILVKYLKRCAETVRDNNDPESVSKLLVSIAKFHAFYSMLQEFHRKLASDQSHVGDAATKEVLWKVYKLSSLYFIDKFSGEFQQLKVMSPDQMTNVQEQMLAILPEIKTHAIRLTDAFHLPDAVINSSIGNYDGDIYHNYFNDVTRVAAKDKAPGVPPYADNACQLSGLVTTSSTI

SEQ ID NO: 63 - protein, 736 aa, Kluyveromyces lactis
MTRQSTVDQNQSTYNAKNFITKERQESKLDIDQLNVFLENGEQEAKLTHDLIEEIINDPILKTDTDHYDITKSQEREITARRIARLSLYMEHDVKTKQREFKDDLVKNLERKDSKLLTNKDLSIFDRRLSLVANIDPGLSTRIGVHLGLFGNCIKGNGTDEQIHYWLQEKGALLLKGIYGCFAMTELGHGSNVAQLQTTATYDPSSDTFKINTPDLLATKWWIGGAAHSATHTTAYARLIVNGKDYGVKTFVVPLRDEKTLNLLPGIMIGDIGAKMGRDGIDNGWIQFKNVVIPRQFMLQRFTKVIPGSPPKVQTQPLLDQISGYSALLSGRVNMVMDSFRFGSKFAIIATRYAVGRQQFGPEGNETQLIDYPLHQYRVLPQLALCYLVAPTAHKLMGTYISTLMELHQAGADKAKLINVSNKLKDLFIDSASLKATNTWLVAKLIDDLRQTCGGHGYSSYNGFGKGYNDWVVQCTWEGDNNILSLTSAKSIVKKFADISRGKNTTVTTDSLKYLTPQFIGKSLSKDLTFKFDNKKDFTEIWAVMIIRLIHHVVELISKGTKIDSLSKTLVQISKFHAIHSMLLTYQDKLNNESEASVKDAYTKGYLWKLYELFSLYFIDQHLGEFLLLKVVTSDQMSQVLQPRLLQLLPEIRKECIALTDAFKLPDAMINAPIGYYDGDIYHNYFNEVTNNNKLEPDGAGRPPYYPLLTSMLGRDDFQNRLGGSFESETLDSLLK

SEQ ID NO: 64 - protein, 748 aa, Candida glabrata
MTKLSTVDPNASVLNPQRFIQRERENCSIDIDQVNTFLESDPRSRDLTHLIVDQLVNDPIIKADSATYDQTKLTQREVTVKKIARMALYMEQDIKTVRKHFRDTDLLKSLQDFGDTTTPPLTNKDLAIFDKRLSLVANMDPQLSTRIGVHLGLFGNCIKGNGTDEQIKYWLQTRGAILIKGIYGCFAMTELGHGSNVAQLQTTATYDQESDTFIINTPDLAATKWWIGGAAHSATHTACYARLLVNGKDYGVKTFVVPLRDPSSLQLMPGIAIGDIGAKMGRDGIDNGWIQFRNVVIPREFMLSRFTKVHRNPGATPTVEVDPQLDQISGYSALLSGRVNMVMDSFRFGSKFATIATRYAVGRQQFADKPGQPEKQLIDYPLHQYRVLPQIVIPYIISPAAFSLLNFYYSTLDELYAASSKNDKRALVVVSQKLKNLFIDSASLKATNTWLVAQLIDELRQTCGGHGYSGYNAFGKGYNDWVVQCTWEGDNNILSLTSAKSILKKFVDSATKGKYNKELDKRSFRYLDPQFIRKVFTSSSENKLDDLYDYTNIWAVALLKLLRHIAKQVDSTKDLDGASKLLVLVSKFHALYVMLNTYYEKLNSPTDSYVTCPKTKEQLWNVYKLFSLYFIDKHAGEFQQFKILSPDQISQVVQPRLLKLLPEIRKECISLTDSFKWPDGMLNAPIGYYDGDIYHNYFNEVVKNNPVEKDGAGIPPYHELLANMLTRGDEFARLGGANNAEILSKLTK

SEQ ID NO: 65 - protein, 732 aa, Botryotinia fuckeliana
MTPPQWVKDLKPSGPQGTELIKVEREKSNIHVEKLSNFLFTKEVLERQERILKILQADKIFDKSNNYFDGRVDRFKTSLARAKRLRQLQVKHNWNQEEYQVANELISEPTPYGLHASMYLTTLRGQGTPEQHKLFLEPAENYKAIGCYAQTELGHGSNVRGLETTATWNPEDKTFILHSPHLTASKWWIGSLGRTANHAVVMAQLIIAGKPYGPHPFVCQIRDMKTHEPLDGVYVGDIGPKFGYNTMDNGFLLLNQVKIPHINMLAKFSSVDPETNKYVKPSSPSLIYGTLTWVRSTIVLQSGGVLARGVTIATRYASVRRQFQDRDAGADASGENQVLNYTMVQYRLLPLLAATFALHFTGKAMMGLYQDNQKRMQQSATNTSDSSRGAGPEELNSGSDLLADLHATSCGLKALGSTTAAEGLEVCRRACGGHGYSSFSGIGSWYADYLPTTTWEGDNYMLTQQVARYLLKSARAVLKGNAPNNDTTKIFTTFLQKQDMGAAHDVLGSDSDIVAAFAWRTSFLTFEALKHRDAEKGSWNSLLVDFWRLSTAHSQYLVVKNFYDALQSESLQHELDAETIDVLHKLYRLYALNTLEKEASEFYSSAAVTVRQIQLARTKSVMKLLGEIRPHALRLVDAWAFPDWQLDSSLGRKDGKVYEDMFYRASQLNPLNGLTVDPYADNDNIVKSDETERFRTRRGAINLKVNQVLTRRRSGHNHETVNVKSPTSSYQK

SEQ ID NO: 66 - protein, 675 aa, Arabidopsis thaliana
MSENVELRRAHILANHILRSPRPSSNPSLTPEVCFQYSPPELNESYGFEVKEMRKLLDGHNLEERDWLYGLMMQSNLFNPKQRGGQIFVSPDYNQTMEQQRQISMKRIFYLLEKGVFQGWLTETGPEAELKKFALYEVCGIYDYSLSAKLGVHFLLWGNAVKFFGTKRHHEKWLKDTEDYVVKGCFAMTELGHGTNVRGIETVTTYDPTTEEFVINTPCESAQKYWIGEAANHANHAIVISQLSMNGTNQGIHVFIAQIRDHDGNTCPNVRIADCGHKIGLNGVDNGRIWFDNLRIPRENLLNSVADVLADGKYVSSIKDPDQRFGAFLAPLTSGRVTIASSAIYSAKLGLAVAIRYSLSRRAFSVAANGPEVLLLDYPSHQRRLLPLLAKTYAMSFAVNDLKMIYVKRTPETNKAIHVVSSGFKAVLTWHNMRTLQECREAVGGQGLKTENRVGHLKGEYDVQTTFEGDNNVLMQLVSKALFAEYVSCKKRNKPFKGLGLEHMNSPRPVLPTQLTSSTLRCSQFQKSVFCLRERDLLERFTSEVAELQGRGESREFLFLLNHQLSEDLSKAFTEKAILQTVLDAEAKLPPGSVKDVLGLVRSMYALISLEEDPSLLRYGHLSRDNVGDVRKEVSKLCGELRPHALALVASFGIPDAFLSPIAFNWVEANAWSSL

SEQ ID NO: 67 - protein, 675 aa, Arabidopsis thaliana; identical to SEQ ID NO: 66

SEQ ID NO: 68 - protein, 664 aa, Arabidopsis thaliana
MERVDHLADERNKAEFNVDDMKIVWAGSRHAFDVSNRMSRLVANDPVFEKSKRAVMSRKELFKNTLRKSVHAWKLINELRLSDEEGLKLRSFMDQPGFLDLHWGMFVPAIKGQGTEQQQQKWLSLATKMQIIGCYAQTELGHGSNVQGLETTATFDPKTDQFIIHSPTQTSSKWWPGGLGKVSTHAVIYARLITNGKDHGVHGFIVQLRSLDDHSPLPGITVGDIGMKFGNGAYNSMDNGFLMFDHFRIPRDQMLMRLSKVTREGKYVASDVPRQLVYGTMVYVRQSIVSNASTALARAVCIATRYSAVRRQFGSHDGGIETQVINYKTQQNRLFPLLASAYAFRFVGEWLKWLYTDVTKRLEASDFATLPEAHACTAGLKSMTTSATSDGIEECRKLCGGHGYLWCSGLPELFAVYVPACTYEGDNVVLQLQVARFLMKTVSQLGSGKAPSGTTAYMGRAKHLLQCSSGVRNARDWLNPGMVLEAFEARALRMAVTCANNLSKFENQEQGFSELLADLVEAATAHCQLIVVSKFIAKVEGDIEGKGVKKQLKNLCYIYALYLLHKHLGDFLSTNSVTPEQASLANQQLRSLYSQVRPNAVALVDAFDYTDQYLGSVLGRYDGNVYPKLFEEALKDPLNDSVVPDGYREYIRPLIKQRFRSAKL

SEQ ID NO: 69 - protein, 664 aa, Arabidopsis thaliana; identical to SEQ ID NO: 68

SEQ ID NO: 70 - protein, 750 aa, Muricauda ruestringensis
MIVTDYSIGILQYIPFFYVIWSDDLLSASEISVVQKVIELDTSLNVDEKHQLRRWLKRDTPPFDDEIKNWKQTIANSKVRLIESDTYPLSSLSQRLVNSENLNDHLKHIEVHLGIQPNHYNHLFDVEVVHEKTSSEYDANILDEILKGEHARVVDRFRSFLDKPDFSWQVLRNKEDFRNRILQQVQLLGEAGYGAMAYPPEYGGTGDMPAYAAIFEHLMFVDGSLAVKFGVQFGLFGGSIQKLGTKKHHDEYLTDAGTTKLLGCFAMTETGHGSNVRGIKTTATYEKSSDSIIIHTPGKNDNKEYIGNAIHSKIATVFAQLIVNGKNEGVHAILVPLRNENHEELEGVSVKDNGYKLGLNGVDNGKIWFNNVKVPRENLLNKYGEIQEDGTYASSIKNPNKRFFTMLGTLVGGRICVARGALGGSKMALSIAVKYALNRRQFNDNVKVQEDLIMDYPTHQLRLTPAIAGAYVYHFTLEEMMKRYSDYSQPDKRKIETQVAGLKSIITWFANETIQECREACGGKGYLLENRIADLKGDVDIFTTFEGDNTVLLQLAAKGILSDFRAEFNSAGFASVLKLLQTQLSDKLTAINPLYSNKVDAKHLYNPKFHRHAFDYRTRRLTYTLAMRIRNYIKKGIPSYQAFLKVQTHLLALGKAYSVELAYNIFCDHYQQIEDLKYRALLEKVGCLYALDQINKDAKWFLEQGYIGGTKSKAIRQRVERLSTELRPHIEVLVDGFGIPEHCLTAPITK

SEQ ID NO: 71 - protein, 763 aa, Cellulophaga algicola
MDRILYFHTMKKNIYTLGVLQYIPFFYVIWSDGLLSASEINITKTAFEKDASLTTADKKTLAGWLDKNNKPSSQELKSWRTIISNAAIKLVEHDAYPLASLAKRLVAHYFSDTPENKQLQHIELNLGIQPNHYHHLFDVEVQHEATSDYYNAKELDAILKGEFAATVTKFHEVLKDPIYTWSIERNKEKFRATVLNQVKHLAAENYGAMAYPNAYGGIEDMPAYAFIFENIMYVDGSLAIKFGVQFGLFGGSIQKLGTKYHHDLYLANAGKAELLGCFAMTETGHGSNVRGIKTTATYQKETDLIILHTPGENDNKEYIGNALDATMASVFAQLIVNGKNEGVHAILVPIRDKNHELLPGVRIEDNGYKLGLNGVDNGKIWFNQVSVPRKNLLNKYGDIKEDGTYYSNIENPNKRFFTMLGTLVGGRICVARAGLGGAKKALTIAVKHALKRRQFNDNKKIQEDLLMDYPSHQLRLTPPIAKAYVYDVTLQHIMKLYSDDTKTDKREIETQVAGLKSIITWFANDTIQECREACGGKGYLIENRIADLKGDVDIFTTFEGDNNVLLQLAAKGVLSDFKAEFNSAGFASVLKLLTSQLNDKLTTINPIYSNKTDAEHLYNPKFHKHAFEYRTRRLTYTLAMRIRNYIKNGVPSYQAFLKVQTHLLALGKAYSCQLSYEIYSTYTETITDEKNKILFEQLGTLSALHEIKADASWYLEQGYMGASKSKAIKQRVERICTELRPHINVLVDGFGIPPHLITAPIAK

SEQ ID NO: 72 - protein, 661 aa, Mus musculus
MNPDLRKERAAATFNPELITHILDGSPENTRRRREIENLILNDPDFQHEDYNFLTRSQRYEVAVKKSATMVKKMREFGIADPEEIMWFKNSVHRGHPEPLDLHLGMFLPTLLHQATEEQQERFFMPAWNLEITGTYAQTEMGHGTHLRGLETTATYDPKTQEFILNSPTVTSIKWWPGGLGKTSNHAIVLAQLITRGECYGLHAFVVPIREIGTHKPLPGITVGDIGPKFGYEEMDNGYLKMDNYRIPRENMLMKYAQVKPDGTYVKPLSNKLTYGTMVFVRSFLVGSAAQSLSKACTIAIRYSAVRRQSEIKRSEPEPQILDFQTQQYKLFPLLATAYAFHFLGRYIKETYMRINESIGQGDLSELPELHALTAGLKAFTTWTANAGIEECRMACGGHGYSHSSGIPNIYVTFTPACTFEGENTVMMLQTARFLMKIYDQVQSGKLVGGMVSYLNDLPSQRIQPQQVAVWPTLVDINSLDSLTEAYKLRAARLVEIAAKNLQAQVSHRKSKEVAWNLTSVDLVRASEAHCHYVTVKVFADKLPKIQDRAVQAVLRNLCLLYSLYGISQKGGDFLEGNIITGAQMSQVNSRILELLTVTRPNAVALVDAFDFKDVTLGSVLGRYDGNVYENLFEWAKKSPLNKTEVHESYYKHLKPLQSKL

SEQ ID NO: 73 - protein, 653 aa, Streptomyces griseus
MTTDKAATAPGGYVRPELDVRALTEVLDGEYAEVRDLVRANLVTHLPVLEEADELDVDAFRERVRERVVEMAATGQTGMGFPQRYGGGGDIGASIAAFETLAFGDLSVLVKVGVQFGLFGGAILHLGTERHHDAYLPDLITGKLMGCFAMTETGHGSNVQALGTVARYDADAREFVITTEGDQARKDYIGNAARHGELAVVFAQLEVGGTAEGVHAFVVPIRTAGEVAPGVRIEDDGRKMGLNGVDNGRIRFDGVRVPREALLNRFADVTPEGVYKSTIDNPDRRFFTMLGTLVQGRVSVGGAGVNAAKVALAVATKYALRRRQFATGSQGEEQLLLDYGLHQRRLLPLIGQTYALHFAQDVLRAQLHDVFSGLEDDPGARRRLEARAAGTKALGTWHATRAIQECREACGGAGYLAVNRFAALKADSDIFTTFEGDNHVLLQLVAKGLLTDYASEFEDLDQLGMVRHVTSLAVETVIEKTSAHKLLERVRDLLPGGDEWDQEAGLLDSEYQLAMFRYREEHMLAGAARRLKRGIDQKGDPGTVFSQVQDHVIAVARAHMERLVLEAFVDKMRVLPEGGNKVALGLLCDLFALSTIEADRAWFMEHGRLTVQRSKAITREVNDLCRKVRPLAGDLVDAWGIPPELLRAPDLVG

SEQ ID NO: 74 - protein, 653 aa, Streptomyces griseus; identical to SEQ ID NO: 73

SEQ ID NO: 75 - protein, 631 aa, Saccharomonospora paurometabolica
MNALTEALTQVLDGRWAPVRRDVREQLAALEPEVATGLDVEGQRARTAERMRRLADSGKPRLGFPPAQGGGGDVGGAVVSFEMLGLGDLSLMVKAGVQWGLFGGAVQLLGTERHHERYLGEIMSLDLPGCFAMTETGHGSDVQNLRTTATYDADAGEFVVHTPEESARKDYIGNAARDGRMAVVFAQLVTEGRSHGVHAFLVPIRDAEGRPADGVTISDCGPKAGLNGVDNGRLLFDRVHVPRTALLNRYGDVLPDGSYTSPIDSDNRRFFTMLGTLVRGRVSVAGSAGNATKRALALAVRYAERRRQFEAPDGDEVTILDYRAHQRRLLPAVATSYALHFAQEELVAALDELHSATEVDPTRQRALESRAAGLKAVATWHATGAIQAAREACGGAGYLGENILPTLKADTDVFTTFEGDNTVLLQLVAKSLLTNYRDQFEDLSPLATARFVAEQFMGTVIERTAARQAVERLVEATPARDDDEVVFDRGWQCKLFEDREEHIVDGLVRRLRSAGRDDAFAAFNDAQDHVLHAARAHVDRLVLEAFVAAVDRCSDDAARDLLGRVCDLYVLSTVEADRAWFLEHGRLSGSRAKAVSAGVNRLCADLRPHARTLVDAFAVPEELLRAPMLTP

SEQ ID NO: 76 - protein, 631 aa, Saccharomonospora paurometabolica; identical to SEQ ID NO: 75

SEQ ID NO: 77 - protein, 712 aa, Isoptericola variabilis
MTTMSDQRSDRPAGRHDAEPDRVPADGTSASKPEPRVDVDGLAAHLLGRWPDERRRARERAADPRFWKDESLSMDEHRERVLEQLRLMVADEDKQVWLAFPERLGGGDAHGANLAGFEEMVAADPSLQIKAGVQWGLFASAILHLGTPEQQDRLLPGAMDLSVPGAFAMTETGHGSDVASIATTATYDPETEEFVIHTPFRAAWKDYLGNAAVHATAATVFAQLVTKGVNHGVHCFYVPIRDPETMEFLPGVGGEDDGLKGGLRGVDNGRLHFDHVRVPRTDLLARYGSVAPDGTYSSPIESPGRRFFTMLGSLVQGRVSLDGAAIAASKIGLAIATRYGAERRQFASASPVEETVLLDYATHRRRLLPRIAEVYAAHFSHDRLLDLFDDVFSGAKDMPEQREDLETTAAALKATSTRFALDTLQECREACGGAGFLTENRITSLRADLDVYATFEGDNTVLLQLVAKRLVSDYGKHLKAATKTPAGAARFVVDQATDAALHRTGLRRFGQTIADVGDPRRAAGHLRDPETQRELLADRVAEMVEQAALALRPAQKADPETAARIFDENQVALVEAAKAHADLLRWSAFTEALETIEDPGTRRVLTWLRDVFGLTVIERNMAWYLLNGRLSAQRARTVTSYVDRLLLRLRPFAVELVDAWGYGQDHLRAKIASGAEAQRQEEARAHLARLRASGDAPVSEKALHKMGTRLRS

SEQ ID NO: 78 - protein, 634 aa, Pseudonocardia dioxanivorans
MTTAVPTDPRLHALRTLLDGRWSAVREEVREQMGRFRPVEPGLSTEEYRARVLELVHELAATKRPHAGFAPEYGGEGDVGGTVVGFQTLGYGDLSLLVKAGVQWGLFGGAVQVLGTSRHHDEYLRPIMDGELLGCFAMTETGHGSDVQNLRTTGTYDPDTHEFVIDTPEPGARKDYIGNAARDGRMAVVFAQLVTRGETHGVHAFLVPIRDDAGAAMPGVTISDCGEKAGLNGVDNGRLVFDHVRVPRGALLNRFADVAEDGTYSSSIENENRRFFTMLGTLVRGRISVAGGAGSAAQKALALAIRYGAVRRQFADPTTGEEVALLDYRAHQRKLLPALATTYALHLAQEDLVAEMHRLQAPGALGTDEQAQRDLEYRAAGLKAVATWHATATIQACREACGGAGYLAENLLPQLKADSDVFTTFEGDNTVLLQLLAKGLLSEYGRRVGKLGPLGTARFAAGVVAESAAEKTGLNKLSHRVKAFAPRSADAQSRLLHDRAEHLLASLARRLRPALADGADQFGIFNGAQDHLLHAARAHVDAVVYDAVATAVDQVTDVPARELLAQVRDLHALSVIEADRAWFLEHGRLTVAESRAVTAAVNDLCASLRPHARLLVDAFGIPESWLDCPLLHTR

SEQ ID NO: 79 - protein, 712 aa, Isoptericola variabilis; identical to SEQ ID NO: 77

SEQ ID NO: 80 - protein, 634 aa, Pseudonocardia dioxanivorans; identical to SEQ ID NO: 78

SEQ ID NO: 81 - protein, 637 aa, Mycobacterium rhodesiae
MTTTAEHLRNALDGRWRDVKNAVRAELSTEVFRPHYTPNTAIARAKVAEQLKIMAHAGAAEDGFRKEHGGNGDVGAAVTRIEMLAMSDLSLMVKAGVQWGLFGGAIENLGTERHHKAYVQRIIDLDLLGCFGMTETGHGSDVQSLETTATYDPATQEFVINSPTPTSRKDYIGGAAETARVSAVFAQLITEGESHGVHCFVVPLRDADGNDLPGITTSDCLYKGGLPGVDNGRIVFDNVRIPRENLLNKYGDVAEDGTYSSPIENVNRRFFTMLGTLIRGRVTVGGSAAAAARVALDIAVRYALQRKQFSAPGDEGEVLIMDYLVHQRRLFPLIARSYALQFAQNELVARLHDLQTADDPDAEEQRELESRAAGLKAANTWHTSTAIQEAREACGGAGYLAENRLIALRADTDVFTTFEGDNHVLTQLVAKELLTAYADDIKGMSPVEWVRFAANFAGDRVLKRTAAETIMQRILDARQDNEEEGSLFNRGTQVKMFEDREEYLLSSVARRLQGKSKEMSAFDAFNAVQDHVLHTAKAHIDRIVLEAFVAGIDACEDDEARKILDLVCDLYALSVIEDDKAWFIEHRFLSTERAKAVTAGINERCRALRPYAEALVDGFGVPEQLRYAEMLHPEHLD

SEQ ID NO: 82 - protein, 671 aa, Arthrobacter arilaitensis
MSENRINVNALSEQLFGPYAEIRKASRARAADPQLQRDPLLGMDEHRERVLGQLGILVQQEAVQRAFPTEFGGQNDHGGSIAAFEELVAADPSLQIKAGVQWGLFAGAILHLGSEEHHKAWLPGAMNLDTPGAFAMTEIGHGSDVAAVATTATYDEATDEFVIHTPFKAAWKEFLGNAALHGKAATVFAQLITKGVNHGVHCFYVPIRDEAGNFLEGIGGEDDGLKGGLNGIDNGRLHFTNVRVPRTNLLNRYGNVDETGTYSSPIPSPGRRFFTMLGTLVQGRVSLDGAATNASKIALQIAITYGNQRRQFNSTSDTEETTLLDYQRHQRRLITRLARTYAASFAHDGLLEKFDAVFSGREDTDTDRQDLETLAAALKPLSTWDALDTLQEAREACGGAGYIAKNRFTQLYADLDVYVTFEGDNNVLLQLVGKRLLTDYAAEFRKLDTGAMALYVAKQVGTTALHRSGLRSVGQAFADISDERKSANFFKDPDNQRALLTGRIKAKVAEVAGALRTAGKDKAKGAAAFNENQDLLISAARDHGQLLRWEAFTAALENTSDAATKEVLTWLRDVFALSLIEDDLGWYLSNGLLSMQRARTLPGYLNRLLARLRPHAQDLVEAFAYTQDHLRADISSGGEAERQDEAMEYFRKLRASDDAPISEKSLQKPKG

SEQ ID NO: 83 - protein, 671 aa, Arthrobacter arilaitensis; identical to SEQ ID NO: 82

SEQ ID NO: 84 - protein, 685 aa, Thalassiosira pseudonana
VDPSLAAERLATPFTPLKITNFLDGSPQLTDRRRKLEALIIRDPSGVFSNEDNNYMGRTERHTRSIAKFVRLVELCRSAGGEIIHTPEFLTLAATISDDPMPTSLHWVMFVPNIMTLCDAQQQALWLPLCRDWKMIGCYAQTELGHGSNIRALETTATFLKESEEWIIHSPTLTSTKFWPGTLGKTANHAMVIARLIDGSGRDRGIHNFVVPLRSMEDHTLLPGVDTGDIGPKIGYNNMDNGWASFDNVRIPRRNMAMRFATVDEEGKYGRIGGGDGDAASKVAYITMMQVRAYIIHSSNEALAMACTIAIRYSCIRRQGYDADAEKKRNGNAPNEVQVLDYRQQQYRLLPLLAASYAIFFTGKHVLTRLKDIESQLVSGSTAITKTIVGDIHATTSALKSYATTFTADGIEDCRKACGGHGFLVASGLVELSQTYLQSCTVEGDNHMLPQQVIKVLLKLVGAVQSGDAELLKEYEPTDMNYLIKPLQDLVGSTSSQPTKSSFAFPTSAAETDFLDVSTLLRVFQHRTACLLLDVAVNLQSAMTTSTPQQAWNDSLLLMARTSRAHACYLLLRDFANGLNDERSNGSSSCLGKEEIGALTQCLTLLALYWMDQHLEDFLQIEALKPKHIPYLRKALLGVLTSLRPSAVGLCDARDFSDFRLKSSLGKYDGDVYPAIMESARKDPL

SEQ ID NO: 85 - protein, 685 aa, Thalassiosira pseudonana; identical to SEQ ID NO: 84

SEQ ID NO: 86 - protein, 648 aa, Rhodococcus imtechensis
MATTADHLRSTLDGRWREVRERVRAELSGSPDFAPHYTPDLDEARAKTLAQLRLLASNGYAADGFAKDHGGTGDAGAAVTSIEMLAMSDLSLMVKAGVQWGLFGGAIENLGTARHHEAYVKRLVALDLLGCFAMTETGHGSDVQALETTATYDADAGEFVIHSPTPSSRKDYIGGAAQHATMAAVFAQLITGGESQGVHCFVVPIRDEDGNDLPGVHTSDCGYKGGLPGVDNGRITFDQVRIPRENLLNKYADVEPDGTYTSPIDNANRRFFTMVGTLVRGRVTVGGSAGAAARVALSIATRYALQRRQFNAPQAEDEVLLMDYLVHQRRLFPLIARSYALQFAQNELVAKMHEIQSSADADPQEQRELEGRAAGLKVANTWHATRAIQEAREACGGAGYMAENRLTALKADTDVFTTFEGDNHVLTQLVAKELLTSYADEVRGMSPVEWMRFAATTVSDVVKKRTAAQQIIQTILDTRQDNEEDGSLFNRGTQLTMFEDREQYLLSTAARRLQGAQKREENPFDAFNFVQDHVLHAAQAHIDRVVLEAFVAGIDECEDDDARDLLSDVCDLYALSVIEEDKAWFMEHRQLSVERSKAVQRGINERCRSLRPHAQTLIEGLGVPEALLGSAMLDGPGTDTVRKTQIFR

SEQ ID NO: 87 - protein, 648 aa, Rhodococcus imtechensis; identical to SEQ ID NO: 86

SEQ ID NO: 88 - protein, 681 aa, Serinicoccus profundi
MTTSARPQTHTPEPDTDISMPASAGPDATRPHPGEELTELGHALRQATGGRYGPVRDLARATVPADVMVRDPELTMSEARAWTTEALGRLVDLGMAGSGFPVAQGGLDDVGRSCVDFEMTAHGDLSLTVKSGVHFGLYGGAVTALGTDWHHETFLPPNLSLEQIGCYAMTEFGHGSDVASLETTHTYDADTDEIVVHSPTPSATKTYIGAAAHDAHIAAVYGQLVVAGESHGVHVVLVPIRDASGRPADGVTLGDNGAKGGLAGVDNGTITFDQVRVPRSHLLGRYGGIDDDGRYVSDIEGDGKRFFTMLGTLVRGRICVAAGAATASRKALSIATRYALRRRQFSAPGHDGEVLLLDYLAHQRKLIPAIATAYAHMFATNELVERLQELHEMPTKDQEAQRELETRAAGLKAVMTRFGNDTVQMCREACGGAGYLAENGLTVLRGDADVFATFEGDNTVLLQLVAKGLLSGYKEMWGDLDMRGMVQFAARAFGGQFVEATAARPMVERLRTAAARKGEGETLLDRGWHLAMFADRERHVLETLATRLRRRADDQDSFEAFNSAQDHVLLAARTHMDRVVLEAFVAGIEGCEDEAARGVLERLCTLYALSSIDADSGWFQAHNRMSAGRAKAVVTQINSLCGELRPHALELVEGMGIPETWLNSQMLQDDTADRWTPGAQG

SEQ ID NO: 89 - protein, 685 aa, Streptomyces griseus
MSSPFLDRYFVVTVIMNDAAPPSTNDLLTAVLFGPNFRQEHRFWRRLLTTEPFRRPDGGTPDERLALSYHRLRILNDALDSGARLAADPRALAALHEWLGPVDPALTTVAGIHYNLFLGSLLDHDAGAPRDVSDFLALRRVGTFLCTEVAHGNDAAAIETTATYDRERDGFVLHTPHAGAQKFMPNTSPAGGPKSGVVAARLLVDGADHGVFLFLVPLTDAHRALPGVRVRRLPPRMGSPVDHCLTSFDRRFVPRGALLAGQQGRVGDDGRFHSEVPNRRRRFLASIGRVTPGKLSMSACAVGSARVTLAIAVRYAGHRMISGSRAVGRIPVYAHRTHHGPLAGAMATVYAMSLLHRRALDRWESAPEADRGEAERLVAVAKGWITWQARAVIVECRERCGAQGLLENNGMTELFTGIEGAITAEGDNLAVHAKAAAEMLFSATAPEPAEDDGPGGLDDPAFLGRLFAAVEDLWFARARERMAAAPPGDPLGRWNAASSAALRGVEAHACRQADEAYAEAVASLPEGAARQRLSELRRLFALRWIAHNSGALLASGRLTADQVTFLPDAVEDAVAVVAEHTPALVETFALPERLMSDWPIAGPGYADVYDDPEGPWHRGRRAGIRGRAAEFRRPVCGSRRRPLREKVAALGTRGVLLAYWGTTSMLSRWFEKPQVSVDESVRPKA

SEQ ID NO: 90 - protein, 685 aa, Streptomyces griseus; identical to SEQ ID NO: 89

SEQ ID NO: 91 - protein, 703 aa, Arthrobacter ureafaciens
MTEVVDRASSPASPGSTTAAADGAKVAVEPRVDVAALGEQLLGRWADIRLHARDLAGREVVQKVEGLTHTEHRSRVFGQLKYLVDNNAVHRAFPSRLGGSDDHGGNIAGFEELVTADPSLQIKAGVQWGLFGSAVMHLGTREHHDKWLPGIMSLEIPGCFAMTETGHGSDVASIATTATYDEETQEFVIDTPFRAAWKDYIGNAANDGLAAVVFAQLITRKVNHGVHAFYVDLRDPATGDFLPGIGGEDDGIKGGLNGIDNGRLHFTNVRIPRTNLLNRYGDVAVDGTYSSTIESPGRRFFTMLGTLVQGRVSLDGAAVAASKVALQSAIHYAAERRQFNATSPTEEEVLLDYQRHQRRLFTRLATTYAASFAHEQLLQKFDDVFSGAHDTDADRQDLETLAAALKPLSTWHALDTLQECREACGGAGFLIENRFASLRADLDVYVTFEGDNTVLLQLVAKRLLADYAKEFRGANFGVLARYVVDQAAGVALHRTGLRQVAQFVADSGSVQKSALALRDEEGQRTLLTDRVQSMVAEVGAALKGAGKLPQHQAAALFNQHQNELIEAAQAHAELLQWEAFTEALAKVDDAGTKEVLTRLRDLFGLSLIEKHLSWYLMNGRLSMQRGRTVGTYINRLLVKIRPHALDLVDAFGYGAEHLRAAIATGAEATRQDEARTYFRQQRASGSAPADEKTLLAIKAGKSR

SEQ ID NO: 92 - protein, 665 aa, Glycine max
MEGMVDHLAFERNNSQFDVDEMKIVWAGSRHAFEVSDKMARLVASDPAFRKDDRVVLDRKALFKNTLRKAAYAWKRIIELRLSEEEAAMLRSFVDQPAFTDLHWGMFVPAIKGQGTEEQQKKWLPLAHKMQIIGCYAQTELGHGSNVQGLETTATFDPRTDEFVIHSPTLTSSKWWPGGLGKVSTHAVVYARLITDGQDHGVHGFIVQLRSLDDHLPLPGITVGDIGMKFGNGAYNSMDNGMLRFDHVRIPRNQMLMRVSQVTREGKYVQSSVPRQLVYGTMVYVRQTIVSDASVALSRAVCIATRYSAVRRQFGSKEGGLETQVIDYKTQQARLFPLLASAYAFRFVGEWLKWLYMDVMKRLQASDFSTLPEAHACTAGLKSLTTSATADGIEECRKLCGGHGYLCSSGLPELFAVYIPTCTYEGDNTVLLLQVARHLIKTISQLGSRNKPVGTTSYIGRVEQLMQYRSDVQKVEDWLKPNAVLGAFEARAAKKVVACAQNLSKFTNPEEGFQELSVDLVEAAVAHCQLIVVSKFIEKLQQDIPGKGVKQQLELLCSIYALFLLHKHLGDFLATGCITPKQGSLANELLRSLYSQVRPNAIALVDAFNYTDHYLGSVLGRYDGDVYPKLYEEAWKDPLNDSVVPDGFQEYIRPMLKQQLRNARL

SEQ ID NO: 93 - protein, 664 aa, Glycine max
MEDGVDHLAFERNKAQFDVEDMKIIWAGSRQDFELSDRISRLVASDPAFRKDDRTRLIGRLFKNTLRKAAYAWKRINELRLNEQEAYKLRSFVDQPAFTDLHWGMFVPAIQGQGTDEQQQKWLPLAYGMQIIGCYAQTELGHGSNVQGLETTATFDPKTDEFVIHSPTLTSSKWWPGGLGKISTHAVAYARLIIGGEDHGVHGFIVQLRSLDDHLPLPGITIGDIGMKFGNAAYNTMDNGVLRFDHVRIPRNQMLMRVSQVTREGRYVSSNVPRQLVYGTMVNVRQKIVADASVALSRAVCIATRYSAVRRQFGSHNGGLETQVIDYKTQQARLFPLLASAYAFRFVGGWLKWLYMDVTERLQANDFSTLPEAHACTAGLKSLTTTATADGIEECRKLCGGHGYLCSSGLPELFAVYVPACTYEGDNVVLLLQVARHLMKTVSQLGSGNKPVGTTAYMARVEQLMQYHSDVEKAEDWLKPNVVLEAFEARASRMSVACAQNLSKFANPEEGFQELAADLVDAAVAHCQLIVVSKFIEKLQQDIPGKGVKKQLEVLCSIYALFLLHKHLGDFLSTGCINPKQGSLASEQLRNLYSQVRPNAIALVDAFNYTDHYLGSILGRYDGNVYPKMNEEAWKDPLNDSVVPDGFKEYIQPMLKQQLRNARL

SEQ ID NO: 94 - protein, 660 aa, Homo sapiens [sequence omitted]

SEQ ID NO: 95 - protein, 660 aa, Homo sapiens [sequence omitted]

SEQ ID NO: 96 - protein, 684 aa, Gordonia polyisoprenivorans
MSTPTQSPTANPDDTTSSRSTAASTDVDVPGREESTELDQATRELLVDGLRRTLDGRWRATRDGVRERANRSDLLPDPSHTLDEARARVLEEMRELSSQGFAAAGFASDHGGTGDVGASITAIEMLGYADLSLMVKAGVQWGLFGGAVENLGTKRHHDRYVSDIISLDLLGCFAMTETGHGSNVQALETTATYDPQTQEFVIDSPTPSARKDYIGGAAQHARVAAVFAQLITAGPGQEPESHGVHCFVVPIRDDNGDDLPGVTTSDCGYKGGLAGVDNGQILFDHVRIPAENLLNRYADVEADGTYRSPIENPNRRFFTMLGTLIRGRVSVAATAGAAGRKALALATKYGTVRKQFEAPGADDEITVLDYLGHQRKLLPLIAKSYAITCTQNELVAELHEVQSAAPDDSDAGRQRQLESSAAGLKAYGTWHASHAINVSREACGGAGYLDENQLSIMRGDIDVFTTFEGDNTVLTQLVAKELLSAYADDVQGLSAGGWVRFIAGMARDVVVEKTAARQVIQTLLESSDEDTEKSTLTDRGTQIRLFRNREDHLVRTCAQRLRRATDDDNDAFEVFNNAQDHLLKVGRVHTERVVLESFIEAINDCDSKAAAELLGKVCDLFVYSALEDDLAWFLMHRHVSVERAKAIRRGVNELCLELRPYADVLVDAFGIPENLLVAPMIENG

SEQ ID NO: 97 - protein, 648 aa, Rhodococcus jostii
MATKADHLRSTLDGRWREVRERVRAELSGSPDFAPHYTPDLDEARAKTLAQLRLLASNGYAADGFAKDHGGTGDAGAAVTSIEMLAMSDLSLMVKAGVQWGLFGGAIENLGTARHHEAYVKRLVDLDLLGCFAMTETGHGSDVQALETTATYDADAGEFVIHSPTPSSRKDYIGGAAQHATMAAVFAQLITGGESQGVHCFVVPIRDEDGNDLPGVHTSDCGYKGGLPGVDNGRITFDQVRIPRENLLNKYADVEPDGTYTSPIDNANRRFFTMVGTLVRGRVTVGGSAGAAARVALSIATRYALQRRQFNAPQAEDEVLLMDYLVHQRRLFPLIARSYALQFAQNELVAKMHEIQSSADADPQEQRELEGRAAGLKVANTWHATRAIQEAREACGGAGYMAENRLTALKADTDVFTTFEGDNHVLTQLVAKELLTSYADEVRGMSPVEWMRFAATTVSDVVKKRTAAQQIIQTILDTRQDNEEDGSLFNRGTQLTMFEDREQYLLATAARRLQGAQKREENPFDAFNFVQDHVLHAAQAHIDRIVLEAFVAGIDECEDDDARDLLSDVCDLYALSVIEEDKAWFMEHRQLSVERSKAVQRGINERCRSLRPHAQTLIEGLGVPEALLGSAMLDGPGTDTVRKTQIFR

SEQ ID NO: 98 - protein, 592 aa, Streptomyces griseus
MTDSQIPDTADASLALADVLFAGQLGTTHARWRRLFSSTPFRFEEGLTHRERIDLSYDRLRLVNEAVQAPQVLANDPAELTAIHEWGGAVDPGMATIVAIHYNLFFGSLADHEAAGRDLGEYVRADRIGTFLCTEIAHGNDAAHMETTATYDRAARGFVLHTPTPAAAKFMPNTSPAGGAKGAVVAARLIVDGTDHGVFLFLTPLSDSDGSPLPGVEVRALPQTASSPVDHCATTFHRVRLPYSALLQGDHGRLTPDGEFTSALGSPRRRFLQSIGRVTMGKLCMTAHSLGVMRHALDIAMRYAHTRVTSGMTNGQRVPLIAHRGHHTPLLDAAATTYAATLLQRSVVRQWDRAAGEEREAYERLTAISKAWITWRARAVMTECRERCGAQGLIQSNGIALQLASIEGTITAEGDNQVIMQKAGGEMLLGGVDLKPESEIAPADRELTDPQHLQDLLADIERISHTRAKARLRQRAGSPLARWNATVTPAVALADAHVHRLAAECLLTAAGQVPSGLPEDLLRGLHALFALRRIAAHSGDLLARGRMTADQVEQLPDAVEAVLGFLEPHALTLTSAFAVPEALLETHPMLSA

SEQ ID NO: 99 - protein, 648 aa, Rhodococcus jostii; identical to SEQ ID NO: 97

SEQ ID NO: 100 - protein, 592 aa, Streptomyces griseus; identical to SEQ ID NO: 98

SEQ ID NO: 101 - protein, 653 aa, Streptomyces griseus
MTTDKAATAPGGYVRPELDVRALTEVLDGEYAEVRDLVRANLVTHLPVLEEADELDVDAFRERVRERVVEMAATGQTGMGFPQRYGGGGDIGASIAAFETLAFGDLSVLVKVGVQFGLFGGAILHLGTERHHDAYLPDLITGKLMGCFAMTETGHGSNVQALGTVARYDADAREFVITTEGDQARKDYIGNAARHGELAVVFAQLEVGGTAEGVHAFVVPIRTAGEVAPGVRIEDDGRKMGLNGVDNGRIRFDGVRVPREALLNRFADVTPEGVYKSTIDNPDRRFFTMLGTLVQGRVSVGGAGVNAAKVALAVATKYALRRRQFATGSQGEEQLLLDYGLHQRRLLPLIAQSYALHFAQDVLRAQLHDVFSGLEDDPGARRRLEARAAGTKALGTWHATRAIQECREACGGAGYLAVNRFAALKADSDIFTTFEGDNHVLLQLVAKGLLTDYASEFEDLDQLGMVRHVTSLAVETVIEKTSAHKLLERVRDLLPGGDEWDQEAGLLDSEYQLAMFRYREEHMLAGAARRLKRGIDQKGDPGTVFSQVQDHVIAVARAHVERLVLEAFVDKMRALPEGGNKVALGLLCDLFALSTIEADRAWFMEHGRLTVQRSKAITREVNDLCRKVRPLAGDLVDAWGIPPELLRAPDLVG

SEQ ID NO: 102 - protein, 648 aa, Rhodococcus opacus
MATTADHLRSTLDGRWREVRERVRAELSGSPDFAPHYTPDLDEARAKTLAQLRLLASNGYAADGFAKDHGGTGDAGAAVTSIEMLAMSDLSLMVKAGVQWGLFGGAIENLGTARHHEAYVKRLVDLDLLGCFAMTETGHGSDVQALETTATYDADAGEFVIHSPTPSSRKDYIGGAAQHATMAAVFAQLITGGESQGVHCFVVPIRDEDGNDLPGVHTSDCGYKGGLPGVDNGRITFDQVRIPRENLLNKYADVEPDGTYTSPIDNANRRFFTMVGTLVRGRVTVGGSAGAAARVALSIATRYALQRRQFNAPQDEDEVLLMDYLVHQRRLFPLIARSYALQFAQNELVAKMHEIQSSADADPQEQRELEGRAAGLKVANTWHATRAIQEAREACGGAGYMAENRLTALKADTDVFTTFEGDNHVLTQLVAKELLTSYADEVRGMSPVEWMRFAATTVSDVVKKRTAAQQIIQTILDTRQDNEEDGSLFNRGTQLTMFEDREQYLLSTAARRLQGAQKREENPFDAFNFVQDHVLHAAQAHIDRVVLEAFVAGIDECEDDEARELLSDVCDLYALSVIEEDKAWFMEHRQLSVERSKAVQRGINERCRSLRPHAQTLIEGLGVPEALLGSAMLDGPGTDTVRKTQIFR

SEQ ID NO: 103 - protein, 675 aa, Arabidopsis thaliana
MSDNRALRRAHVLANHILQSNPPSSNPSLSRELCLQYSPPELNESYGFDVKEMRKLLDGHNVVDRDWIYGLMMQSNLFNRKERGGKIFVSPDYNQTMEQQREITMKRIWYLLENGVFKGWLTETGPEAELRKLALLEVCGIYDHSVSIKVGVHFFLWGNAVKFFGTKRHHEKWLKNTEDYVVKGCFAMTELGHGSNVRGIETVTTYDPKTEEFVINTPCESAQKYWIGGAANHATHTIVFSQLHINGTNQGVHAFIAQIRDQDGSICPNIRIADCGHKIGLNGVDNGRIWFDNLRIPRENLLNAVADVSSDGKYVSSIKDPDQRFGAFMAPLTSGRVTIASSAIYSAKVGLSIAIRYSLSRRAFSVTANGPEVLLLDYPSHQRRLLPLLAKTYAMSFAANELKMIYVKRTPETNKAIHVVSSGFKAVLTWHNMHTLQECREAVGGQGVKTENLVGQLKGEFDVQTTFEGDNNVLMQQVSKALFAEYVSCKKRNKPFKGLGLEHMNSPRPVLPTQLTSSTLRCSQFQTNVFCLRERDLLEQFTSEVAQLQGRGESREFSFLLSHQLAEDLGKAFTEKAILQTILDAEAKLPTGSVKDVLGLVRSMYALISLEEDPSLLRYGYLSQDNVGDVRREVSKLCGELRPHALALVTSFGIPDSFLSPIAFNWVEANAWSSV

SEQ ID NO: 104 - protein, 731 aa, Corynebacterium resistens
MSQPREPQNSHLTDPSIADEENITTAQTEGAPTNVTDATSSTEKKAKKQDIRRSKAAPATLNADPSASVQKHVARELKKILDGSFPEARARIRKDVLSNPDSLPVYDQDLEGSRAHTTDQLQMVLESGLPYGAFRKDQGGTGETGQTLTSIEMLGHIDLSLMVKSGVQWGLFGGAVGNLGTERHSELVKDLIELRALGCFAMTERGHGSDVQSLETTATYDPETQEFIINSPTASAEKWFIGNAARDGRFAAVFCQLYTPGVEESHGVHCIVARIREDDGSAIPGVRLGDHGYKGGLKGVDNGTLSFENYRVPRENLLNRFADVDAEGNYSSPIENPNRRFFTMLGALVRGRVTVGAAAGAAARTALGIGVNYANIRRQFAADDSLPEKRLIEHRQHRLRLVPRIARAYALQLATNNLISRVHDLDQLGLDPTNMTKEQQSDQREVEAHAAALKAANTAHATDTIQEMREACGGAGYMAENLLTTLKADSDVFTTFEGDNVVMLQLAAKELMTGFAREVGSLRPMEMVRFGLDNFSTLLRRRTAADALIQNLVDTFSDSDETSLFDPSFQVKLIEERENRLMVSLARRLRPAKKMDIEEAAEVVDNAQDHLISVAWAHIDRILFEALLEAESEVESEDARRVFEQVRHVFFLDMIKTNAAWYLEQNLLTGTRTKAARAALNDLVDSLGPWSKPLVDAFGIPDSILNVTLMQDPASLTPKYESSPAAGQSDN

SEQ ID NO: 105 - protein, 635 aa, Coccomyxa subellipsoidea
MAAERRVAALSRHLTSSSDVSLSAKVDLRDFAAEDVYLFLTRDNVELRAKMLDFLKDPMYRPNYYLSLMEFRDLTLRRLQKFVDQKFFSTFDYLNDPLRFMAGLETLASVDYSLCIKAGVHFTLCGGTIAKLGTEKHHKTFLPRLDTLELPGCFGMTELGHGSNVMGIETQATYDEETGEFVINTPTDTASKFWIGGAAQHGKVCTVFAQLTVRGKWEGPHVFVVRLRDDSGQPMPGVRIQDNGPKAGLNGVDNGQLWFYNVRVPRDALLDRYSSVAPDGTYSSPIPSVAQRFGTMVGGLTTGRMLIAQGAIDASKIGVAIALRYACARPQFNGKCIMEYLTHQRRLLPALATTYAMQLQSLRLKDLYMAKRPEDAKTIHVVSSGLKAGATWHRVEILQACRECCGGQGFLAANKIGPMKNDMDVDVTFEGDNTVMMQQVAKALLDTAAKKPPRPQMPSMEGASVTDLTLLAALLRFREDSLTAEVAAAIGRAAKVAAPGGKKAAVAAAADAYEDNLDTVLQLGWAHVDRITFEGFVEEVNTRAPREARPVLSLLATLYGLTRVERALAFYLASGAASGAAAAAVRAGVNGACAALSADGGWAALRLAEGFGIPDHCLEAPIAFDWRQIGSTVTM

SEQ ID NO: 106 - protein, 717 aa, Corynebacterium jeikeium
MSPNNSENTTENTATTDNSVTSNSADGIADKSGNKFRRSTSAPKTLSTAPTAETQASIAKALQTVLDGDFPEAREETRSLLADPDILPRTDLDLEQSRTRTTEQLQRVLESGVPNHAFRADQGGTGETGRCLTSIEMLGHADLSLMVKSGVQWGLFGGAVGNLGTERHQEIVGKLMNLEALGCFAMTERGHGSDVQQLETTATYDAATQEFIINSPTASAEKWFIGNAARDGRWAAVFAQLIVPKAKGETESQGVHCLLVRIREDDGSAIDGVRIGDHGYKGGLKGVDNGTISFDNHRVPREALLNRFADVDEAGNYTSPIENPNRRFFTMLGALVRGRVTVGAAAGAAARTALDIAVTYANLRRQFAPDDSLPENRLIEHRWHRLRLIPRVARAYGLQFATNKLIARVHELGQRGVEPTEYTKEQQADQREVEAHAAALKAANTAHATDAIQEAREACGGAGYMAENLLTTLKADSDVFTTFEGDNVVMMQLAAKELMTGFAKELGGLNPMEMVRFGLDSFGNLLRRRTAADALIQNLVDTFSDSEETSLFDPAYQINLLSEREDRLMRSLARRLRPARKMDVDEAAKVVDQAQDHLLAVGWAHVDRIVFEAFVEAESKLDSEDAQRVLEQVRLVYFLSCIVDNASWYLEQNLLTGTRTKAARAALNDLVDSLGPWSQTLVDAFGIPDHITDLKLMEDYEAMVPKYESDPAAGQAE

SEQ ID NO: 107 - protein, 717 aa, Corynebacterium jeikeium; identical to SEQ ID NO: 106

SEQ ID NO: 108 - protein, 731 aa, Corynebacterium resistens; identical to SEQ ID NO: 104

SEQ ID NO: 109 - protein, 644 aa, Saccharopolyspora spinosa
MGTTGFDAGELATLLDGRWAGIRKQVRDALDGVPLQPGDDLDTESHRAQTLEQLRLLAKSGITDLGFPVAYGGRGDTGGAVVSLEMLAGNLSLMVKAGVQWGLFGGAVVALGTERHHERYLRDIISLDLPGCFAMTETGHGSDVQHLRTTATYDAATQEFVVHTPHEAARKEYIGNAARDGRLAVVFAQLITGDKSHGVHALLVPIRDEAGQALPGVRIEDCGRKAGLNGVDNGRLTFDQVRIPREALLNRYADVDPDGTYRSPIASQSKRFFTMLGTLIRGRISVAGTAGSATKLALEIALRYGDARRQFERPGTGRETVVLDYLAHQRKLLPALAKTFALHFAQEELVSTLHDAPGGEREQRELESRAAGLKAMSTWHATQTIQTCREACGGAGYLAENQLAQLKADTDVFTTFEGDNTVLLQLVAKGLLTNYKDQFDDLGTLGMAKFVADQFVGAVIERTATRSLVQRIIDGSGKDDILDRGWQLKLFDDRERHVLDGLGRRLRKANRENAFEVFNNAQDHVLRAARVHVDRIVLEAFVAAIERCRDRRTAALLNKLCDLYVLSNIEADSGWFLEHERITPRRSKAITEAINALCGQLRPHAVDLVTAFGLPRQWLTAPIATGAEARRQEAQHAQHAHETS

SEQ ID NO: 110 - protein, 703 aa, Komagataella pastoris
MFKIESIKSQSPQVAIDKERKATKFDINKMFEFLESGKDEAALTKSLMQQIERDTILKTNASYYDLTKDQHRELTAQKIARLATYIEKDAPFFENFQKRLNLIAIVDPQLGTRVGVHLGLFLSAIRGNGTEEQFKYWAFERGAAYLKDVYGCFGMTELAHGSNVAGLETTATFDQKTKEFEINTPHLGATKWWIGGAAHSANHCVVYARLIVSGKDYGVKTFVVPIRDRNHNLHSGVAIGDIGAKMGRDGIDNGWIQFTNVRIPMNYMLSKFTKVDSETGDVEVPPLEQLAYGALLGGRVTMVTDSFRMAQRFITIALRYSVGRRQFGAKNSSEELKLIDYPLHQRRLLPYLALTYALSISSFDLSQTYDSVLSNLDAAGKSQDFSKLGQAIAGLKNLFCASASLKSTATWYVAQLIDECRQACGGHGYSSYSGFGKAYNDWVVQCTWEGDNNILASNAGRIIVQSIIKLQEKEKKIKGDLSYLNGISNIDKEAILLPNKQSMTNLSKLINAYQGTIIRLGVRCAESIGSKKSTWDDIAAQRVVLSKLNAVLYMLQHLVLKIKQLGDEEAHKQYLVQIAALFATSQIEMNFASYFLQFKAIDSLEPVADVVSELCLSVRDQVIGLTDSFQFSDYFINSALGSHSGDIYNTYFDTVNNLNNPQVRDGKAAYSEALEAMLRRDPLEVRECFEKSDKVLKKLAPKI

SEQ ID NO: 111 - protein, 710 aa, Corynebacterium bovis
MSQNTPHPTDDGTVTPGTTTGDAAHATPSTTGGRSIRRSQDAPAKLSEVADPSVTPELQAVLDGHWADAKQAVRASLSEGDVRADPTLDLEASRQRTLDQVRALAESGMPRGAFSVEHGGSGDTGATLTSIELLGHADLSLMVKAGVQWGLWGGAVENLGTERHVPLIKDIIDLRVLGCFGMTERGHGSDVQSLETTATYDPETQEFIVNSPTPSSEKWFIGNAARDARMAAVFCQLHTPGEEESHGVHCLVVPIRDENGAPLPGVRIGDHGYKGGLKGVDNGTLAFDHVRVPRENLLNKFADVSEDGTYSSPIENPNRRFFTMLGALIRGRITVGAAAGASARTALDIAVRYADLRRQFSAGDGLPEKRLIDHRNHRLRLLPRVARAYGLQLATNKLIARVHELEHRITDRTAMSEEDQWDQRELEAHAAALKAANTAHATDTIQECREACGGAGYMTENFLTTLKADSDVFTTFEGDNAVMIQLAAKELLTGFAREVGGLNPLEMVRFGLDSFGTLLKRRTAAETLIQNLVDSVTNQEETSLFDPAYQIELLSNREDSLLRSLVRRLRPAQKMETEEAAQVVDRAQDHLIACGWAHVDRIILEAFLEAESELESETARQVLEQVRDTYFLSLITEHAGWYQEQNLLTGTRTKAARAALNDLVDSLAPWSTVLVDAFAVPSTLTSVPLLTDYADMEWYADTHPAHPSEG

SEQ ID NO: 112 - protein, 694 aa, Petroselinum crispum
MESSSSSPLHSNPTAENDDQTTARRIQRLSLHLNPTLTDNTTIEMVTCAARAKLNVNTTQLTLFMRGKHRDLQEKVYEFFRSRPDLQTPIEISTEKHRELCMKQLLALVREAGIKPFKYVVDDPFVYFAIGEAAGSVDVSFGIKLGVQYSLWGGSVLNLGTKKHRDKYFDAIDNVEYPGCFAMTELHHGSNVQGLQTVATFDPLTDEFVIDTPNDGAIKWWIGNAAVHGKFATVFAKLMLPTHDARGYSDMGVHAFIVPIRDMETHETLPGVEIQDCGHKVGLNGVDNGALRFRSVRIPRDNLLNRFGDVARDGTYTSSLPTINKRFAATLGELVGGRVGLAYSSVGILKVAVTIATRYSLFRQQFGPPKQAEISILDYQSHQHKLMPMLASTYAFHFATLLLVEKYSEMKKTHDEELVADVHALSAGLKAYVTGYTSKSLSICREACGGHGYAAVNRFGSLRNDHDIFQTFEGDNTVLLQQVAADLLKQYKEKFKGGTLTVTWNYLRESMNAYLSQPNPLTSRWEGEDHLRDPKFQLDAFRYRTSRLLQSAAVRLQKHSKNLGGFGAWNRCLNHLLTLAESHIESVILETFIKAVKNCPDASSRAALKLVCDLYAMDRIWNDIGTYRNVDYMAPNKAKAIHKLTEYLSFQVRNITRELVDAFDMPDHVIRAPIGKQTPVEAYSEYRQHVGFQM

SEQ ID NO: 113 - protein, 692 aa, Arabidopsis thaliana
MESRREKNPMTEEESDGLIAARRIQRLSLHLSPSLTLSPSLPLVQTETCSARSKKLDVNGEALSLYMRGKHIDIQEKIFDFFNSRPDLQTPIEISKDDHRELCMNQLIGLVREAGVRPFRYVADDPEKYFAIMEAVGSVDMSLGIKMGVQYSLWGGSVINLGTKKHRDKYFDGIDNLDYTGCFAMTELHHGSNVQGLQTTATFDPLKDEFVIDTPNDGAIKWWIGNAAVHGKFATVFARLILPTHDSKGVSDMGVHAFIVPIRDMKTHQTLPGVEIQDCGHKVGLNGVDNGALRFRSVRIPRDNLLNRFGDVSRDGTYTSSLPTINKRFGATLGELVGGRVGLAYASVGVLKISATIAIRYSLLRQQFGPPKQPEVSILDYQSQQHKLMPMLASTYAYHFATVYLVEKYSEMKKTHDEQLVADVHALSAGLKSYVTSYTAKALSVCREACGGHGYAAVNRFGSLRNDHDIFQTFEGDNTVLLQQVAADLLKRYKEKFQGGTLTVTWSYLRESMNTYLSQPNPVTARWEGEDHLRDPKFQLDAFRYRTSRLLQNVAARLQKHSKTLGGFGAWNRCLNHLLTLAESHIETVILAKFIEAVKNCPDPSAKAALKLACDLYALDRIWKDIGTYRNVDYVAPNKAKAIHKLTEYLSFQVRNVAKELVDAFELPDHVTRAPIAMQSDAYSQYTQVVGF

SEQ ID NO: 114 - protein, 433 aa, Myxococcus xanthus
LEVGGRVLGVHALLVPLRDPAGKVLPGIRIEDCGEKMGLNGVDNGRIWFEHVRVPRENLLDRFGQVNAQGEYTSAITGDSKRFFTMLGTLVAGRVSVAAAALSAAKSGLTIAVRYGDLRRQFGPAGDKEFRLLDHQAHQRRLLVPLAKTYAMDFALEYLVERYVKRTEEDAREVESLAAGLKAYSTWHTTAVLQEAREACGGQGYLQANRLAALKADTDVFTTFEGDNTVLMQLVAKGLLTGYRQRFEDDRVFAVLKLLADRATAVVDRNPFAARRTDSDHLRDNDYHLRALRFREEELLATVSQRIRKRLSAGVEAFEAFNQVQVHLLELAHAHVERLVLEQFLKGVADVKDPGLKTVLGRLCDLYGLSCLESANGWFQEHGWLEGTKVKAIRKEVTRLCAELRPDAVALVNAFGVPDTCLAAPIGLGHLSP

SEQ ID NO: 115 - protein, 709 aa, Phalaenopsis sp.
MFTRPMEGGGMTKEAQMTSLASEHDTQRALRRIQKLSLHLLQPSPFLDPESSGDKNWIVPSPCTGGRGRPLLSVSRAELVEYMTGRHREIQERVFNFFVSRPELQTPVEISTADHRVLCMRQLTALVREAGIRPFRYAIEDPSVYFAIVEAVGGIDISLGIKLGVQYSLWGGSVMNLGTKKHKEKYFKGIDNIDYPGCFAMTELHHGSNVQGLQTTATFDPLTDEFVINTPNDGAIKWWIGNAAVHGKFATVFARLILPFQGKGGKSIDMGVHAFIVPIRDMETHDTLPMVEIHDCGHKVGLNGVDNGALRFQSVRIPRDNLLNRFGDVSRDGTYTSSLPTINKRFAATLGELVGGRVGLAYSSVGVLKVSVTIAVRYSLLRQQFGPPKQPEISILDYQSQQHKLMPMLASTYAFHFATLYLIDKYSEMKKSHDDDIVGDVHALSAGLKAYVTSYTAKSISVCRESCGGHGYAAVNRFGVLRNDHDIFQTFEGDNTVLLQQVAGDLLKQYKSKFRGGTLTVTWNYLRESMASYIAQPNPVTARWQGEEHLRDPNFQLDAFRYRTSRLLQSLGLRLRKHTKTLGGFGAWNRCLNHLLTLAESHIESVILAKFIEAVQKCPDKNTGNVLKLLCDLYALDRIWNDIGTYRNVDYVAPNKAKAIHKLVDYLSFQVRGIAGELVDAFGLPEIVIRAPIGMSSEAYSQYTEYVGF

SEQ ID NO: 116 - protein, 709 aa, Candida tropicalis
MTFTKKNVSVSQGPDPRTSIQTERANSKFDPVTMNYFLEGSKERSELMKSLAQQIERDPILFTDGSYYDLTKDQQRELTVLKINRLSRYREGDSVDTFNKRLSIMGVVDPQVATRIGVNLGLFLSCISGNGTAEQFKYWAIDKGTHNIQGLYGCFGMTELGHGSNVAGVETTATFDKETDEFVINTSHIGATKWWIGGAAHSATHCSVYARLVVDGKDYGVKTFVVPLRDSNHDLMPGVTVGDIGAKMGRDGIDNGWIQFSNVRIPRFFMLQKFCKVSAEGEVVLPPLEQLSYSALLGGRVMMVLDSYRMLARVSTIALRYAIGRRQFKGDNVDQNDPNALETQLIDYPLHQKRLFPYLAAAYVVSTGALKVEHTIQSTLATLDAAVENNDTTAIFKSIDDMKSLFIDSGSLKATTTWLAAEAIDQCRQACGGHGYSSYNGFAKAFNDWVVQCTWEGDNNVLSLSVGKPIIKQIIGIEDSGKTVRGSTAFLNQVKDFTGSNASKVVLNNTSDLNDINKVIKSIEVAIIRLAHEAAISVRKESLDFAGAELVQISKLKAHHYLLTEFVKRVGEFEHKELVPFLNTIGRLYSATVVLDKFAGVFLTFNVASPQAITDLASTQIPKLCAEVRPNVVAYTDSFQQSDMVINSAIGKYDGDVYENYFDLVKQLNPPKNTKAPYTAALEGMLNRPSLEARERYEKSDETAAILSK

SEQ ID NO: 117 - protein, 709 aa, Candida tropicalis
MTFTKKNVSVSQGPDPRTSIQTERANSKFDPVTMNYFLEGSKERSELMKSLAQQIERDPILFTDGSYYDLTKDQQRELTVLKINRLSRYREGDSVDTFNKRLSIMGVVDPQVATRIGVNLGLFLSCISGNGTAEQFKYWAIDKGTHNIQGLYGCFGMTELGHGSNVAGVETTATFDKETDEFVINTPHIGATKWWIGGAAHSATHCSVYARLVVDGKDYGVKTFVVPLRDSNHDLMPGVTVGDIGAKMGRDGIDNGWIQFSNVRIPRFFMLQKFCKVSAEGEVVLPPLEQLSYSALLGGRVMMVLDSYRMLARVSTIALRYAIGRRQFKGDNVDQNDPNALETQLIDYPLHQKRLFPYLAAAYVVSTGALKVEHTIQSTLATLDAAVENNDTTAIFKSIDDMKSLFIDSGSLKATTTWLAAEAIDQCRQACGGHGYSSYNGFAKAFNDWVVQCTWEGDNNVLSLSVGKPIIKQIIGIEDNGKTVRGSTAFLNQVKDFTGSNASKVVLNNTSDLNDINKVIKSIEVAIIRLAHEAAISVRKESLDFAGAELVQISKLKAHHYLLTEFVKRVGEFEHKELVPFLNTIGRLYSATVVLDKFAGVFLTFNVASPQAITDLASTQIPKLCAEVRPNVVAYTDSFQQSDMVINSAIGKYDGDVYENYFDLVKQLNPPKNTKAPYTAALEGMLNRPSLEARERYEKSDETAAILSK

SEQ ID NO: 118 - protein, 721 aa, Corynebacterium variabile
MQCGPTFKARPAYVSSGGMTNTDTTGLTRRDGDTPEKLRALADDAQRAAVAAELKAALDGPYAEARDAARALIDAKGLRADDTLPLDEARERTMSQLFDVLSTGSPRGSFRKDHGGTEDIGATLASLETVGGADLSLMVKAGVQWGLWGGAVENLGTDRHIPLIKDIMELRVPGSFGMTERGHGSDVQSLETTAVYDRATGEFVIHTPTPMAEKWYIGNAAKDATKAAVFCQLYTPAGDYEEPADASVPGSWGETHGVHCLVVDLRDAEGRVLPDVHIGDHMYKGGLKGVDNGTLRFDHVRVPRENLLNRFADVSEAGEYSSPIESDGARFFTMLGALIRGRITVGASAGSAARTSLAIATKYANKRRQFAADDSLPESKLIEHRKHRLRLIPLIAKSYALQTASNKLISRLNELETSIPDRTNMTKEQSADQRELEAHAAALKAANTTHATRTIQECREACGGAGYMAENLLTTFKDDSDVFTTFEGDNVVMIQLAAKELLTGFSREMGNLGPLEIVRFGLDNFGTLLKRRTAAEKIIQNLVDSVTDRETTSLFDPAYQVELLTEREDRLLMSLIRRIRPAQKMSTEDAAALVDSCQDHMLSCAWAHVDRIVLETLLETESALPDSQAKKIMEQIRDVYVLDIINGNSGWYQEQNLLNGARTKAARAALNDLVDSLGPWSETLVDAFAVPASVLDVPLLEDVSDPTALTFRSVTNPAAGM

SEQ ID NO: 119 - protein, 646 aa, Mycobacterium xenopi
MASNPVTTAEHLRNALDGRWRDAKNQMRARLADEIFRPHYTPNTVIARTKVAEQMKIMAAAGAAESAFRKEHGGTGDLGAAITAIEMLAMSDLSLMVKAGVQWGLFGGAVENLGTERHHQAYVKKIINLELRGCFAMTETGHGSDVQSLETTATYDAATQEFVIDSPTPTARKDYIGGAAETATVAAVFAQLITEHDGAPVNHGVHCFLVPIRDAEGNDLPGVTTSDCDYKGGLPGVDNGRIVFDQVRIPRENLLNRYGDVAPDGTYSSPIENPNRRFFTMLDTLVRGRITVGGSAAAAARVALDIATRYALQRKQFSAPDDDSEVLIMDYLVHQRRLLPLIAKSYALQFAQNELVAKCHDIQTADEPDAEEQRELASRAAGLKAANTWHATRAIQEAREACGGAGYMAENRLIALRGDTDVFTTFEGDNHVLTQLVAKELLTAYADDIRSMSPVEWVRFAANTVGTRVLKRTAAEAIIQTIVDARQDSEEEGSLFNRGTQVKMFEDREEYLLSSVARRLQAKSNEMSAFDAFNAVQDHVLHAASAHVDRVVLEAFVAGIDSCEDDEARHVLELVCDLYALSVIEDDKAWYIEHRFLSTDRAKAVTRGINDRCRALRPYAQTLVDGFGIPEQLRYAEMLHPENLPH

SEQ ID NO: 120 - protein, 646 aa, Mycobacterium xenopi; identical to SEQ ID NO: 119

SEQ ID NO: 121 - protein, 694 aa, Corynebacterium aurimucosum
MALTKSSSDKKPVSPELNNQATTDAPKAEARSPHRLPTTPKLSVAAELAALLDGPHAAFRQELRTFLNDPELFPKADLSMAEQRQHTFENLSKVRDFGGFNHGLRSAHGGAGKPNLSTFTLEGLAWVDGSLAIKSGVQWGLWGGALDQLGTERHLDWINKAASLELPGCFAMTERGHGSDVQSLETTATFDPETDEFIINTPSDSAVKNYIGNAAKDGRAAVVFTQLITPDSDGRSHGVHAIIVPIRDENGNELPGVTLGDHGHKGGLVGVDNGTLRFDNVRVPRENLLNRFADVDEKGKYSSPIESKNARFFTMLGTLIRGRIGVSGAAGAATEASLDIAIRYANRRRQFEGATGAEKRLIEHRQHRRRLLIPLARTYALHLLYNQILERYQEQNDQQESGAWSVTEPTEEQKFASREMESLAAAIKTAQTQHATRTIQECREACGGAGYMSENRLTTYRADSDVFATFEGDNTVLIQMVGKNLLTAYGRAMNDMSPWDTVKYAATTATDVVRRRYGFTTRLQSLVDRVNPSEASLFDATYQAKLIDDRAQSILFSLVRRIQPARKADKVQAAAIVDQCQDHLIAAGWARVDTLLVQAMIEAEERLEEGSLARQVFEQLRHLFVFDTLVQHAGWYQEHNLIPAGRIKAARAAINDLVDSLAPWSIVLVDAFGVPPEVHNIPMLTEAGVDPLHI

SEQ ID NO: 122 - protein, 653 aa, Saccharopolyspora erythraea
MDVPKTPASFDRAELAELLDGRWAQVRTHVRRALTGVDLSPGDHLDTESHRARTLEQLHLLVESGITGLGFPLSHGGQGDTGGSVVSLEMLSGNLSLMVKAGVQWGLFGGAVVALGTDRHHDRYLARIMDLQLPGCFAMTETGHGSDVQRLRTTATYDPATEEFVVHTPHEAARKEYIGNAARDGRMAVVFAQLITRGDRHGVHALLVPIRDERGNPLPGVHIEDCGRKAGLNGVDNGRLTFDHVRVPREALLNRYGDVEPDGTYASPIANESKRFFTMLGTLIRGRISVAGTAGGAAKLALRIALRYADARRQFERPGTGEETVVLDYLAHQRKLLPALAKSFALHFAQEELVSTLHDMQSSDDARAQRELESRAAGLKAVTTWHATQTIQTCREACGGAGYLAENQLPQLKADTDVFTTFEGDNTVLLQLVAKGLLTNYKDQFDDIGTLGMARFVADQFVGAVIERTAARPLVQRLADAAPGKDDENVIFDRGWQLRLFDDREKHVLDGLARRLRRATGKDADPFEVFNNAQDHVLKAARVHVDRVVLEAFVAGIERCRDRDTAAVLERLCDLYVLSTVEEDRAWFLEHERLNSRRAKSVTEAVNALCGRLRPHAVDLVESFGIPDQWLTAPIATGAEAGRQEAQRAYDEG

SEQ ID NO: 123 - protein, 653 aa, Saccharopolyspora erythraea; identical to SEQ ID NO: 122

SEQ ID NO: 124 - protein, 614 aa, Nocardia brasiliensis
MASAEKSAEPLASLTRAVLGERDDYVRQTDVRDAVAALGDRPGTGETQAEEARYCYTLLEQAISALGGSALAIAADEAQCYRLFDWAAALAPRLLALLSGHLKLVIAAITELGNGAELQSSCLQELDTGAVSGVALVTELGHGTDAIHLETTATWQPEQRCLRLDSPTAASVKFMPNLATPLPRCVVVAARLLVDGVDEGVWPLLVRLRTTSGLIEGADVVALSDNGFGLWMDNALTRFHGALVPEEALLGGDAGWFDERGRFHCELTTAQRFARTMSPLYAARLGMAGAAVSAARAGLALTIAYAQRRHVGPDAATMISRDHVAHDLVHAMAEVWAMTALVAAVRTECARDDVDAGQVALWGMLTKPAASHTAWTALEMCRERCAAQGILRANYLSDYITVCQGIKTAEGENSAMLAAAGRVVRRRARPRLTGVSGAPIRSWWHRLLVERERLLAGAPPPPRQPDCASVELARAVNDRLALEALNAVAARTNDAGAQQILHDLTAVYGLGRVRADADWFTAHGLLDQQRAQDLDRELRSHTLALHPWLPMLARSFGLPEIPAPIAGDYTAAWIDFAGWSEAFENTHGADSLTATAGFDTTAESGAVKAYYRHV

SEQ ID NO: 125 - protein, 645 aa, Nocardia brasiliensis
MTTGTGTATTADHLRAALDGPWGEIREQARVQLADDKFAGDSYLDYKAARARVLEQMRAIATMGYAERGFRRENGGTSEPGAAVTGLEMLAYADLSLWVKAGVQWGLFGGAVENLGTERHREYIKRLLSLDLLGCFAMTESGHGSDVANLETTATYDPETQEFVVHSPTPSARKDYIGGAAEHARMAAVFAQLITQGKNQGVHCLLVPIRDEAGADLPGVTTLDDGLKGGLPGVDNGRIVFDHVRVPRENLLNRYADVAPDGTYSSEIENPSRRFFTTLGTLVRGRVSVGGAAAAGARVGLSIAVRYAEKRRQFSDPDSGQETVLLDYRSHQRRLLPLVAKSYALAFAQNDLVRRMHLVQTGQDLNPSSQRALEKRAAGLKVAQTRHATRAIQECREACGGAGYLTENRLVTLKADTDVFTTFEGDNVVLTQLVAKELLTAYSDEIRDLDALGWVKFAATMARDEVRKRSGVRQLIQTLRDGSDDTVDDGDLSRRAVQLQLFADREDYLVRTAGHRLRARAEDTSPFEAFNNAQDHILAAGTAHIDRLVLEAFIEGIEDIHDPDARTLAETVCDLFVYSTLEENSAWYIMHRFMSVERAKGVRRGVNELVDRLRPDALTLIEGLGVPESMLRAAMLDDASVYERG

SEQ ID NO: 126 - protein, 645 aa, Nocardia brasiliensis; identical to SEQ ID NO: 125

SEQ ID NO: 127 - protein, 614 aa, Nocardia brasiliensis; identical to SEQ ID NO: 124

SEQ ID NO: 128 - protein, 652 aa, Streptomyces clavuligerus
MEDRFARYLRYPGTPTDLTGDHHSNERQGWRLPRGRMIVENAVFTHADTPACARADISADATGSASPARRELTAVLFKDGSADAHRKWRKTISTEPFRFRSGLRTEERWELSYARLRAFNEEIESPEELARDPRGLAALHEWAAVVDGALATVAGIHYNLFLGSLVDDESTERDLVPFHTLSRTGTFLCTERGHGNDAAALETTVTYDRGAQEFILHTPHERAQKYMPNTSPAGGPKSAVVAARLRVDGEDRGVFLFLVPLTDADGTLPGVTVEPLPDRIGSPVDHCVTSFDRVRLPRTALIQGPHGRLLPDGVLHTDVGSQRKRFLHAIGRVTTGKLCMSASTLGGCRAALSIAVRYAHTRRISGPTAGSRIPLAAHRSHVGRLLKSLATAYAMTFLHRSVVDTWVHHEPADRDRVERLVAVAKGWITWNARAITIEARERCGARALFPVNGLAEYPANADGAITAEGDNLAIWCKAGAEMIFGHTPAEPSLRSTAVPQGVNALGDPVFLRDLLAVVEGRWHHRARLNLRSGPSGDSLGRWNNASGAALELVEAHATLLAADAFVAAAGTVPHAPTRSLLRDLCALFLLDALAPRSGELLADGHLTAAQVRAIPDTVDRLTAGLTPHLGVIADAFDVPEEHLGDLPMLTAP

SEQ ID NO: 129 - protein, 721 aa, Corynebacterium variabile; identical to SEQ ID NO: 118

SEQ ID NO: 130 - protein, 694 aa, Corynebacterium aurimucosum; identical to SEQ ID NO: 121

SEQ ID NO: 131 - protein, 648 aa, Rhodococcus pyridinivorans
MPTTAEHLRIALDGAWHEARERARKDLAHEKFAPHYTPETDKARAITLEQMRILAEHGYAAAGFSVESGGTGDAGGAVASIEMLAMSDLSLMVKAGVQWGLFGGAIENLGTERHHEKYVKQLIDLDVLGCFAMTETGHGSDVQSLETTATYDPDTQEFVIHSPTPSSRKDYIGGAAQHARFAAVFAQLVTQGETHGVHCFVVPIRDEDGNDLPGVTTSDCGYKGGLPGVDNGRIVFDQVRIPRENLLDKYADVEPDGTYASDIDNPSRRFFTMLGTLVRGRITVGGSAGAAARVALSIATRYAEKRRQFDAPGRDGEVPIMDYLVHQRRLLPLIARSYALGFAQNELLTTMHRLQSTSLQELDAQEQRELEGRAAGLKAANTWHASRAIQECREACGGAGYMAENRLTALRADVDVFTTFEGDNHVLTQLVAKELLTAYADEVQGMSPVEWMRFAATTISDIVKKRTAAQQIIQTIVDTRQDSEEDGSLFDRGTQVTMFEDREQYLLSTAARRLQAAMKREDNPFDAFNFVQDHVLHAARAHIDRVVLEAFVAAIEDCKDETARDLLSELCDLYALTIIDEDKAWFMEHRLLSVERAKAVTRGINERCRSLRPHALTLVDGLGVPDYLLGSAMLDREGAVVPPQDVAV

SEQ ID NO: 132 - protein, 657 aa, Actinoplanes sp.
MIGDSLDEVHLQEVLDGRWAHIRRAVRDELGKAGFAAVYGETGDEARERVSRLIRQIPSDIGVASAFPRAYGGSDDPGGSVVAAEMLAYADLSLMVKAGVQWGLFGGAVVALGTERHHAAFLPGIIDTEIMGCFAMTETGHGSDVQKLRTTCEYDPATETFDLHTPHEAARKDYIGNAARDGRMAVVFAQLITGGRGRGVHAWLVPIRDADGNPMPGVTLGDAGHKAGLLGVDNGRISFDHVRVPRDMLLDRYGQVAPDGTYSSPIENDTRRFFTMLGTLVRGRVTVGGAASAATRAALTIAVRYGDTRRQFGVPGADREVVLNDYLAHQRRLLPALATSYAYLFAQEELVGTLADVQAGPEPVDEHRQRELESRAAGLKAMQTWHATHTIQMCREACGGAGYLSENRLPALKADTDVFTTFEGDNTVLLQLVAKGLLTGYRDAFGSLDGWGRTTFVAEQVREMVLERTAARGLIQRLVSAVPGRHEEVAVTDRGWHLTMFEDREKHVLEGAIRRLRSGAASKKDHPFDIFNDVQDHVLKTATAHIDRITLEAFVAGIDRATDPGVQALLGKVCDLYALTTIEADRGWFLEHGRLTPARSKAVTAVINDLLKELRPHLRTLVDAFAIPDGWLNAAILREEPARQESTAEEDARITAG

SEQ ID NO: 133 - protein, 648 aa, Rhodococcus pyridinivorans; identical to SEQ ID NO: 131

SEQ ID NO: 134 - protein, 629 aa, Amycolatopsis mediterranei
MDVPEVPSKVDPDALTAVLDGRWAELRRGVRAQMAGAEFRDPVDLGIEAHRAQVLDQLRALAETDRPGLGFDPAYGGGGDVGGSVTSFEMLGYGDLSLMVKAGVQWGLFGGAVQLLGTERHHERYLRGIMDLDVLGCFAMTEHGHGSDVQHLRTTATFADGGFVIDTPDAMARKEYIGNAARDGRLAVVFAQLVTGGESRGVHAFLVPIRDDDGKPMPGVSIEDCGSKAGLNGVDNGRLSFDNVRVPREALLNRFGDVAEDGTYSSPIESDSRRFFTMLGTLIRGRVSVAGSAGSATKRALTLAIRYGEVRRQFAKPDGDEVVVLDYLAHQRKLLPALAKTYALHFAQEELVSKLHDIDASAPEEDQRELESRAAGLKALGTWHATSAIQTAREACGGAGYLAENVLPGLKADTDVFTTFEGDNTVLLQLVAKGLLTSYKQDFEDLSPLATARFFTDQVVNTLLERTSVRKALESLTEGSDAEVFFRREWQLRLLEDREDHVVEGVAKRLRKAAADPFGVFNSAQDHVLRAGRVHVERLVLEAFTAAVERCDDPDARTLLERVCDLYALSAIEEDLAWFLGHGRLTASRAKAVTSAVNRLCSELRPHARTLVDAFAIPEQFLAAPMLTS

SEQ ID NO: 135 - protein, 427 aa, Cryptococcus gattii
MLSRVLRNNSRLLRPTAASLRFRALSTTPARLNVQEITRPAIDTPLSLWNFTEEENMLRETVRRFAQDVIGPKVREMDEKEIMDPAIIQGLFDNGLMGIETSADLSGSECSFTSAIIAVEELARVDPSVAVLCDVHNTLVNTVIRLYGSPEIQQKWLPDLATCKVGSFCLSEPSAGSDAFALQTTAKLDSSGDFYVLNGSKMWISNSAEAETFLVFANVDPSKGYKGITCFIMSKDMGVEIAKKEAKLGIRASSTCLLNFDDVKIPKENIVGEIGKGYKIAIEILNEGRIGIAAQMIGLAQGAFDKSLEYAYQRKQFGKPVGEFQGMGFQFAEVATEIEAARLLTYNAARLKEEGRPFTKEAAMAKYYASVIAQKAAGSAIEWAGGQGFVREVGLEKYWRDSKIGAIYEGTNNIQLDTIAKFLRTCY

SEQ ID NO: 136 - protein, 694 aa, Corynebacterium aurimucosum; identical to SEQ ID NO: 121

SEQ ID NO: 137 - protein, 653 aa, Saccharopolyspora erythraea; identical to SEQ ID NO: 122

SEQ ID NO: 138 - protein, 661 aa, Pseudonocardia sp.
MTRSTIPAPDRIPAGTLRTVVDGRWAQVREETRAQLAASGDMRADPDLSSAEYRAHITDALKFLTSSGRPHTGFDPAVGGEGDVGGVVTAFAMLAYGDLSLLVKAGVQWGLFGGAVQVLGTERHHERYLRAIIEGELLGCFAMTETGHGSDVQHLHTTATYDRETREFVVDTPYPQARKEYIGNAARDGRMAVVFAQLVTGDEKPGVHAFLVPLRDADGNALPGVTIGDDGRKAGLNGVDNGRLSFDGVRIPRENLLNRFGDVAEDGTYSSSIGNETARFFTMLGTLVRGRISVAGGAGGAAQKALTLAVRFGERRRQFANPATGEEIAVLDYLAHQRKLLPALATTFALHFTQDDLVKRMHDIQAPGASPVGAREQRTLEQSAAGIKAIATWHATHTIQTCREACGGAGYLEENLLPALKADTDVFTTFEGDNTVLLQLLAKELLSDYGRTIKKGNPLEIAPLLGRQLAGVFAEHTGAASLTRRLPFRGIDLTDRERRRELLRVRRDDTLATAIRNLAPALRKGNDEFAVFNSAQDLLLLAARAHVDTLVEQSFADKLETVTDPAVRALLERVYDLHVLSVIDRERAWYLETGRLTAAESRSVRPLVNELCAELRPYAGTLVDAFGVPENWLACPMLDDEAWAPGPSAPAASVTEQVEAG

SEQ ID NO: 139 - protein, 715 aa, marine actinobacterium
MITELSRIETAMTQVHDTATETAPDSPNAASDDATNTSPETSPEAPAINVEWLGEYLLGKWAKARKESRALMSNPELHQVNGLSMADHRERVLSQMSILVDNGAIQRAFPSALGGQDDHGGNIAAFEEVVLADPSLQIKSGVQWGLFGAAVLHLGTKQHHDKWLPDIMNLTTPGAFAMTEIGHGSDVASIATTATYDPDTDEFVINTPFRAAWKDYLGNAALHGKAATVFAQLVTKDVNHGVHAFYVPLRDDNGFLPGISGEDDGLKGGLNGIDNGRLAFDHVRVPRTNLLNRYGNVDENGEYTSDIDSPGRRFFTMLGTLVQGRVSLDGAAVLASKLALTIAIKYGSERRQFTASSDTKEEVILDYQRHQRRLLPRLAQTYAMSFAHEEFLDKFDGVFSGRTDTDADRQDLETIAAALKPLSTWAALDILQEAREACGGSGFMAENRLTQMRADMDVYVTFEGDNNVLLQLVAKRLLTDYSRKFAGADPGALAQYVADQVSDAAVNRTGLRRFAQNVVDFGSTARSIGYVRDTDSQRQLLTDRVETMVSDVAGKLRPATKLPQAEAAALFNSHQNQLIMTAYAHAELLQWEAFTRALEKIEDKDTAKVMTWLRDLFGFSLIEKNLSWYLMHGRISTNRAQAITDYIDDRLLPRLRPQALDLVAAFGLTDELVRAPIASGAEAIRQNEARDYYAGRRASGEEPVHEKDLKQKKRR

SEQ ID NO: 140 - protein, 429 aa, Cryptococcus neoformans
MLSRVLRNNSRLLRPTAPSLRLRALSTTPVRLNVQEITRPAIDTPLSLWNFTEEENMLRETVRRFAQDVIGPKVREMDEKEIMDPAIIQGLFDNGLMGIETSADHSGSECSFTSAIIAVEELARVDPSVAVLCDVHNTLVNTVIRLYGNAEIQQKWLPDLATKKVGSFCLSEPNAGSDAFALQTTAKLDSSGDFYVLNGSKMWISNSAEAETFLVFANVDPSKGYKGITCFIMSKDMGVEIAKKEAKLGIRASSTCLLNFDDVKIPKENVVGEIGKGYKIAIEILNEGRIGIAAQMIGLAQGAFEKSLEYAYQRKQFGKPVGEFQGMSFQFAEVATEIEAARLLTYNAARLKEEGRPFTKEAAMAKYYASVIAQKAAGSAIEWAGGQGFVREVGLEKYWRDSKIGAIYEGTNNIQLDTIAKFLRKEYQK

SEQ ID NO: 141 - protein, 416 aa, Coprinopsis cinerea
MFRIATRAASNPLRALAVSSRTFATTRCVRSETRPTSLDAFTEEETMLREAVRRFAVDVVGPKVREMDENEQMDPAIIKGLYEQGLMGIETSAEHGGAESSFTSAIIAIEELAKVDPSVSVLCDVHNTLVNTVVRKYGTKEQQDKWLPQLSESKLGSFCLSEPASGSDAFALQTRAKKDGNDWIINGSKMWITNSYEAEIFLIFANVDPSKGYKGITCFLATKDMGVQIAKKEQKLGIRASSTCTISLDDLKVPEENIIGGIGKGYKIAIEILNEGRIGIAAQMLGLAQGAFDKAVPYTYERKQFGQAIGTFQGMAFQIAQAAIDIETARLMTYNAARRKEEGLPFTKEAAMAKYWASVVAQRVSGQAIEWAGGVGFTRETGIEKFWRDSKIGAIYEGTSNIQLQTIAKFIQKEYS

SEQ ID NO: 142 - protein, 416 aa, Coprinopsis cinerea; identical to SEQ ID NO: 141

SEQ ID NO: 143 - protein, 652 aa, Streptomyces clavuligerus; identical to SEQ ID NO: 128

SEQ ID NO: 144 - protein, 665 aa, Glycine max; identical to SEQ ID NO: 92

SEQ ID NO: 145 - protein, 664 aa, Glycine max; identical to SEQ ID NO: 93

SEQ ID NO: 146 - protein, 664 aa, Arabidopsis thaliana
MEGIDHLADERNKAEFDVEDMKIVWAGSRHAFEVSDRIARLVASDPVFEKSNRARLSRKELFKSTLRKCAHAFKRIIELRLNEEEAGRLRHFIDQPAYVDLHWGMFVPAIKGQGTEEQQKKWLSLANKMQIIGCYAQTELGHGSNVQGLETTATFDPKTDEFVIHTPTQTASKWWPGGLGKVSTHAVVYARLITNGKDYGIHGFIVQLRSLEDHSPLPNITVGDIGTKMGNGAYNSMDNGFLMFDHVRIPRDQMLMRLSKVTREGEYVPSDVPKQLVYGTMVYVRQTIVADASNALSRAVCIATRYSAVRRQFGAHNGGIETQVIDYKTQQNRLFPLLASAYAFRFVGEWLKWLYTDVTERLAASDFATLPEAHACTAGLKSLTTTATADGIEECRKLCGGHGYLWCSGLPELFAVYVPACTYEGDNVVLQLQVARFLMKTVAQLGSGKVPVGTTAYMGRAAHLLQCRSGVQKAEDWLNPDVVLEAFEARALRMAVTCAKNLSKFENQEQGFQELLADLVEAAIAHCQLIVVSKFIAKLEQDIGGKGVKKQLNNLCYIYALYLLHKHLGDFLSTNCITPKQASLANDQLRSLYTQVRPNAVALVDAFNYTDHYLNSVLGRYDGNVYPKLFEEALKDPLNDSVVPDGYQEYLRPVLQQQLRTARL

SEQ ID NO: 147 - protein, 700 aa, Corynebacterium sp.
MTEVVDKASSAQKSSGRDDAATAATEPVVDVAALGEQLLGKWAHIRHEARKVAGNPAVQKIEGLHHTEHRARVFEQLKFLVDNNTVHRAFPTRLGGSDDHGGNIAGFEEIVTADPSLQIKAGVQWGLFGSAVMHLGTAEHQDKWLPGIMSLEIPGCFAMTETGHGSDVASIATTATYDEASQEFVINTPFRAAWKDYIGNAATDGLAAVVFAQLITRKVNHGVHAFYVELRDPATKEFLPGIGGEDDGIKGGLNGIDNGRLHFTDVRIPRTNLLNRYGDVAADGTYTSTIESPGRRFFTMLGTLVQGRVSLDGAAVAASKLALKTAIQYATERRQFNASSATDEEVLLDYQRHQRRLFTRLATTYAASFAHEQLLQKFDDVFSGAHDTDADRQDLETLAAALKPLSTWHALDTLQECREACGGAGFLIENRFASLRADLDVYVTFEGDNTVLLQLVAKRLLADYAKEFRSADFGVLARYVVDQAAGVALHRTGLRQVAQFVADTGSVQKAALALRDEEGQRTLLADRVQSMVAEVGAALKGANKLPQHQAAALFNQHQHELIEAAQAHAELLQWEAFTEALPHVADEGTRRVLTWLRDLFGLSLIEKHLSWYLMNGRLSMQRGRTVGTYINRLLVKIRPHALDLVDAFGYGPEHLRAAIATGAEATRQDQARDHFREQRASGTAPADEKALLALKAAKAR

SEQ ID NO: 148 - protein, 715 aa, marine actinobacterium; identical to SEQ ID NO: 139

SEQ ID NO: 149 - protein, 650 aa, Coccomyxa subellipsoidea
MQGTAQRRIVMLHGHFDVSAQQPARGGLGGIAFDPEALQRILDHDNHETRRAMKDLMKDDLFVPRYDMDLREERELAFQRLLRICQSGLVSITDFRHNPLNIFAAHEITGFADPSVATKMTVHFNLFGGTVLKLGTRQHHDVLLGPIDSLDATGCFALTELGFGNNAVEMQTTAQYDQGADEFIIHTPTTLAQKYWITNSAVHAKWAVVFAQLLIGGRNEGIHGFLVRIRNEDMSVVPGVRIEDMGHKMGCNGVDNGKLWFDHVRVKRWALLNASSNVGADGSFRSTVARPRDRFLRVADQLLSGRICIASMMQSGSKMALLIAFRYAATRLAVGSRGKSDTPILDYQLQQRALLPLLAQTVCLNLGLNYVKDRWAAASGFDEVMVDPSVAREVIMLCCAIKPLCAWNAQETGTTCRERCGGQGYLSVNKFGAIIGFAHAGMTAEGDNRVLMQKVAKEYLSTLDQAQVRDRLRAGSSPPNLSGGQLRDVNALRGVFVAREGRLLGALAAKMRGVSGEAVFDTWMKRESDLVQATALAYAEREVIDACQRACQQAPGSVASILRALTNLHALRRLEADQGWLLTEGILSLEAARGIPNEIRALCAELAPSSQRIIDSFGIPSHLVAAPIAVDWEKYNKVDNQGELIGPAFD

SEQ ID NO: 150 - protein, 760 aa, Runella slithyformis
MTPGILSVLPIFYVGWSDSVLSPSEMQTIQALIENLPHLTEEDKKLLQSWTDQRHPPNRETFAEWKHILQNHVAEIDLSARRNLTEIGLAMAQKASSLDWYAPEVREKIEDFEAIMGLDNASSALSFYRAIVPQNASELTEEADFDPRKLQTILDGPFAELKTRTKTLLLDEAFRVPTELRNKDELRLKILEQCRYLARQGFGSYAFPPEYGGSGSTGGSTAIFETLALGNLSLLIKYGVQFGLFGGAVFQLGTEQHHRLYLEKLGKLELAGCFAMTETGHGSNVRDLETTATYDHATRSLVIHSPTEAAGKEYIGNALHSRMAAVFCQLMVNGQNHGIHTVLVPLRDENHQTLAGITVKDNGYKMGLNGVDNGRIWFDNVRVPVKNLLNRYGSIDENGQYQSPIQNPSKRFFTMLGALVGGRVSVALGSNTAAKKALDIAIRYALKRRQFKTLSEDRETLLLDYPTHQERLFPLLAKSYALTFALETLRQKFVESAALDDKREVEALAAGLKSYASWHAIDTIQECREACGGKGYLAENELPDLKADTDIFATFEGDNHVLLQLLAKSILTDFKQEFSDGGFMAVARHILHRVNTEWLESNPFAARNTNAEHLLSAEFLGEALRYREQKLLFTLSDRLRSFLGKKLNPNEIFLRTQTHSIALAMAHVERFINDEFLAKLNSLPDSPEKTALQQMQQVFALDAIHRDRGWYLENDYLSSEKSKAIRKVLTKLYRQLRPQAQAYVQAFGIPAVLRNAEIVS

SEQ ID NO: 151 - protein, 597 aa, Clonorchis sinensis
MKLYSMPVRYAVSLEEERQLALSRLKLVCDNDVLSVFDFDHNPHRIFAAHELCGIVDPSMTTKMTVQFNLFGGTLLKLGSREHYGEMLHNVDTLKDVGCFGLTELGFGNNATMMETTAEYDFNSDEFIVNTPTVEASKYWITNGALHAHHCILFARLLLGGQDQGVHAFLVPIRDRNLQVMPGVTIEEMGHKMGLNGVDNARLMFDHVRIPRNNLLDRYSHVSASGKFSTKLGDNPRNRFLKVADQLLSGRICIASMCVGAAKASLAIALSYSASRLAVGPTGKSDIPILSYQLQQRSLIPLLAATYAINFGLDYVKDSWAKATTGAIDSPDSESVVVMCCAIKPLAAWHLNRTVNACRERTGGQGYLSCSRFGTYLGSAHASMTAEGDNSVLMQKVAKERLAQLLKDWQGVPPHSAAAEFRSDPQYTEDVGYLHSLLEKRELALFSLLARTLDGVKGKDLFNAWMYELSDLIQAAARAYAERLCSEQFAVVLEQYKADLNDSTVNAMRMLHRLYVTESLVGPDAVEWPDMPTQFVTCLRSESRCLCHGLSPKSLSLATDAFGLTPRLLHAPISEDWIAYNSKSGMSGEVFDWYSQR

SEQ ID NO: 152 - protein, 673 aa, Streptomyces avermitilis
MIATTFEAGPVATGHPVADHLAHLLFEGTGRERTHGTWRRLISGREFSYRPGLAPAERTALSYDRLRLLNDTVDDPVRLAADPHRLAALHEWIGPVDGGLTTLASIHYNLFLGSLVDHDDNGRDLSAFTTLQQVGTFLCTELEHGNDVAAMETVAVFDRASGGFHLHTPTPGAQKFMPNTSTTGGPKSAVVAARLVVDGRDEGVFLFLTPLGDRSGLLPGVRVRPLPERTGTPVDHALTAFDHKWLPREALLEAAHGRLAPDGTLTSTLGNRRKRLLRSINRVTMGKLCMSAGTLGMARAALTIAVRYAHSRLVTGPRAGERIPVAAHRSHHGRLLDALATAYAMTFLHRTVVDRFAARTEEDREEVERLTAVAKGWITWQARAITTECRERCGAQGLFPANGISDLASNIEGGITAEGDNLVIWVKAAAEMVFGHDTTARTRAGAPAAPNSSAALSAPNRPAAPATPSAPGAPATPGAPGAPGAPGAPGAPGAPGAPGAPGATLADPAFLRGLLAEAEAIWQARARADLRDGPAGDPVGRWNGTSTAALEMVSAHARLQAADALIAAAERATDPTARFLLRSLCRLFLLRRLRDHTGDLLAEGHLTADHVRALPRALDSVYDDLAPHLMTLVDAFDFPAEMLSAIPIASGGTIVRTLEQSAEEWPLVSPASP

SEQ ID NO: 153 - protein, 691 aa, Corynebacterium lipophiloflavum
MSLPNPPKEDVKDAKHLATDTTKASGRPEKNQPERLPATPDSNAVQDLADVLDGNYKDRKESLRPLLNDASLLPKIDGTLDEIRADNLENVQKIASSGKIQPSFSPLNGGEGQVAAGVSSLELIAQINNSAAIKSGVQFGLWGGAVDALGTERHVEFAQGAMDLTKLGCFAMTEIGHGSNVQQLETTATYDPETKEFIVNSPTPGSKKAYIGNAARDGRWAAVFAQLYTPDSEESHGVHCIIVRIREEDGSDAPGVTTSDHGHKGGLLGVDNGMIVFDNVRVPRENLLNRFGDVAEDGTYSSPIESKNRRFFTMLATLVRGRLGVGASALGASRTGLALAVKYANIRRQFEAGTPGKEARLIDYRQHRRRLLIPLAKSYALAIFQNALLDRYQAQQDAIMAGEWNPAQPTDEQERAGREMETLAAIFKSTAATYANATLQECREACGGAGYMSENLLTTFRADVDIFTTFEGDDTILRQLVGKNLLTAYGREVSEMSPFGMAKFVASNVGDILTRRSGIAAGVQSISDRVTGTGSLFDADTQLRIVQAREEHVLNSLVRRVQVARKMDREDAAKVIDRAQDHLLAAAVAYGDRMMVQAMIEAEEKLPENSPARPVFEQLRDLYVLDTIVEHADWYQEHGVLPSGRVKAAKAAVNDLVDSLGPWSEVLVDAFKIPQVVLDRPMMSNGGTDLS

SEQ ID NO: 154 - protein, 862 aa, Dictyostelium fasciculatum
MENATRRLNVTNNHLQSNNCSAAAVQEQEVKENLTNSNIVGGSTPSQIFEIQRPFDADSLNEFLFPYHRDLRKRLLSQWKGSELLSRPAFGLSLKEDRDLTLTQYHEMMKLSQGNLSVWDYLTDPSKVAAWTQCYRLRNIAASTLFGVHISLFGCSILFLGTDEQRERYLKHVEDGSMMGCFALTELGHGSNVQAIETLATYDDKTQEFVLHSPTTTSQKYFIGGAATHARWSVVFAQLRVGEKYEGVHAFVVRIRNDDGSMVPGVRAADCGHKMALNGVDNGRLMFDQCRIPRDQLLARYGGVNKAGIYSSPINPAVKRFAHNIGALVIGRYIISLGSVAFVCVSLLTAINYSFSRRQFGDGSAGSERQLISYAIHRRRIIPYLAFNYGVHFGNEHLLRLMCEKENKKEKEIHVYASALKAYASWHGRNCLQECREACGGQGFLSENIIGPFKSEMEIYTTFEGDNVLLFQQVAKHILTEARRRPPPEYERPSDSHRLRVDSAYIRSPEFLMGALTARLHHTTPLVASRLMESVGSGKPVMDAWNDAGDVILQLGIVFTERFLLERFIQEVGKCPNETQRQAMNLLISLMGLTILDKDPWFSRYEYLSSDQSEAISNEINQLCLQIVPYSVSLVEGFGFNSSDLGPIGLDTVLLTYDSTIRELERSHINLAVAVNSIFTLLLLFGKFVQYLFFGKLREIEERNFRERFFLYVVTKFFVFAVKDHEVGSIIMWGFWFSIQCFLKLFSLLARDRFEYLNTFSPNTHAKIHFKLLFLLVSILMSDLMCFYFSTTIFFDNGLSNIMILNFEFFTIFFETIQTLIKYSIHLFDMAATGVWEQRGAYIYYTEFATDSIILAGTCCIH

SEQ ID NO: 155 - protein, 698 aa, Corynebacterium genitalium
MTSVEEKEGRKAKPESRQPQTLPETPDAAVAGKLKDLLDGAWGERKDDIREQLNREEALPMIEGSVEDIRAALLEKVKMVAGSGMMQTAFSEANGGSGEAHVGILGLDLLGQFNGSLAIKSGVQFGLWGGAVDVLGTERHREYAQGAMDLSMLGSYGMTERGHGSNVQDLETTATYDPETQEFIIHSPSPSATKVYIGNTARDGRWSAVFAQLYTPGEEESHGVHCFVVRIREDDGSPVEGVKIGDHGHKGGLLGVDNGTLTFDNVRIPREALLNQFGDVDEAGNYTSPIESKNRRFFTMLGTLIRGRIAVGAAGAGATKSALAIATKYAHQRRQFDYGDAGREDKLIDYRAHRRRLIIPLARTYAIQLLQNQLTQRYADQTARQASGEWSVTDPTKAQALASREMETLAAAFKAVATEHATDTIQECREACGGAGFMSENLLTTFRADTDVYNTFEGDNTVLLQLAGKNLLTAYTSEMANPSAMDIVKYAATNVTDIFRSRAGLGATVQSVVDTFASEEASLFDADYQLKVIQLREQLVMRSLIRRIQGARKLSRAEGAKVIDKAQDHMLNAAWAYIENLMVQAMIEAERSLPVGSTERAVFEQVRHLFVFDTIIRNAGWYQEQNVISSGRVKAARAAINDLVDSLGPWSEVLVDAFAVPSVVLDRPIFKDGGTDASRDNPEAWTVGSNIPTTAKEN

SEQ ID NO: 156 - protein, 683 aa, Corynebacterium amycolatum
MAQTSSSSTRIPRRRSTDAPKTLPSRPEPEVASALQKVLDGYFPEARADVRALLEDPSLRPTSGLTVEEARQHTTEALSKVLKTGMPYGAFRTDQGGTGDTGGTLTGIEMLGHTDLSLMVKSGVQWGLFGGAVSNLGTERHGELVRDLIELRALGCFAMTERGHGSDVQSLETTAHYDSETEEFILNSPTASSEKWFLGNAARDGRWAAVFCQLYTPGQEESHGVHCIVVRIRNDDGSPVDGVAIGDHGTKGGLLGVDNGTLMFNHYRVPRENLLNRFADVSATGEYSSDIDSPNARFFTMLGALVRGRVTVGAAAGAATRTALTIGTKYAHLRRQFAPDDSMPEKKLIEHRQHRIRLLPRIARSYGLQFATNLLIKRIHDLEAEGLDRANLTPEQARDLREAEAHAAALKVANTAHATDAIQEMREATGGAGYMAENLLTILKEDSDVFTTFEGDNVVMLQLVTKELLGGFAREVQSFSNLEMVRFGLDNFSGILRRRTGADAVVQNLLDALTDADESSLFDPASQMQLLIERENRLLKSLARRLRPARKLPVEKAAKLVDKVQDHMISCAWAHIDRMILEAFFEAESTLTDERSQEVLEQVRDVFFLSVVCDNAGWFLEQSLLTGTRTKGARAGLADLVDSLGPWSEVLVDAFGVPSTMLDIPMMEPYEAMTPKAKANPAS

SEQ ID NO: 157 - protein, 698 aa, Corynebacterium genitalium; identical to SEQ ID NO: 155

SEQ ID NO: 158 - protein, 689 aa, Arabidopsis lyrata
MESRREKNLMAEEESDGLIAARRIQRLSLHISPSLTPPPLLQPETCSARSKKLDVDGQALSLYMRGKHMDIQEKIFDFYNSRPDLQTPIEISKDDHRELCMNQLLGLVREAGIRPFRYVADDPEKYFAIMEAVGSVDMSLGIKMGVQYSLWGGSVINLGTKKHRDKYFDGIDNLDYTGCFAMTELHHGSNVQGLQTTATFDPLKDEFVIDTPHDGAIKWWIGNAAVHGKFATVFARLILPTHDSKGVSDMGVHAFIVPIRDMKTHQTLPGVEIQDCGHKVGLNGVDNGALRFRSVRIPRDNLLNRFGDVSRDGTYTSSLPTINKRFGATLGELVGGRVGLAYASVGVLKISATIAIRYSLLRQQFGPPKQPEVSILDYQSQQHKLMPMLASTYAYHFATLYLVEKYSEMKKTHDEQLVADVHALSAGLKSYITSYTAKALSVCREACGGHGYAAVNRFGSLRNDHDIFQTFEGDNTVLLQQVAADLLKRYKEKFQGGTLTVTWSYLRESMNTYLSQPNPVTARWEGEDHLRDPKFQLDAFRYRTSRLLQNVAARLQKHSKTLGGFGAWNRCLNHLLTLAESHIETVILAKFIEAVKNCPDPSARAALKLVCDLYALDRIWKDIGTYRNVDYVAPNKAKAIHKLTEYLSFQVRNVAKELVDAFELPDHVTRAPIAMQSDAYSQYTQVVGF

SEQ ID NO: 159 - protein, 627 aa, Trifolium repens
MRGKYRDIQEKVFDYFNANPQLQTPLEISKDNHRELCMNQLLGLVREAGIRPLHYVVHDPAKYFAILEAVGSVDMSLGIKMGVQYSLWGGSVINLGTQKHKDKYYDGIDNLDFPGCFAMTELHHGSNVQGLQTVATFDPITDEFIVDTPNDGAIKWWIGNAAVHGKFATVFARLKLPNYDAKGISDMGVHAFIVPIRDMKTHQTLPGIEIHDCGHKVGLNGVDNGALRFRSVRIPRDNLLNRFGDVSRDGQYTSTLPSVNKRFGATLGELVGGRVGLAYSSVSVLKVASTIAIRYSLIRQQFGPPNQPEVTILDYQSHQHKLMPMLASTYAFHFATTNLVEKYAQMKMSHDEELVADVHALSAGLKAYVTSYTAKSLSVCREACGGHGYAAVNRFGSLRNDHDIFQTFEGDNTVLLQQVAADLLKQYQRKFKGGTLAATWNYLRDSMNTYLSQPNPVTARWEGGDHLRDPKFQLDAFRYRTSRLLHSVAVRLQKHSKPLGQFGAWNRCLNHLLTLAESHIESVILAKFIEAVQSCPDPSAQAALKLVCDLYALDRIWNDIGTYRNVDYVAPNKAKAIHKLSEYLSFQVRNIAKELVDAFDLPDHVTRAPIAKQSGAYSQYTQYVGFE

SEQ ID NO: 160 - protein, 689 aa, Arabidopsis lyrata; identical to SEQ ID NO: 158

SEQ ID NO: 161 - protein, 638 aa, Dictyostelium discoideum
MESTIRRIQINTLHLLSNNDCLSEIDPQYMEIKQSFDANLLNKYLFPYELELKESLSTFWNNENFLLQPSFGLSLEQDRELTFNQFKKLMELATKHFGLIDLERNPKKIAVFTQGYRFQNPSVTTLMGVHFSLFGASIVFLGSEEQRKKYTEKVEKLEIIGCFSLTELGHGSNVQSIETIAEYDHDKEEFIINSPTITSQKYFIGGSAKNATHTIIMAQLKVSGKMEGVHAFVARIRNDDGSLVKGVDIRDCGVKMALNGVDNGRIMFKDLHIPRDQLLNRFGGVNKAGIYTSPINPANKRFANTIGALVLGRYIVSIGSVAFNSVGLTTAIRYSFSRKQFQGSDPKFEKQLISYSSHRKRLIPHLANTYATHFSNNYLLDLLSEKEKKEKEIHILASALKAYSSWSTRDCLQECREACGGQGFLSENLIGNFKSETEIYTTFEGDNILLYQQVAKFMLSESRKNPPTDYQQPSNEQKQRTDRNYIRSFDFLLEALNSRLNQTIQYVTEKLSDSVSEGSAIMDAWNDNGTYIVRLGVAYTEKTILDKFIAAVNNYPDENTRNALKLLVSLYVLNIIDRDNWFLKYQFISPQQSESISIQILELCKEIVPYSISLTDALGFDHQRLGPIAGDWISRNKF

SEQ ID NO: 162 - protein, 617 aa, Polysphondylium pallidum
MDRINIIAQHLLVNDVAAGDVPTTSLLSVQLQVDSVEIQKLKTLLDTPKYTEFKDRVRTFIQNNPLFHGSVSGISSAEYKQRVLLQLKSLATSGLFNITDIRDNPEKTCAFIEVISEFNNNINTKFAVHYSLFGGTILLLGTERHEIYLPKADCLDIVGCFSMTEIGHGSNVRSLETTATYCPKAGGFIIHSPTPTSQKFWIGGAGLHAHYTTVFARLILGGKDHGVHAFVVPIRDQLNRVLPGVTIKDCGPKMGLNGIDNGQLAFDNVFIPRENLLNKYADVTPDGKYKSDIKPQSIFTSQMAALVNGRLYVCKSTVGVVKTCLTIATRYSHIRKQFGPPNSNGELPLITLSSQQKRLMVPIATTITMDLFTIDLAKKLANAKISHASHAHCAGIKAVFSWHLLRSIQQARESCGGQGYRMENRIAEFRCDSDIFVTYEGDNTVLMQQVAKYAMTLKPISIDRVVLGSKADLFNLVKLQQLFRLREQLRVDELKELIAKGGKDKFAAFNNVIPWAVATGYAHMHSVILDNAIHYINGNSIKPLPQMVLLDTLSKIEEDLGWFLSQSLISTDVAKQIPFVVMELCKNLSDHSLDIIKSFDIPAVCLPEPSLISDLIN

SEQ ID NO: 163 - protein, 639 aa, Polysphondylium pallidum
MDSVNRRISNIEQHLSVNSCSDAVQTSGTLEPVRPFNPDKLFEYLFPHHLEMRRQLIAEFEAPENELMQRAPFGLSYTQERDLTMEQTKRLIEIAKRYVKVIDFVRDPTKIAAWTQSYRMRNIATTTLFGVHFSLFGATILQLGTDEQREKYLKHVEDFSMPGCFALTELGHGSNVQQIETLAVYDHSTEEFIINSPTITSQKYFIGGAAKNARWTVAFAQLKVGEKYEGVHAFLMRIRNEDGSVCNGVKIADCGVKMALNGVDNGRLMFTNYRVPRDQLLSRFGGVNKAGIYSSPINPAIKRFAHNIGALVIGRYIISIGCISFSAVGLQTAINYAFTRRQFGEDNNERQLITYAVHQRRLLPHLAFNYGIHFANDYLLRLLAEKENRKDKEIHVYASALKAYSSWHNRNCLQDCREACGGQGFLADNLIGPFKSETDIYTTFEGDNVLMYQQVAKYILTEARRKPPPEYNPPSDAFRAKTDSKHLRSFDFLLQAMTARLNQYVVLVANKLMEAVGSGKPVMDAWNDCGSYILNLGIVFTDKFILERFIEGVSKCPDDNQRKAMSLLLSLMGLFIINRDTWFIKYQFISVDQSDAIENEISDLCKEIAPISIALAEGFGFSTKTMGPIGRDWIAENRY

SEQ ID NO: 164 - protein, 638 aa, Dictyostelium discoideum; identical to SEQ ID NO: 161

SEQ ID NO: 165 - protein, 691 aa, Corynebacterium lipophiloflavum; identical to SEQ ID NO: 153

SEQ ID NO: 166 - protein, 683 aa, Corynebacterium amycolatum; identical to SEQ ID NO: 156

SEQ ID NO: 167 - protein, 692 aa, Arabidopsis thaliana
MESRREKNPMTEEESDGLIAARRIQRLSLHLSPSLTPSPSLPLVQTETCSARSKKLDVNGEALSLYMRGKHIDIQEKIFDFFNSRPDLQTPIEISKDDHRELCMNQLIGLVREAGVRPFRYVADDPEKYFAIMEAVGSVDMSLGIKMGVQYSLWGGSVINLGTKKHRDKYFDGIDNLDYTGCFAMTELHHGSNVQGLQTTATFDPLKDEFVIDTPNDGAIKWWIGNAAVHGKFATVFARLILPTHDSKGVSDMGVHAFIVPIRDMKTHQTLPGVEIQDCGHKVGLNGVDNGALRFRSVRIPRDNLLNRFGDVSRDGTYTSSLPTINKRFGATLGELVGGRVGLAYASVGVLKISATIAIRYSLLRQQFGPPKQPEVSILDYQSQQHKLMPMLASTYAYHFATVYLVEKYSEMKKTHDEQLVADVHALSAGLKSYVTSYTAKALSVCREACGGHGYAAVNRFGSLRNDHDIFQTFEGDNTVLLQQVAADLLKRYKEKFQGGTLTVTWSYLRESMNTYLSQPNPVTARWEGEDHLRDPKFQLDAFRYRTSRLLQNVAARLQKHSKTLGGFGAWNRCLNHLLTLAESHIETVILAKFIEAVKNCPDPSAKAALKLACDLYALDRIWKDIGTYRNVDYVAPNKAKAIHKLTEYLSFQVRNVAKELVDAFELPDHVTRAPIAMQSDAYSQYTQVVGF

SEQ ID NO: 168 - protein, 676 aa, Cordyceps militaris
MSFPDNLKPKEPSGASLLARERQQSPIAVDALGAHIFAGTGFLARQARVLSVMAAEPLLDKSRQQQLSRVDRVRLGLARGKLLRRLQARHGWDMDDYHMAAYLLGEQSPYRLHVGMFRTTIQEQASDAQRAYWMPRVDAWEVTGTYSQTELGHGSNVRGVELEARWDPAAKEFVVHSPTLTAAKWWNGSLGRTANHAVLMAQLMVPDPKRKGEYVSHGPQAFIAQIRDAKTHLPLEGIVIGDIGVKIGFASMDNGYMLFDQLRIPHSALLSRYVQLDPETSVFSKSPNAALSYGTMTSIRTVLVEEAGTHLARAVTIAIRYTAIRQQFKDKDSQDPGRDELQVLDYPTVQYRLFPLLAAAFALQYTGKVMRQDYAKTRGEVEQGNLDGLAVMHSHSSGLKSLSTEITNAGIETCRRAMGGHGYGSGSGLVEMQKDYQAKPILEGDNWMITQQTSSFLIKRMAAAVETRGEPAKDQTDAQLKTFLDQKDQGRAFDILNNDSDIQESFRWRAASMTYDAYKARVVDKKKHNDLLIQFHKLSHAHSSSIMVASFFTTLTSSHDLPPETKEVVLDLYRLFAYTAIQAESYECKDLDALPDRIQALLARIRPHAVKLVDAWQIPDYLLDSALGRYDGNVYDDLFNRAHRLNPLNDVVFNPDYKDDEIIKGSGERKPLSSKL

SEQ ID NO: 169 - protein, 693 aa, Aspergillus oryzae
MAVFNRQMDLMQQARASSTFNPMKLTVIIYDNEATVSARRAAFHRVEDALGLLDNMKLPHVYSGLDREGLYLEGVRRARVITNDMITHGHSHFKWLNERYQICNSSPFGMNFLMFRRTIELQGTAEQRRYWLQEIDQMRINGAYAQTELGHGTFVRGIETTATFDVDTDTFTIHCPTPTSVKYWPGGLGFSCSHAIVAARLITHGKDHGVHMFIVQIRSLEDFAPVRGVELGDLGMKMAYNGTCNGYARFNYLRVPRSSLLAAHAQVSRDGTYSQAQAKAGTLPLSKRVYSTMLDTRRNIVRCVAFGLAQAATITARYSIVREQGRLMFSDAAEEETAIITFKSQHYRLLTLIAQSYAILFAAKDFDFRYDQLVREQENDDHARLPFMHALSTGLKAWATTIASAGATEARKMCGGHGYVALSGLPEIEGSVSATATFEGENYVMWQQLVVYLFKQVRASCAGQDVDAEVKDYIGGVRSYLGNGGSPSRIQSCDKKTLFDGSTLVLIYKKRSQRVLAAAYSSYRDMCNRCSAAEAWNACMMTSLAAGQAFVEYIVLESFVKRTSPSATRDAPVSQALSHLFSLFALTTITSPTPSFAAGSFLEHGLLTPDELNEIRVHINELLASLLPNIAALTDAWDFTDSSLCSALGCKDGNVYERLLSWTRQLPANSGRAVEKAWEASEGIEEFFKASRL

SEQ ID NO: 170 - protein, 688 aa, Leifsonia xyli
MGDTAERAATKLSGSVPAPEPRVDVEALGRQLLGEWAEIRLASRELAKRPEVQKVEGLSVAEHRKRVSGQLKLLVENGQVHRAFPTSVGGADDHGGNIAAFEELVAADPSLQIKSGVQWGLFGAAVLHLGTEEHHKKYLPGIMSLEVPGAFAMTETGHGSDVASVATTATYDPETQEFVIDTPFRGAWKDYLGNAAVDATAAVVFAQLVTRNVNHGVHAFYVPIRDAAGAFLPGVGGEDDGQKGGLNGIDNGRLHFTGVRIPRTDLLNRYGDVAADGAYTSPIQSLGRRFFTMLGTLVQGRVSLDGSATIAAKIALKIALTYANERRQFSAGSDTDEEVILDYQRHQRRLLPLLATTYAASFAHEMFLRTFDDVFSGRVATDADRQDLETIAAALKPLSTWHALDTLQEAREACGGAGFLTANRITSLRQDLDIWVTFEGDNNVLLQLVAKRLLTDVSRKFAQADAGALARYVVTHAADRVYHGSGLRSVAQTVRDVGSTARSVTWLQDPATQRELLTDRVETMISQIAGHLRPASKLDRKAAAELFNSQQNELIEAAQAHGELLQWESFTDALEQTRDAGTKQVLTWLRDLFGFGLIEKRLAWYLVNGRLSPQRGQAVTAYIGRLLTRIRPHAIDLVDAFGYGPELVRAEIATGAEAERQAEARAYYASRREDGTLSVEEKAANESR

SEQ ID NO: 171 - protein, 687 aa, Dictyostelium discoideum
MDKATLRRIDNTLKHLTKVSDIESLHKSTLKDEIPNVKLLRSILDGEFHFDRDRLRELFQSSNTFNERFLMEPLSTDEHREQTLQACLEIIQLQLVQLNDMEKNPKKFLSWFESISMCDPSVSLKFAVQYNLWGGTILFLGTKKHHDKYLSDIATGKLLGVFGLTELGHGSNVNGLETTATYDRNTQEFIINSPTWESQKYWPGNISKHGKMATIFARLLINDNDIGSGSGSGDSGIKKDMGIHAFVVQIRSESTSNNKYGELLPGVTVRDISLKNCYNGIDNGGLSFNNVRIPRENMLDRFSRVDANGKYHCDLPSNRHFAMTMSVFFIGRLCLSLNALSFMKSGLSIAIGYSINRHQFSTTTKSRQEIPILVYSTTQLRLIPYIARAYALDLAHKMIADLLGNSTISKEVIHSYSSGFKAITSWTSVESLQLAREVLGGQGLRLCNRIPMLLNHADLITTGEGDNTVLCQQVTKFLLAKYHATIKSAEPSNFKGELSYINHLTSQPPTTSLLGGNGGTDNSSVELNSIAFHQWLLEKREYILIKTLHSRLYGRMDDELIEPNTERWFSNWNQSLPLCKMITKANVDRLTQSFFLHKINQLASTFGSTDTNTITMLKNLCRLDTLFQIQKDLGFFINNGLLIGESKWIQLQDEITHLSRDISPHSHLLTEAFAIPNKFNPLQNSIE

SEQ ID NO: 172 - protein, 700 aa, Dictyostelium discoideum
MYCPKAYENEKKNEDLEFERSQSTFSVSELNFILNNNDHNIINIKNEIKKFIDNDEIISKPQEIHFLSREEQYKRALYVSSKLIEIKKRFGEIGRDQYYQSLFEEIPFVINDIVFACAFKSLASDEQMNRLYSKFENYQYFGSYSQTEIGHGSNVQGIETTCTFIKETGEFELNSPNLTSTKFWIGGLGKLATHTIVFAQLLIPSSIDGKLKNYGPHPFILQVRSLDDHSPLPGVTVGDIGPKLGFNSIDNGFLRLDHVRIPRENMLSRFFRVNEQGEYEKPKHPKLIYAGMVGVRSSMIENSFVSLSRAVTIAIRYSTIRKQFKSNRLDKQEKKIIEYSNQMNRIIPYLAQTFAYFFTGKRFSIEFDQMMKAVKHNQDTTLLSELHANSSGLKSLMTQSTSDGIESCRLSCGGHGYSQFSGLPYLWSNYVHMSSAEGESNLLPQQTTKYLLTILRKVLSGGGGSSDTTTADDDNKPIGKSVKYINDEFQSSFENINQFIQEKGLNSIIHPDSLLQLFKHRSFILIKSIAESIQEQMSNGNKDIPQIWSDLNVEINHCSKAHCQLYVIQSFYDQILLLSSNSSSCSSSITTVLIQLLQTYSIWIINSNLVDFLQDQYVELSQIDFLKKSLINFYKLLRPNLVPLVDSFDLCNTTLGSALGSYNGDVYSTLYKWASTQPFNKNSLPLGFNETIKPLINSKL

SEQ ID NO: 173 - protein, 682 aa, Ajellomyces dermatitidis
MPPVPEWVKALNPPGPQGSELLQQERDRSNVSVNKLAELVHTKEVLDRQDKILAVMEKEKVFDKSQILSMGRVERIKASLGKAKRIQQLREQHNWTDDEFIMANDLLSEPTPYGLHASMFLVTLRNQATPEQKKLFLRPAERYEIIGCYAQTELGHGSNVQGLETTATWDPTDRTFVMHSPSLTASKWWIGSLGKTANHAVVMAQLIIEGKSYGPHPFIVQIRDLKTHEALEGVYVGDIGPKFGYNTMDNGFLLLNQVKIPHVNMLARFSHVDPITNKYVRSAASTLVYGTMTWVRSTIVLQSGKVLARGVTIATRYCAIRRQFQDRDTTDKSSDENQVLNYKMVQIRLLPLLAATFALHFTGRRMMEMYEENQRQMARGGSAKAGALLLADLHATSCGLKALGSSVAAEGLEVCRRACGGHGYSSYSGIGPWYADYLPTPTWEGDNYMLTQQVARYLLKSARAVYANNAPDNDTSRILKNYIRRRDMGAAFDILDNDADIVDAFAWRTANLTFEALKNRDVAKRSWNSLLIDFWRLSTAHSQYLVVKNFYESVFAPSTASALDPETTAVLHKLFRLHALYTLERESADFFTSGAVTIRQITLARTKAVVKLLDEIRPHAVRLVDAWKFPDWQLDSSLGRYDGKVYEDLFHRASQENPVNNFTFDPYPWNNAVVKNEKQSKL

SEQ ID NO: 174 - protein, 688 aa, Ajellomyces dermatitidis
MASLNRQLILMRNARQAATFDPYRLTCILHKGEETVQRRREAFWRVEQATGTDDQSKLPAAYANADRESVYLQGVEAGTAAFVDGIRYNHDFFYGLDQYYTLSNGTPYGLHYMMFIPTVELQGSSEQIEYWVPLAKQGKICGCYCQTELAHGTFVRGIETTATLDTEKDEFIINSPTLTSAKFWPGAMASSCTHGILMARLVIRGEDHGVHPFIVPLRNVDGFKPVQGVEFGDLGMKMGYNGTTNGYALFSGLRIPRNHLLMGHTKVHRDGTYVRAPHDKAAYLTMLHARSTIAAGAGFKLAQAATIATRYSVVREQGAGIGDGPEMPIIHYRSQNFRLLTIIARSYAIHFTRNTLEYLEKDLKHIASNHDYTSIHLDHVLLAGFKAWNTQVAADGAEDARKSCGGHGFVLTSGLPSIVAEATAPATFEGENYVMYQQVGRYLLKCWKNLKLGNPIDSRLGILREAFTRLQTTRGKQQCCKAFGTEFLNPDIQCTIFKHRAFRLLHQCSEELENAEQKGQSAVDAFNHNLVEIIAAARAYIELLVLQDFINSVEPTSATDPAIYAALSRLRSLFALTTITHPQSYDAISFVEDQHLNAKQMRDIRCCVNGLLDQLLPDAIALTDAWDFTNASLRSAIGQYDGNAYETLMSWTRQMPINRGMEQAGGTCEVAWNTWIKPALSPELRGKL

SEQ ID NO: 175 - protein, 659 aa, Coccomyxa subellipsoidea
MITERNRASFDTKGLAEYLNGGKEKLQRLGELADLLHQQDWGNKSQRYYQNRQDTYESALKAALGIWKKVITMEDAMEARKLVDFPGGLELHIGMFIPTLLSQASPDQQAEWLPKALGLKLIGTYAQTELGHGTFVRGLQTNATYDPQSQEFVIHTPTLTATKWWPGGLGKTSTHVVAMARLFIKGKDYGPHSFVVPIRDMATHLPLPGIKVGDIGPKFGYNGVDNGYLSFNHVRVPLDNMLMRFSKVTPEGKYVPPPPSNQKASYATMVYVRATIVEGAGWALARSVTIAVRYAAVRRQTAAHAGELEVQVLDYQNTAADLLPLLASSYALIFMGKAGMAMYSEFEADRDRGNFDKLPELHAVLSGMKAVSTTIASDGMEAARRACGGHGYSLLSGLPTTFTHYVQNVTWEGDNNVMLLQTARYLVKQLLAARAGKAGGVGSADYTNNAEAELRQRCPVASSRDWLDPAVQSAAFRHRSARLCVAATDLLASASGGQVAFEGQAWNGNTVDLIRLSRAHCFFVLHSTFADSVQRLSDEGTLPAPTIAALSKLVSLFALSTLSREAGDFLEDGYMTGQQVEWARRQYYGVLRALRPDAVGLADAFGLSDYLLNSALGRADGDVYRALLAAAQASPLNETEEGPAWHSVLKPRLTPRARL

SEQ ID NO: 176 - protein, 654 aa, Candidatus Aquiluna
MNFNEDIQLDVEAIGERVLGRWADVRRHTRSVIEEHKLFKQEGQPMAEHRETVLKQLRTLVAAGATQHGFQSEFGGTMNPGASLSSFEELVFADPSLQIKYGVQYGLFSSAILYLGTEYHHKTFLGSAVSTEIPGAFAMTETGHGSDVASIGTTATYDADTKEFVIHTPDRHSYKDYLGNAALHGHAAVVFAQLYTGGEKHGVHAFYVPIRKRGKLLPGVGSEDDGLKGGLNGIDNGRLHFDSVRVPRTNLLNRYADVSEDGVYTSVIESSGRRFFTQLGALVQGRVSLTGGVVNAQKLALDIAIRYSLERKQFPGPDGEEKTIMDYGRHQRRLLPLLARTYAQVFTHQELLDQFHAVFTGQNDTDESRQDLETVAAASKALSSWYALETVQECREACGGQGFMAEHRLTGLRADLDVYVTFEGDNNVMLQLVAKRLLGDYAKAFKSPDFGTLASYVAGQVGEATINRGGLRGLAQKMVDFGSTARSVGYVKEEEHQHQLLTDRVHTMIAKLANNLKHSGPKNAQKQAELFNRYQNDLILAAKAHGELILWEAFTSALKTIEDEDSKQILTWLRDLYGFSVLEENLSWYLINGRLSSSRAEAITEYIDTRLLPRLRPHAESLVDAFLLTPGLVRTTLAADEKERQATRSQLVRK

SEQ ID NO: 177 - protein, 654 aa, Candidatus Aquiluna; identical to SEQ ID NO: 176

SEQ ID NO: 178 - protein, 715 aa, Corynebacterium urealyticum
MRVKRKSRIGCGLRHIAYPWVMAQNSPKNKQLGEDIPRRSKAPNPLPTTPNPAILPELRRVLDGQFGEARDNIREVLKDDQFRPAVGLSLEEARARTTAQLQSVLDSGLPHGAFREEQGGTGETGATLASIEMLGMADLSLMVKSGVQWGLFGGAVGNLGTERHHDLVKDLIELRALGCFAMTERGHGSDVQSLETTATYDPETQEFIINSPTASSEKWYIGNAARDGRFAAVFAQLYTPGVEESHGVHCLVARIREDDGSPVEGVRLGDHGYKGGLPGVDNGTLVFENYRVPRENLLNRFADVDEEGNYTSPIENPNRRFFTMLGALVRGRVTVGAAAGAAARTALDIGVRYANLRKQFAPSDDLPENTLIQHRKHRLRLIPRVARAYALQLATNELISGLHDLEARGVDPVNATKEEQADQREIEAHAAALKAANTAHATDTIQEMREACGGYGYMAENLLTSLKADSDIFTTFEGDNVVMMQLAGKELMTGFSKEIGSFNPLEMVRFGLDNFSTLLRRRTAADALVQNLKDTFSDSEEATLFDPASQVRLISERERRLMVSLGRRLRVAKDMPVEKAAKVVDRAQDHLLEVAWAHVDRILLEAMLEAEATLTSDTARHVMEQVRDVYFLDLIVRNGSWYLEQNLLTGTRTKAARAALNDLVDSLGPWSELLVDAFGVPSEITSVNLMRRYEDMVTKAESDPAVGQPGRWRED

SEQ ID NO: 179 - protein, 650 aa, Saccharopolyspora erythraea
MTRFAEKLPETESESSDARGDLVDLIFDGKFSSLHQDLRAALENPLFDQRPGLSTLEAGRLSYERARFLHEHLELGSELPHDQERMFAVSEWSCLVDITTLPVLNIHYNLCMGTILQHGAGRDDLGDYLDELRSMSSIGLLIATELGYGNNIAALETEAVYDHETGEFVLNTPNARAQKFMPNTGISDIPKLAVVLARLKVSGADRGVFPFIVRISDRNGLRPGVHVTRLPEKPGFALDNGVTRFDHVRIPRRNLLTGSAGRLTDAGEFRANVKNRRTQVLRALDRVTPGRICLSGALISAARASTYIAVRYAWQRLTAAPGRGEVPIISFRSQQSALFTSLARVYAMTFLLNHVKKEYLHRHGGDDTEVNQLVSIAKALSSWEMSEVLHVCRERCGAQGMFSINRIADYLPMAQGVVTAEGDNLPLLATVAGQMVAGRSGRVASAPQVPEPGDIRDGQFHLDLLRYREDSLRWETRQAMRKRSDERPSLASGWNDNMNAAVSMARTRGVQVALERFLDAADRARTEESRTALQLLACLYGLIEVERDSGWYLARNALTPEQVERLPREIDSLCEQILPHSLMLVDAFGVSPELLRAPIAADDYVSAVDQAVGHALTSVRPNAPAPRQPVEATAGHTGNGRSVRVEASTG

SEQ ID NO: 180 - protein, 650 aa, Saccharopolyspora erythraea; identical to SEQ ID NO: 179

SEQ ID NO: 181 - protein, 495 aa, Nocardia brasiliensis
MLVLTGHFDLAVGAILALGNDSPYQQECLAELDTGATIGVLMLTELGGTNGADQQTTTRWDPTTETFLLNTPSATAVKIMPNVADATEPKTAIVTARLLIDGQDEGVLPFLLRLRTRDGLADGIEVVRLPDKVSAPMDHAMVRFNDVRLPREALLGGDWARLSPDGRFACVLPPRKRFHRAINVLGNGRLDLANAAVASARAALAGLVNYTRQRRPGSGVLMADRDAVQRDLATALAAVYATSSLGLCLRELRATGTDRDHAVWSMLAKPLLSNTAHQVLMMCRQRAAAQGALRINHIVDWIGNLEAIITAEGENQIMQVTAGKQGERLTALELPHTRETPWYIETLTEREHTIAADVRNGDYRSAGSVLGPDSAAIELATATAERLAATALSTAALNTDDPTAKELTTAAAAAYALERIHARGTWYVAHSRMSPGQAASLTTELNRHHAVLTAHLPTMVAAFDIPRLSGPLFATDYIQAWQDYAGWRAPASTEH

SEQ ID NO: 182 - protein, 726 aa, Exophiala dermatitidis
MADFTNTLRPADPQGPEILSQERAGSDVNVNQLATHLLSRNDFLQRQKKILAILEGIPIFCKRNQLNMARPDRYHLGLARAKMLRRLSLKHGWDRDDYIMADYLMDEMGPYALQATMFATSIREQSNDQQKAYWLPKVENWEIIGCYGQTELGHGSNVKGIECEARWDPATKEFIIHSPTITASKWWNGALGRTANHAIVVAQLLLPEKTGLKSNSNSGTANNYKYKSYGPHQFIVQIRDMKTNKPLDGIVIGDIGPKYGYPAMDNGYMLFKHFRVPHSALLARYSGVDADSGKYIKPENPAVVYGSLTFVRAQIVMHARLVLARAVTIAVRYLSIRRQFSDRDSKGGPEQAVLNYPTVQIRILPLLATTFALHYTGEAMYKLYYGTREAIETSGDFSRLAEMHAASSGLKSLCTTLAADGIETCRRAMGGHGFGGGSGMIALNNEYLSKPTVEGDNWMITQQTAAYLIKRMTEVVKHPESEPKETVDVQFQQFLARNKQSKTPAEYDLFNSTDDASGIVGAFEHRASYLAYQAYHARVVQKQPWTSMMISLHRLSRAHSETLLVSNFHHAVFQTSRPDPPLDNATLRVMRTLFRLFALYTLDVSASEFLLSGAITLQQLQAVMPTIQNLMTDVRPHAVRLVDAWSIPDYLLESALGSYDGDVYNRLFRKAHWENPLNLVTFNPDWRNEEVVMGEGAENARRRLEELALGVQGHEQAGKGDVKAKL

SEQ ID NO: 183 - protein, 701 aa, Exophiala dermatitidis
MPSNPDWVKALKPSGPQGSELLAQERAKSTLNVDQLANFMFTRENLERNERILKILLADPVFDKSQNYFRGRTERIEAALARGKRLQQLSVQHKWTKEEFQVANDLISEPTPYGLHASMFLVTLKEQGTPEQHKLFLERAEAYKIIGCYAQTELGHGSNVRGLETTATWNPEDKTFTLNSPHLTASKWWIGSLGKAANHAVVMAQLYIDGKNYGPHPFVVQIRDLKTHEPLPNIHVGDIGPKFGYNTMDNGFLLLKSVKIPHVNMLARFSRVDPNTNKYVRPSNPSLVYGTLTYIRSNIVLQAGSVLARGVTIATRYCAVRRQFQDRDAPETEVGENQVLNYTMVQIRLLPLLAATFALHFTGKGMISLYQENQKRMNGDAGKLADSTGKRAPGPEELNPGTDLLADLHATSCALKALSSTTAAEGLEVCRRACGGHGYSSFSGIGSWYADYLPTVTWEGDNYMLTQQVSRYLLKSARAVLKGNAADNDTTRILKEFRRRQDIGAAFDVIGSDSDLVAAFAWRVSFLTFEALRHRDEDKQSWNSLLVDFWRLSTAHAQYMVVKNFHDALNDSNTTNQLDPETVGVLHKLFRLYALHTLEREASEFYSSAAVTVRQITLARTKTVMKLLEEIRPHALRLVDAWKFPDWQLDSSLGRYDGKVYEDMFYRASELNPLNSIVFDPYPDSKVLFKKDERANLRSKL

SEQ ID NO: 184 - protein, 495 aa, Nocardia brasiliensis; identical to SEQ ID NO: 181

SEQ ID NO: 185 - protein, 571 aa, Aspergillus kawachii
MQSHHSFNSSTLSLLSSKLFEHHYEDGPRIEELERSYHRARAIGQLHGVTLEDCLHMTPKFWAVHKDGIIVRDAVAHILVTIQLNLVAGTVAPFALKRPDLHPLMKEILNFDISAPFMLNEVGHGCDSRNLETTATLQRDGSFILNTPTPEAVKFMPPSMPIKGIRRVAIVCARLIVDEEDRGIRTFVVPLNNGMEMNKGVHSWLLPPITGGRVLDHSLTSFDNVHLPANAMLGELAMPADLRAQYLSAIHRLGTGALALSLWIIPFLKCAAYCVGKYSQRRTVQAGVHGERVPIISFRTQQLPILHSLAQIAVMEPFSDWLTHLYSTDNSLHPGAKHGLGVIIKAVFLQNGQWSLANLIERSGAQGVYPHNQMVTFEVFTRATGIAEGEVLVLSIRLATELLLGRYAIPGPTKPDCLLAQHEAGIFSELRRKLKKIGNHRGDEYSKQVLPHLRPMVIAIGQRMAYEAAVNASVDPDLLALYEAGAMKSDPAWFSEHLGISRDAQFQKECDAVDAVYRRLDEHLDNLQIEPYITAPMLSADRWMGIIKAVPEFTGNGEMSFPGAQEFQSKL

SEQ ID NO: 186 - protein, 701 aa, Arthrobacter aurescens
MTEVVDRASSANQPSGRDDAATPSAAEPVVDVAALGEQLLGKWAHIRHQARAVAGNPAVQKIEGLHHTEHRARVFEQLKFLVDNNTVHRAFPTRLGGSDDHGGNIAGFEEIVTADPSLQIKAGVQWGLFGSAVMHLGTVEHQDKWLPGIMSLEIPGCFAMTETGHGSDVASIATTATYDEASQEFVINTPFRAAWKDYIGNAANDGLAAVVFAQLITKNVNHGVHAFYVELRDPATKEFLPGIGGEDDGIKGGLNGIDNGRLHFANVRIPRTNLLNRYGDVAVDGTYSSTIESPGRRFFTMLGTLVQGRVSLDGAAVAASKVALKTAIQYATERRQFNASSSTDEEVLLDYQRHQRRLFTRLATTYAASFAHEQLLQKFDDVFSGAHDTDADRQDLETLAAALKPLSTWHALDTLQECREACGGAGFLIENRFASLRADLDVYVTFEGDNTVLLQLVAKRLLADYAKEFRSADFGVLARYVVDQAAGVALHRTGLRQVAQFVADTGSVQKAALALRDEEGQRTLLADRVQSMVAEVGAALKGANKLPQHQAAALFNQHQHELIEAAQAHAELLQWEAFTEALGHVSDEGTKRVLTWLRDLFGLSLIEKHLSWYLMNGRLSMQRGRTVGTYINRLLVKIRPHAVDLVDAFGYGPEHLRASIASGAEAVRQDEAREHFSEQRASGSGPADEKTLLALKVRKSR

SEQ ID NO: 187 - protein, 643 aa, Nocardia farcinica
MATGSPTTADHLRAALDGPWRDIRQQARRELADERFLGDPNLDYKAARARVLDQMRLLAAMDYAKRGFRLENGGVGDPGGAVTALEMVAYADLSLWVKSGVQWGLFGGAVENLGTERHREYIKQLISLDLLGCFAMTESGHGSDVASLETTATYDPATQEFVIHSPTPSARKDYIGGAAEHARMAAVFAQLITQGEGRGVHCFLVPIRDEQGADLPGVTTSDDGLKGGLLGVDNGRIVFDHVRIPRENLLNRYADVEPDGTYSSPIENPSRRFFTTLGTLVRGRISVGGAAAAGARVALSIAVRYALQRRQFADPDSGTETVLMDYRMHQRRLLPLVAKSFAYAFAQNDLVRRMHVIQTGQNLDPGAQRALEKRAAGLKVAQTRHATRAIQECREACGGAGYLTENRLVTLKADTDVFTTFEGDNVVLTQLVAKELLTAYADEVQDLDALGWVRFAATMAGDVVRKRSGVRQLIQTLRDRSDESVDEGDLSRRSTQLQLFADREDYLVRTAAHRLRARAEDTTPFEGFNNAQDHILAAGSAHIDRLVLEAFIEGIGEIEDPEARALAETVCDLFVYTLLEENLAWYIMHRFMSVERAKAVRRGVNELVDRLRPHALTLVEAMGVPEEMLHAAMLHDASVYQRS

SEQ ID NO: 188 - protein, 743 aa, Puccinia graminis
MKPSSSGASHSTTQLVAPSPMETLANERRECPFDLWRMTCVLHGGEKSVLLKDKFMQEIERDPAFKLDDIHDLTKDQIRERTMAKFANMVHYVTTERLDVFTKRMELIGIADPAFWTRFGVHYGLFLGAIRSGATANQFSYWLDKGVLGLNGITGCFAMTELAHGSNVAGLETTATFDEQADEFVIHTPTISATKWWIGGAAQTATHCSAFARLIVKGKDYGTKTFIVPLRDPRNFSLLPGVNIGDIGKKMGRDGIDNGYIQFTNVRIPRAYMLMKHTQVTREGKVFEPPLAQLTYGALLQGRTAMVADGAHVAKKALTIAIRYGAIRRQFKTGNNPFETQLLDYTTHQRRLMPLVAQAIAMGFTALRMTDLYEKLSMELESFDSSSDKEHTERVLETLKETHASSAGLKAFSTWQCLETIDRCRQTLGGHGYSSYAGLASMYADQAVQCTWEGDNTILSLQAGRSLISAYQDAQKGKKLSTGTAYLNDKSILNARCRSDEVVVDLDTMDLAWGTIAANVVKKAADVYESKLKQGLGKDVAMEGCAHERFCAAKIHTMGYIFRQFRDALGSLSDEEPRTLKTLKTICQLYGSFQIEENAAYFLKYGFYTPKQMDMVSETVTQLCAEVRTYAVSLIDAFRYSDHIINSPFGRYDGNVYSAYFNAVRAANPLPPVHPYFDRLIKPLLTREPLELGDASEIGIDEEIEEIQQERSQGLDENDEGSIPLTESQRQETEGVAEWEKKR

SEQ ID NO: 189 - protein, 569 aa, Streptomyces sp.
MRTVAAAIPDPRALALSAPALTALHEWAGPADPGMATLASIHYNLFLGSLLDHDHAERDLEPWLRMDRIGTFLCTEAEHGNDAVNMETTAEYDRASRQFVLNTPGPGAAKWMPNTSLTGGPKDAVVAARLLVDGRDLGIFLFLTPLSDERGHLPGVSVERLPHTSGAPVDHCATRFHHVRLPHSAMLQGDHGRLSPDGEFESTLGSPRIRFLRSIGRVSMGKLCMSGYSLGATRQAVAVAVRHGSTRLTSGMTKGRRVPLMAHRSHHEPLLDALATTYAATLLHRSVVRQWEVAEEAEREEVDRLVAVTKGWITWAARETMTTCRERCGAKGLLLTQGIAGQLAANEGTITAEGDNQVIWVKAAGELLMGGFTPKPPSETAPEQRSLRDGTHLQDLMADVERIWHERARTRLRTGGVRGNPMARWNGAVTPALELVAAHAHRLAGEALLEGSDRVTGDEAERIRDLHRLFALRQVAAHSGELLAGERLTAEQVRRLPDEVERVVADLEPHALALTERFFVPEQVPGSDPAGLVETAGLVEAAPEAVAGALPAGAESRTGGLRESEPDAA

SEQ ID NO: 190 - protein, 640 aa, Rhodococcus equi
MATTADHLRSTLDGRWAEVREKARIDLSTDEFRPHYTPDIAQARAKTLEQMRVLATGGFVDRGFGVEIGSGADPGAAVTAIEMLAMSDLSLMVKAGVQWGLFGGAIENLGTEDHHAEFLRPMIDLELLGCFAMTETGHGSDVQSLETTATYDAATDEFVVHSPTPSSRKDYIGGAAEHARVAAVFAQLVVGDESHGVHCLLVPIRDADGNDLPGVTTSDCGLKGGLPGVDNGRIMFDHVRVPRTNLLNRYGSVDADGVYSSPIENENRRFFTMLGTLVRGRITVGGSAAAAARVALTIATRYALQRKQFSAPSGDDATPDPEVPIMDYLVHQQRLLPHIARAYALGFAQNELVAKMHDIQTADEVDSAEQRELESRAAGLKAANTWHATRAIQECREACGGAGYLAENRLTALKADTDVFTTFEGDNTVLTQLVAKELLTKYADEVRGMSPVEWMAFAASAFGDAVRSRTAAQQIIQTILDTRQDNEEDGSLFNRGTQLTMFEDREEYLLATAARRLQAARKREDDPFDAFNFVQDHVLHAARAHIDRVVLEAFIAGIDECEDEAARDLLSELCDLFALTVIDDDKAWFMEHRLLSVERAKAVRRGINERCRTLRPHAATLVDGLGVPDALAGAAMLDGQ

SEQ ID NO: 191 - protein, 768 aa, Flavobacteria bacterium
MKTSISIEDSLLPFLPLLYIAWADEVLEEHEILYIKEQFDKNETIQSEVKESIYKWLNPDMPPSARELAYWKSYIKDHADLLDPTAKMDLFTLGKTLAKNPDSEEWVNEQTKQSLIHIENYLGVASHEAIRSVYETNPLPLKESFNLNKPLKDYSLALKTLLQHNNADLKARVQNILDPHKEAIESYDDDLITRKEKVFKWTKELADAGLGKLAYPNAYGGSDSMVQYAAVFEELAKYDLSLTIKFGVHFGLFGGSVESLGTTYHHDKYLKDIGNMTLPGCFAMTEMHHGSNVKALQTTAIYQPDSNSFIIHTPSQHDRKTYIGNAAMHAQMATVFAQLIVDGEEHGIHAFLVPIRNIKGDAMPGITIGDNGHKMGLNGVDNGTLHFNSVRIPKENLLNKFGDIDEDGQYFSPIISPSRRFFTMLGTLVGGRLCVPMAGNTASKKALNMAVYFALDRKQFGPPGEPEQSIMDYPTHQKKLMPLIANAYAYDFAHNHLLREYTSDAKHDAQEMEALAAGLKALSTWNTTATIQTCREACGGKGYLSEMYFDLLKADSDIFTTFEGDNTVLLQLTAKSRLTYFRKQFGKMDWWDTLKYISSIASTNLSELNPLVTRDTSEDHLLDNDFLLSAFSYREEYSLRSLAMRLSKKIKNGMDSYEAFLQVQVHLIDMASAYIDRIVLERFIATIDEQENESVKEILTSLKNLYALHRIEENKGWYLEHDYISGSKSLAINKLVQKLCEEFKEDSQHLVDVFDIPKHMTETALKFY

SEQ ID NO: 192 - protein, 724 aa, Corynebacterium nuruki
MSNSTQEDAATGAAASAAAASVPAGLPRRTTDGPAKLRMKADAAQRAAIAAELQAALDGPYAASRAAARDLITDRDLRPDDTLPLDEARERTLSQLFDLLATGAPRGAFRTDHGGTGDIGATLSAIETVGGADLSLMVKAGVQWGLWGGAVENLGTDRHVPLIRDIMELRVPGSFGMTERGHGSDVQALETTAVYDRATHEFVIHTPTPMAEKWYIGNAAKHATMAAVFCQLYTPAGDYEEQAAGADATSVPESWGDSHGVHCLVVPLRDADGNALPGVGIGDHGYKGGLKGVDNGTLRFDHVRVPRENLLNRFADVSEDGAYSSPIESDGARFFTMLGALIRGRITVGASAGSAARTSLTIATKYATKRRQFAPDDSMPESRLIEHRKHRLRLIPLIAKSYAMQLASNKLISRLAELETTVPDRTAMTKEQSANQRELEAHAAALKAAGTAHATRTIQECREACGGAGYMAENLLTTFKGDSDVFTTFEGDNVVMMQLAAKELLTGFSREMGNLGPLEVVRFGLDSFGTLLKRRTAAEKIIQSLVDSVTDRETTSLFDPAYQVELLTERENRLLMSLIRRIRPAQKMDTADAAALVDSTQDHMLSCAWAHVDRIVLEALLEAEAGLPDGQAKQIMEQIRDVYLLSLINDNSGWYQEQNILNGARTKAARAALNDLVDSLGPWAETLVDAFAVPESVLDIPLLADVSDPTALTFRCDTDPAAGM

SEQ ID NO: 193 - protein, 662 aa, Rhodococcus erythropolis
MRLGSNRVARGALRAIVGSMATTADHLRTTLDGRWREVRERVRGELNDERFAPHYTPNTAIARSKALEQMRVLADLGYAANGFAVSHGGTGDAGGAVTSIEMLAMSDLSLMVKAGVQWGLFGGAIENLGTERHHQAYVKPLIDLDLLGCFAMTETGHGSDVQELETTATYDVETGEFVVNSPTPSSRKDYIGGAAQHATVAAVFAQLITGGESQGVHCFVVPIRDDAGNDLPGVTTSDCGLKGGLPGVDNGRIVFDQVRIPRENLLNRYADVAEDGTYTSAIENPNRRFFTMVGTLVRGRVTVGGSAAAAARVGLAIAGRYALQRRQFSAPKSDDEVLIMDYLVHQKRLLPLIARSYALQFAQNELVAAMHDIQSSDDPDPQEQRELEGRAAGLKAANTWHATLAIQEAREACGGAGYLAENRLTALKADTDVFTTFEGDNHVLTQLVAKELLTSYADEVRGMSPVDWMRFAATTVSDVVKKRTAAQQILQTIVDTRQDNEEDGSLFNRGTQMKMFEDREEYLLATAARRLQAAQKREENPFDAFNFVQDHVLKAAQAHIERVILEAFVAGIDSCEDETAKELFGEVCDLYALSVIEEDKAWFMEHRHLSVERSKAVTRGINERCRTLRPHVETLIDGFGIPDILLGSAMLDGPGTDAVRLK

SEQ ID NO: 194 - protein, 703 aa, Candida tenuis
MSLSVKNTVDSSRGPDPKTSITTERANNQKWDPVLMNHFLEGSKEASELNRTMYQQMERDPILRANPHYYDLGKEEERELTALRIDRISQYLESDTPAEYNRRASLISVFDPQLNTRIGVNLGLFLGCIRGNGTPEQLKFWSASKETKILKHIYGCFAMTELAHGSNVAGLETTATFDKENDQFIINTPHIGATKWWIGGAAHSATHTACYARLLVDGKDYGVKTFIVPLRDSNHKLMPGITVGDIGAKMGRDGIDNGWIQFSNVKVPRFFMLQKFCKVSREGDVVLPPLEQLSYSALLGGRVTMVLDSYRVGARFSTIALRYAIGRRQFKSGKNELETQLLDYPLHQRRLLPFLALTYLVSCGAMKLEKTYDSVLDGLDEAVEKNDMKVISKSIKEMKSLFIDSASLKSTCTWLAADLIDQSRQACGGHGYSGYNGFGKAYNDWVVQCTWEGDNNVLAMSVGKPLIRSIDEILNKDKKASGSISFLNNAKQYLNEDNVLKSFEDVNDLKKVLLSIEILIIRLCKDSLDTIKQNGGQYEIVSGSMVTISKLKAHHYLLNEFLIRTEAADASLKPFLTLIARLYSASIVLDKFSGDFLTYSVVSPKFMGKINQEYIPKLCLEVRPLVINYTDSFQQPDMALNAPIGNFNGDIYENYFGVVKQENNPFNYKAPYSAALESMLNRPSLSDRQRGERSDSVKDILSK

SEQ ID NO: 195 - protein, 712 aa, Candida tenuis
MTVTKVVNSSAPPAPKNFIQAERDAAVFNPEVMNYFLEGSQERSQETKAMIQQMERDPILAARSSDYDMTKAEARENTIAKINRLSRYIESETFDEFERRMSLISVFDPQLHTRVGVHLGLFIGCIRGNGTFAQMNYWVLEKESAFIKNIYGCFAMTELAHGSNVAGLETTATYDEDNDQFIINTPHVGATKWWIGGAAHSATHSSVYARLIVKGKDYGVKTFVVPLRDSNHELMPGVTVGDIGSKMGREGIDNGWIQFSNVKIPRFFMLQKYAKVDSNGNVEQAALNQLSYSALLGGRVVMVKDAFRWSSRVITIATRYGVGRRQFQAAKAKESDPESQLLDYPLHQRRLIPILAMCYAFSNGANVLADYAKEANEILDSAVANDDKAGIDRGVALAKSLFVASGSLKSTCTWLTLNNIDQCRQACGGHGYSAYSGFGKAYNDFAVQCTWEGDNNILGMSVGKQLVKNIKSVLEGGEKPEGILEFLNNAPKYINNKDAILDSDALSDTSKLLQAIQVVLIRGSYQCLKALEANGEDWDYIGADLVTLSKLLAHFFLLKAFLDKIDSMSSPDEKVLVEILDKLAQLYSATIVLEAFSGFFLSYSVISADAMTTLTTGRIQELCSQIRPHVIPLTDAFQLSDMMINSSLGGYDGNFYEEYFKIVKDNNPAPGSFHAPYTASIKAMLQRPSYDDRTRQEFTDETAESLDPEEDD

SEQ ID NO: 196 - protein, 650 aa, Mycobacterium colombiense
MAPETTTTAEHLRNTLDGRWRDVRNRMRDTLTEDLFRPHYTPNTVIARTKVAEQMRIMAAFGAAADSFKKEHGGTGDVGAAITMIEMLAMSDLSLMVKAGVQWGLFGGAVENLGTERHHETYVPKIISLELRGCFAMTETGHGSDVQSLETTATYDPQTQEFVIDSPTPSARKDYIGGAAETATMAAVFAQLITTEDGKPVNHGVHCVLVPIRDEDGNDLPGVTTSDCEYKGGLPGVDNGRIVFDHVRVPRVNLLNKYGDVAADGTYSSPIENPNRRFFTMLGTLVRGRITVGGSAGAAGRVALDIATRYALQRRQFSAPGDGSEVLIMDYLVHQRRLFPLIAKSYALQFAQNELVSKCHDVQSADAPDADEQRELEARAAGLKAANTWHASRAIQESREACGGAGYMAENRLIGLRGDTDVFTTFEGDNHVLTQLVAKELLTAYADDIKSMSPVEWVRFAANTVGERVVKRTAAEAIIQTIVDARQDSEEEGSLFNRGTQIKMFEDREEYLLASVARRLQAKSKEMSEFDAFNSVQDHVLHAASAHIDRVVLEAFVAGIDACPDEQARELLGILCDLYALSVIEDDKAWYIEHRYLSTERAKAVTRGINDRCRALRPHAETVVDGFGVPARLRDAEMLHPENLSEALTS

SEQ ID NO: 197 - protein, 650 aa, Mycobacterium colombiense; identical to SEQ ID NO: 196

SEQ ID NO: 198 - protein, 449 aa, Sphingobacterium spiritivorum
MFDKIKNMMGLMKSIDLEQIEKISKKIDLKQVMEAISKMDDKQLQAVTKMLTGGGKKKELPPINGDFYDIDAKLGPEDRALQLKVRSFMETEIKPIVNNYWLRDEFPFEIIPKFAALNIAGYTYEGYGCAGGTSLMEGVVAAEIARVDASIATFFGVQSGLAMGSIYICGSEEQKQEWLPKMQKMEVIGAFGLTEPEVGSGAAGGLTTTCQKTEQGWVLNGQKKWIGNSTFSDITIVWARDLDDGEVKGFIIRKDTPGFEVEKIKGKMALRIVQNGLITMTNCVVAESDRLQNANSFKDTAKVLQMTRAGVAWMAVGCARGAYENALDYTRQRKQFGKPIAAFQLIQNHLVEMLSNLTAMQTLVFRLSELQDAGQLKDEHASLAKVFCSLRTRDIVSKAREVMGGNGILLEYNVARFLADAEAIYSYEGTKEINSLIVGRSITGFSAFV

SEQ ID NO: 199 - protein, 695 aa, Corynebacterium striatum
MALTKTLSRDSNKEQNPGRGDGRSAPAQAEPRSPGRLPTTPKPSVATELGALLDGPHASFRHELREFIDDPSLFPRPELSVAEQREHTFNNLTKVRDFGGFQKGLRRDYGGPGKPILSTFTLEGLAWADGSLAIKSGVQWGLWGGALDQLGTERHLEWVEKASSLELPGCFAMTERGHGSDVQSLETTATYDPETDEFIINTPKDTAVKNYIGNAAKDGRAAVVFTQLYTPGSDGRSHGVHAIIVPIRDEEGNSLPGVTVGDHGHKGGLVGVDNGTLRFDNVRVPRVNLLNRFADVDEKGKYTSPIENPNARFFTMLGTLIRGRMGVAGAAGAATEASLDIALRYANRRRQFEGATGSEKRLIDHRQHRRRLLIPLARTYALHLLHNQILERYQEMNDQQESGTWSVTTPDEEQKFASREMESLAGAIKAAQTQHAIRTIQECREACGGAGYMSENRLTTYRADSDVFATFEGDNTVLIQMVGKNLLTAYGRAMNDMSPWDTVRYAATTATEVVRRRTGFTTRLQGLVDLVNPNEASLFDAVYQAKLIDDRAQSVLLSLVRRIQPARKADKVQAAAIVDKCQDHLIAAGWARVDTLLVQAMIEAEERLEEGSLARQVFEQLRHLFVLSTLVEHAGWYQEHNLLPAGRMKAARAAINDLVDSLAPWSVVLVDAFGLPSEVSNIPMLTETGVDPLRH

SEQ ID NO: 200 - protein, 650 aa, Saccharopolyspora erythraea; identical to SEQ ID NO: 179

SEQ ID NO: 201 - protein, 672 aa, Corynebacterium jeikeium
MSTAPTAETQASIAKALQTVLDGDFPEAREETRSLLADPDILPRTDLDLEQSRARTTEQLQRVLESGVPNHAFRADQGGTGETGRCLTSIEMLGHADLSLMVKAGVQWGLFGGAVGNLGTERHQEMVGKLMNLEALGCFAMTERGHGSDVQQLETTATYDAETQEFIINSPTASAEKWFIGNAARDGRWAAVFAQLIVPKAKGETESQGVHCLLVRIREDDGSAIDGVRIGDHGYKGGLKGVDNGTISFDNHRVPREALLNRFADVDEAGNYTSPIENPNRRFFTMLGALVRGRVTVGAAAGAAARTALDIAVTYANLRRQFAPDDSLPENRLIEHRWHRLRLIPRVARAYGLQFATNKLIARVHELDQRGVEPTEYTKEQQADQREVEAHAAALKAANTAHATDAIQEAREACGGAGYMAENLLTTLKADSDVFTTFEGDNVVMMQLAAKELMTGFAKELGGLNPMEMVRFGLDSFSTLLRRRTAADALIQNLVDTFSDSEETSLFDPAYQINLLSEREDRLMRSLARRLRPARKMDVDEAAKVVDQAQDHLLAVGWAHVDRIVFEAFVEAESKLDSEDAQRVLEQVRLVYFLSCIVDNASWYLEQNLLTGTRTKAARAALNDLVDSLGPWSQTLVDAFGIPDHITDLKLMEDYEAMVPKYESDPAAGQAE

SEQ ID NO: 202 - protein, 719 aa, Puccinia graminis
MSDRSIAPVGPPDPSLPPVGSKINFNESPSLDSHEVSPPPGQSADHSGLTFNIPVPAHLKPTGTPGSKLLHIERSHASFDSKSMSFYLYGTTYLEKLNRILAIVQDEDAFDKKRLNYQGRDARFRHALRKEKRLVQIAKEHRWTEEDMSMAEMLIDMPGPFSLHKSMFLKTLQEQGDEEQQKMFTQPAENFQIIGCYAQTELGHGSNVQGLETTATYDKATQEFIIHSPSLTASKWWIGGLGRAADHAVVMAQLYTNGKKYGPHPFVVPNPRHPNSRPFTWSNNGMILFDKVRIPHNHLLSRFSRVDPHSGQYIKPDNAKLAYGTMTYIRAGLVQQARMVLARSAIVAIRYCAIRRQFADKDAPVLDGKKPAENPVLDYQMVQYRIFPILAQAFACHYTGLEMFRLYNESQKNMSEGDFSLLADVHASSSGLKSLCTIMAAQAIEECRRACGGHGFSQASGLGALYADYLPQVTWEGDSYMITQQTGRYLFKTMRTLFQDRNAKLSAENVTGEYILRYLENPNEKSKVEYSGDFHDVQAFIWAYGHRAAFLVAQATRKRDIERRTWNSLLVDIYRCSVAHCQFLMVRNFARVLLYDEALKAKPALHHVIQLVFELYACYTMDVEASEFLASGYISPKQHILLRNRVYSLLAQIRPEAVALCDSFAVPDYLLNSELGRSDGNVYQKLIEFASKEPLNAVKFNVNPWDNELAIGEPSLAKL

SEQ ID NO: 203 - protein, 623 aa, Dictyostelium fasciculatum
MYRERILQISKHLNPSNGLEGPKINSIVVGNKQVALDTDFKIDVQRLKLELDSPQLSAYKDQVREFIKNEPLLKSPVGIPPDQYKELVLQQLVKVAQSGLVKCTDVRDRIAHFCSAVEILGLYNNNLCTKMFVHYSLFGGTVTLLGTERHEKYIDMVTNATHVGCFSMTEIGHGSNVRGLETTAKYDVKTQEFVIHSPTLSSHKFWIGGAGLHGRLTSVFARLITPDGVDHGVHCFVVPIRDEHLKVLPGITITDCGLKHGLNGVDNGKLQFTHVRIPRENLLNKTADISPDGIYKSQYATPIKNFAATMAPFIGGRLYVTKSSAAASRVCLAIAIRFAHYRKQFGPSDNQELPIITLPQHQRRLMVPLARTIVYDFFLHSLENQLQSKNAPNTIHPHCSGIKAMYSWHSISTMQVCREACGGQGFRSDNLIAEFKADCDVNSTYEGDNTVLVQQVAKYLLSQKSSSKDNIKKFDQIQQLYNLNELLVLFKSREQLKIEELKGLVGKNSYQSFNDAVPWAVRTTFAYMDRVILECAIQRVQAPRVYLHPLAHIVLLDTLGRIEDDLAFFLSHQLITPEIANCIPFVIMDLCKFITSHSLDIIKSFDIPAKCLPSESLTDNIYN

SEQ ID NO: 204 - protein, 691 aa, Dictyostelium fasciculatum
MSTTTQALQDIKNERSKASFHVETMTNIIYDQESLDTKVKPTTQRINIKRKVKEAYSKDPVISKPEQHYFLSREDQFSRCLDVVSRVINIKKNLGLVNTPGLEFHRELGHEMPLLLHDVVFAGCIKSLASDEQLKEWLPKILNYQWIGSYSQTELGHGSNVASLETTIHYIEETDEFEINSPSLTSTKWWIGALGKISTHTIVFGQLWLKEKATGELKNYGVHPVLVQIRSLDDHIPLKGVEVGDIGPKFGFNMVDNGYLRLDKFKVPRSNLLSRFFQVTRQGHYIAPPHPRLVYAGMVGVRAHLIEDSFTQMAKAITIATRYSIVRRQFKTNSIIENMVLNYGSQQMRIFPSIAATYAFAFMGKRLYQSHVAMMTAIKKNHDVSRLSELHSLSSGLKSLCTTIACKAIDDCRLACGGHGYSNLSGLPTLYAGYAHVLTAEGENNILPQQTARYLLKVFKDVLLSGQTKVGETVQYLVNESNDQSHATLEQFLGLPVGQFATGQTLLKPEVLLKLYTQRSFSELARLAFLLQDATANGDDLAQTWTELNTDCIRVSHAYCQVYILSSFFDEINRLPTSPSKDVLVKLAQLYALVQLETSAGDFLRSGFLLPKHIDTIRGLIPYLLRQLRPDALPLVEAFEVSDLALASAIGRSDGKAYETLFNLVKSQPFNQPKVVDGFNQYLQPIIKSKL

SEQ ID NO: 205 - protein, 699 aa, Trichophyton rubrum
MVSSPDWVKKLTPAGPQGSELLKHERGQSNISVDKLAELLHTKEVLERQDRILSLIQHEEVFDKSQNHSLGRVERVKKALARAKRLEQLKRQHNWSEDDFLMANNLISEPTPYGLHASMFLVTLRNQGTPEQHKLFLEPAERYEIIGCYAQTELAHGSNVRGLETTATWNPEDKTFTIHSPSLTAAKWWIGSLGRTANHAVVMAQLYINGKNYGPHPFVVQIRDLKTHEPLENVHVGDIGPKFGYNTMDNGFLLFNKVKIPHINMLARFSRVDPITNKYVRPASPSLIYGTLTWVRSTIVLQSGGVLARGVTIATRYCAVRRQFQDRDAPANAPGENQVLDYKMVQIRLFPLLAATFALHFSGRGMMALYNHNQVIMKKSASNQASGRGAGPEELNPGADLLADLHATSCGLKALASTVAAEGLEVCRRACGGHGYSSHSGIGPWYSDYLPNTTWEGDNYMLTQQVARYLLKSARSVFVGKPANNDTCAILQSYLSRRETGAAFDILENDADIVAAFAWRAAYLTFEALKHRDVEKRSWNSLLVDFWRLSTAHSQYLVVKNFYEAVFPSGSSAEVAASLGIDEPTLDVLRKLFRLHSLHTLERESADFFTSGAVTTRQIILTRTKAVMRLLDEIRPHAVRLVDSWKFPDWQLDTSLGRFDGKVYEDLFRRASEENPLNELTFDPYPMSNTLVKNDKSKL

SEQ ID NO: 206 - protein, 687 aa, Trichophyton tonsurans
MVSSPDWVKKLTPAGPQGSELLKHERDQSNISVDKLAELLHTKEVLERQDRILSLIQHEEVFDKSQNHSLGRVERVKRALARAKRLEQLKRQHNWSEDDFLMANNLISEPTPYGLHASMFLVTLRNQGTPEQHKLFLEPAERYEIIGCYAQTELAHGSNVRGLETTATWNPEDKTFTIHSPSLTASKWWIGSLGRTANHAVVMAQLYINGKNYGPHPFVVQIRDLKTHEPLENVHVGDIGPKFGYNQDPSYHMLARFSGVDPNTNKYVRPASPSLIYGTLTWVRSTIVLQSGGVLARGVTIATRYCAVRRQFQDRDAPANAPGENQVLDYKMVQIRLFPLLAATFALHFSGRGMMALYNHNQAIMKKSASNQTSGRGAGPEELNPGADLLADLHATSCGLKALASTIAAEGLEVCRRACGGHGYSSHSGIGPWYSDYLPNTTWEGDNYMLTQQVARYLLKSARSVFVGKPANNDTCAILQSYLSRRETGAAFDILENDADIVAAFAWRAAYLTFEALKHRDVEKRSWNSLLVDFWRLSTAHSQYLVVKNFYEAVFPSGSSAEVAASLEIDEPTLDVLRKLFRLHSLHTLERESADFFTSGAVTTRQIILTRTKAVMRLLDEIRPHAVRLVDSWKFPDWQLDSSLGRFDGKVYEDLFRRASEENPLNELTFDPYPMSNTLVKNEKSKL

SEQ ID NO: 207 - protein, 699 aa, Trichophyton rubrum; identical to SEQ ID NO: 205

SEQ ID NO: 208 - protein, 683 aa, Ajellomyces capsulatus
MPPVPKWVKALKPTSPQGSELLQQERDSSNVSVDKLAELIHTKDVLDRQQKILAIMEKEKVFDKSQILSMGRVERLTASLGKAKRIQHLRKQHNWTDDEFIMANDLLSEPTPYALHASMFLVTLRNQSTPEQAKLFLEPAERYEIIGCYAQTELGHGSNVQGLETTATWDPTDRTFVMHSPSLTASKWWIGSLGKTANHAVVMAQLIIEDKSYGPHPFVVQIRDMKTHEALEGVYVGDIGPKFGYNTMDNGFLLLNHVKIPHVNMLARFSHVDPATNKYVRSAAATLVYGTMTWVRSTIVLQSGKVLARGVTIATRYCSIRRQFQDRDTADKSSDENQVINYKMVQIRLLPLLAATFALHFTGRRMMEMYEENQKQMARGGSAKGGVLLLADLHATSCGLKALGSTIAAEGLEACRRACGGHGYSSYSGIGTWYADYLPTITWEGDNYMLTQQVARYLLKSARAVYANNAPDNDTSRILKNYISRRDMGAAFDILDNDADIVNAFAWRAAYLTFEALKHRDVAKRSWNSLLIDFWRLSTAHSQYLVVKNFYESVTAPATASALGSETAAVLHKLFRLHALYTLERESADFFTSGAVTIRQITLARTKAVVKLLDEIRPHAVRLVDAWKFPDWQLDSSLGRYDGKVYEDLFYRASEQNPVNNLTFDPSPVSNVLVRKNEKLSKL

SEQ ID NO: 209 - protein, 671 aa, Aedes aegypti
MPAQVVNKDLQNERNKCTFNQEEFTLWWVGGEEQLKEKRSRETYFESQPEFQDKVPLHFASHQELYEETIRKATVIFSKVKKLLTDQGKYDAKNYVHFMEALLGSGFIKEGNPLGIHFSMFVPAIMGHASPEQQEQYLGKALNCEIIGSYAQTELGHGTFLRGLETTATFDPQTDEFVINSPTLTSYKWWPGALAQTVNHCVVMAQLYSNGKCYGIHPFMVQVRDSETHMPMPGIDIGDIGDKMGYKGVNNGYLGLKNVRIPRSSMMMKNAKLMRDGTYVKPSSSVLAYGTMVFVRVIIVRNMAQSLAKAATIAVRYSSVRRQSHINPELPEVQVIDHVTQQAKLFPLVAKAIALKLTSDNLWQMYERTTSDLNSGSLDRLPELHAIACCLKVVSTSDTATGVEVCRLACGGHGYLTCANFLNYYSLASAASTYEGENTVLLLQTARFLVKMWNQAVQGKPLMPTVSYLQNYVGKQVQQFPWSDSVPVIISAFQAVVANKLRLACLRIEQRKSKGFTPEEATNFTGLELTQVAEVHGRWFVLQSAYEMFEKACQKATTPLISVMQNLCKLVVYDEALRIRGDLLRFTTMTETDLVKLEQNYEACLMVLRPNAVGIVDAFDYPDFVLGSALGAYDGNVYERLFAEAMKSPLNQEPVNKTFELYLKPLMKSRL

SEQ ID NO: 210 - protein, 669 aa, Aedes aegypti
MPSTKVNQDLHNEREKCSFKNEDFTLWWIGGEAKLKEKRSREKFFLSEPEFFDKVPLHFVSHKEVYEESVRKATVIFRKVKQMQEQGKDGVDNYMALLGGLLGSGILKEGNPLAVHFVMFLPALMGHGTPEQQAEWIGRAWNCEIIGTYAQTELGHGTFIRGLETTATYDERTKEIVLNSPSLSSYKWWPGGLGHTANYCVVIAQLYSQGKCHGIHPFIVQLRDEETHMPMPGITIGEIGNKLGMNGVNNGFLGFKNVRIPRANMLMKNAKLLEDGTFVKPPSSVLTYGTMMFVRVVIVRDMANYLSKAVTIATRYSCVRRQSVINPDQPEVQVIDHLTQQYKLFPAIAKSIIFKLTSDNLWDMYNQVTSELDKGDLERLPELHAIACCLKAVCTADAAQAVETCRLACGGHGYMTCSNLFGTYGMVTAACTYEGENTVLLLQTARYLLKVWTQAQKGQELVPTVQYLKKFLSSNQRQTWDDSVPGIIAALQTVAAGKLRLANEHIEQRKRAGRTPEEAVNLTSIELARTADAHCRAFLVQSGYEMIEKSCTSAPPELARALRDIYELYAYDEAMKAVGDLLRFTTISESDISRLQQKLEDALAAIRPNAVGIVDSFDIPDMVLGSALGAYDGNVYERLFEEAKKSPLNQEPVNKSFHLYLKPFMKSNL

SEQ ID NO: 211 - protein, 773 aa, Aedes aegypti
MYKNTVILAGVKRLITGIASNRDNFFRSIYSSDKVHRIYDRECNPLLLTAIRRSLCSSTVKRKQQPEKIDMTEFNTISRPSAHPELLANGTYFPDLPKSGPLTKYRQQSAIDWRKVKLAFNDEASLELQHSTWNFLQSHPLFARPSRPLSTDESRHLATKQMYALHDANLFGIDKLLERPDFVAFFNHVLMAYDPNFAVKHSLGFGMFSSVIQALDVGRLSHIIQQNQSGEILGAFGLTEISHGTNAKGMRTTATYDVKTKEYVLNTPDFEAAKCWIGNLGKTCTHLVCYAQLYTEDGRHHGLNAFVVPVRDPKTLNAYPGVIVGDLGEKSGLHGVDNGFVMFKKYRIPRDYLLAKTGDVNEEGQFVSPYKDENKRFGASLGALSGGRVGICGIANIYLTKAISIAIRYSASRKQFGADDNSEELPVLEYQSQQFRLFPHFANVFTIKMFNLWFAKVYGDVLLKMLMGERSGHVGMELHALSSAAKPVCTWAARDGIQECREACGGHGFLKLSTLGDLRNDNDPNCTYEGENNVLIQQASNWLLNVRARGFEAFEVVSPLGSAAFLKDSVKIQKSRANWRTPLQALDIQALLDALNWLVAFLLEETYAKTVLLKQKGKSSFEARNESQSFYARTLSIVYGERALIYAANKFLNNLEDGQEKVALQRLVSLCGANLVLKYSGIFYEGGYFSQTPKAMSLLQQGVLELLPLVKTDAIPLVDAIAPPDFVLNSPLGMSDGEVYKHMESAIMQAPGALERPQWWRDVVYRDYIKSKL

SEQ ID NO: 212 - protein, 640 aa, Rhodococcus equi
MATTADHLRSTLDGRWAEVREKARIDLSTDEFRPHYTPDIAQARAKTLEQMRVLATGGFVDRGFGVEIGSGADPGAAVTAIEMLAMSDLSLMVKAGVQWGLFGGAIENLGTEDHHAEFLRPMIDLELLGCFAMTETGHGSDVQSLETTATYDAATDEFVVHSPTPSSRKDYIGGAAEHARVAAVFAQLVVGDESHGVHCLLVPIRDADGNDLPGVTTSDCGLKGGLPGVDNGRIMFDHVRVPRTNLLNRYGSVDADGVYSSPIENENRRFFTMLGTLVRGRITVGGSAAAAARVALTIATRYALQRKQFSAPSGDDATPDPEVPIMDYLVHQQRLLPHIARAYALGFAQNELVAKMHDIQTADEVDSAEQRELESRAAGLKAANTWHATRAIQECREACGGAGYLAENRLTALKADTDVFTTFEGDNTVLTQLVAKELLTKYADEVRGMSPVEWMAFAASAFGDAVRSRTAAQQIIQTILDTRQDNEEDGSLFNRGTQLTMFEDREEYLLATAARRLQAARKREDDPFDAFNFVQDHVLHAARAHIDRVVLEAFIAGIDECEDEAARDLLSELCDLFALNVIDDDKAWFMEHRLLSVERAKAVRRGINERCRTLRPHAATLVDGLGVPDALAGAAMLDGQ

SEQ ID NO: 213 - protein, 640 aa, Rhodococcus equi; identical to SEQ ID NO: 212

SEQ ID NO: 214 - protein, 629 aa, Amycolatopsis mediterranei; identical to SEQ ID NO: 134

SEQ ID NO: 215 - protein, 402 aa, Streptococcus cristatus
MATKEEILRELYPEDLFHYADGLTLGEAEVLQETRRLIEKHLRPVINEYWEAPDFPFEEFYAVAKGAQIMNNPKLFEGREGNYKPSELYIAFLYLELGRFDASIATFFTVHGGLCYNTVLLGGDERQQKEFLPKLAAFDWQGCFALTEPLSGSDIAGGLATTAERVGDKWILNGEKRWIGGSDTADVVPVFARDVEDGKVKCFIVRKGAPGYHAEPIPHKTALRCVRNGHITMKNVEVPDSDRLVNINGFGDVARILTFTRADVAHIATAITCGSYVAALKYAKDRQQFKRPIAAFQIVQEKLARMQANAVAVLSYSARIAEMQEAGNELMLNSALAKMHNSLVMRETVALARETCGGNGITLETDVARFFADAEAIYTYEGSHEVNALIVGREITGIGAFV

SEQ ID NO: 216 - protein, 402 aa, Streptococcus cristatus; identical to SEQ ID NO: 215

SEQ ID NO: 217 - protein, 565 aa, Aspergillus niger
MQSSTVDLLSSDLFKHHYEDGPREAHLERTYLRARAFARFWQLTPDDVLQFTPKFRRAHTDGIILRDIAAQSAFSVHYNLVGGTIASLAPQRPDLQPLLRQIFNFDVVTTYMMTEAGHGCDARNLETIAVWQSDGSFILDTPTPAARKLMPPSAPLAAGIPRIALVLARLIVEGEDRGTRQFIVPVNDGRQMYRGIKAWGLPAPGAGRLLDFVLTAFDHVHLPSTAMLGDLARPSNMRDQYLTAIDRLSTGALIVSLWVIPFLKGAAFTVGRYSQRRTVQEGLQGERVPIISFRTQQLPIAHALAEVAVLAPFADWVIKQHKSHTIGPGLKHALSIILKVVFLQHGSESLKQLNERSGSRGMFPINGLAEMETYLRASASAEGEILVHSIRSATELLHGRFRIPDAKTPDSLLGRHEAGFIAEMKESLKSTKGHRTPEYNRLILPRCRPMLLAIGQRMAHEAAVDAGVDPNFLALYEAGAVRNDSSWYVEQLGLSRASQYDMECQACDSVMSQLDRHLDELGIEPYCTAPMLSPPKWENFIDTCPKYTGDAVPSLSIGDSREQKL

SEQ ID NO: 218 - protein, 693 aa, Coccidioides posadasii
MSPTPDWVKKLKPAGPQGTELLEQERAKSNVSVDKLAELIHTKETLQRQERLLAIMEKEPVFDKSQNHTLGRVERLKRSLGKAKRLQNLREQHGWSQDEFMMANDLLGEPTPYGLHASMFLVTLREQGTPEQHKLFLERAERYEIIGCYAQTELGHGSNVRGLETTATWDPTDKTFIIHSPTLTASKWWIGSLGRTANHAVVMAQLIIGGKSYGPHPFVVHIRDLETHEPLENIHVGDIGPKFGYNTMDNGFLLFNHVKIPHVNMLARFSRVDPDTGKYIRPALPSLVYGTLTWVRSTIVLQSGGVLARGVTIATRYCAVRRQFQDRDAPATETGENQVINYKMVQIRLLPLLAATFALHFTGRGMMALYQQNQSLMKATENGTKTRGAGPEQLNPGADLLADLHATSCGLKALGSTIAVEGLEACRRACGGHGYSSYSGIGPWYADYLPTATWEGDNYMLTQQVARYLLKSARSVIAGKPANNDTCRVLATYLSRRDTGAAFDILDSDKDIVDAFAWRTAYLTFEALKHRDVEKRSWNSLLVDFWRLSTAHSQYLVVKNFYEAVSSPATAAAVDPETMTVLHKLFRLHALHTLEREAAEFFTSGAVTTRQIVLTRTKAVMNLLEEVRPHAVRLVDSWKFPDWQLDSSLGRYDGKVYEDLFHRASELNPVNAMTFDPYPSHEVLVKNERPSKL

SEQ ID NO: 219 - protein, 650 aa, Coccidioides posadasii
MADKPDWSAALRPAPPDGATIIAQERARSSIPVDQLAGYLLTPDFLERQDRVLKVLLKEPVFKKTNQANLSRPDRYKLGLARGKKIRQLKEKLGWDEEDYHMAAYLCDDVLPYHLHTAMFITTVSQQGSDAQRARWVPRIERWEIIGAYAQTELGHGSNVRGIELEARWDPETREFILHSPHLTASKWWNGTMGRTATHAIAVAQLMLPVSGKGAETKYKSYGPHPFIVQIRDSRTHQPPESIIIGDIGPKYGYASMDNGYMLFNNHRVPHDAMLSRYSRVDPETGKYTKPGNPEVVYGSLTHVRATIVMEARLALARAVTVAVRYLSIRRQFRDKDSDNPSDPEMPVLDYSTVQVRIFPLLATAFALHYSGKAMGELYARTRKNIEENGDFETLAELHSTSSGLKSLATDLTAGGIEICRRAMGGHGFGASGLVQLNANYLSKPTVEGDNWTITQQVARYLIKKAKALSASAKSRAGARTEESLKRYLYARQKTLNLKVYEDDNAILEAFEWRTAHLVFKAYEQREIQKKSWNSLLIDFHKLSRAYSQSILILNFHQALQPNNPETARLDSTTRAVLRDLFLLFAFTTMDAEAREFCSSGAVSNDALDALSARILELMGRIRPHAVRLVDAWKIPDFLLDRYVATYQHV

SEQ ID NO: 220 - protein, 692 aa, Neosartorya fischeri
MPSPPPEWVKALTPSSPQGTDLLKQERAQSNVEVDKLAEFLHTKAFLEKQQRFLELLSSEKVFDKSQMHSQGRPERIQRALAKGKRLQQLKEKYNWSTEDYHFASEMIGEPTPYGLHASMFLVTLREQCTPEQKKLFLEPAEKYQIIGCYAQTELGHGSNVRGLETTATWNPEDKTFTIHSPSLTASKWWIGSLGRTANHAVVMAQLFIAGKNYGPHPFIVQIRDLETHQPLENIYVGDIGPKFGYNTMDNGFLLFNNFKIPHINMLARFSRVDKETNKYMRPASPSLVFGTMTWVRSNIVLQAGSVLARGVTIATRYCAVRRQFQDRDAKAGAGETQVLNYKMVQIRLLPLLAAMYALHFTGRGMMRLYEENQNKRAAAEAEQDKRGAAPEALRAGSDLLADLHATSCGLKALASTTAGEGLEICRRACGGHGYSSYSGIGPYYSDYLPTLTWEGDNYMLTQQVARYLLKSARAVLAGKGTGNDTSQILQAYLARRDKGASFDILEVDSDIVAAFAWRTAHLTFEALKHRDLEKRSWNSLLVDFWRLSTAHSQYLVVKNFYEAVSSPDLAAKLGPETTKIMHNLFRLYALHTLEREAAEFFSSGAVTVRQITLTRTNAVMKLLDEIRPHAVRLVDAWKIPDWQLDSSLGRYDGDVYPDLFNRASQNPVNDLVFDPYPWNEAVLKNAPKAKL

SEQ ID NO: 221 - protein, 692 aa, Aspergillus clavatus
MPSPPPDWVKALTPSSPQGTELLKQERAQSNVKVDQLGEFLHTKEFLEKQQRFIQLLSAEKVFDKKDMHSLSRPERIQRALAKGKRLQQMSEQYNWSAQDYHFASDMIGEPNPYGLHASMFLVTLREQCTPEQKKLFLEPAEKYQIIGCYAQTELGHGSNVRGLETTATWDPTDKTFVIHSPALTASKWWIGSLGRTANHAVVMAQLFIAGKNYGPHPFVVQIRDLKTHQPLENVYVGDIGPKFGYNTMDNGFLLFNKFKIPHVNMLARFSQVDKETNQYMRPASPSLVFGTMTWVRSNIVFQAGSVLARGVTIATRYCAVRRQFQDRDAAPGAGETQVINYKMVQIRLLPLLAAMYALHFTGRAMMGLYDENQNKRAAAEAGQDQRGAAPEALRAGSDLLADLHATSCGLKALASTTAGEGLEICRRACGGHGYSSFSGIGPFYADYLPTLTWEGDNYMLTQQVARYLLKSARAVLAGKGTGNDTSRILQAYLARRDKGASFDILEDDKDIVDAFAWRTAHLTFEALKHRDLEKRSWNSLLVDFWRLSTAHSQYLVVRNFYEAVSSPPLAASLGPETTQVMHSLFRLYALNTLEREAAEFFSSGAVTVRQITLTRTNAVMKLLDEIRPHAVALVDAWKIPDWTLDSSLGRYDGDVYPDLFKRASENPVNDLVFDPYPWNEAVLKNAVKSKL

SEQ ID NO: 222 - protein, 748 aa, Aspergillus clavatus
MATQPGGPPPRTALLGEQKATGAKKDYWVWVYNKACLRCNKEKLNSSARVRRLKMASNQQMTLMEQARQSATFDSRILTRVIHDGEANASSRRAAFRRVESALGLGDTMTLPHVYSGLDRKGLYLEGLRRGRAMVDDMMQYNHRHFENMTERYQVANSTPYGLSLLIFRMTIEFHGNAEQKQQWLPLIDQMTINGCYAQTELGHGSHLRGIETTASFDEDTGDFVIHSPTITAAKYWPGGLGLSCSHAVVAARLLIRGKDYGMHWFIVQIRSLDDFSPAEGVELGDVGLKMAYNGTCNGYARFSHVRVPRSSLLAAYAQVDRDGSYVQTLHGQSFQKELYAAMLEGRRIIIQYAAFGLAQPLTVATRYSVVRMQGMPMFSEPNAPEVPVVAYKSQHYRLLTLISQAYALIFVSKEFNEQFGQIQKERAQGNLARLPFIHALSTGLKAWGTSTVNAGAEEARKMCGGHGYMALSGLPEMVGAACATTTFEGENYLMWQQLVRYLFKQADAIQAGRAVDADVEECLRDFDSYLSHKKTFHLKNLATDQLCQTATLLAMFHHRFCRVHAAAYTEYGRRKRSMSAAEAWNRCLMRLLPVAHAYTEYMVLQAFQRRVAMLRESEPSVFPVLSRLSELFALTSIITPTQSYYTTSFTEDGLLSSTQFDPMRTRIDQILEELLPDIVSLTDAWDFTDASLSSALGCRDGNVYERLMSWTRQLPVNTENVAKDAWGVEGGIRDLLKRGSPPLKSML

SEQ ID NO: 223 - protein, 624 aa, Mycobacterium intracellulare
MRTTLTEDLFRPHYTPNTVIARTKVAEQMRIMAAFGAAADSFRKEHGGTGDVGAAITMIEMLAMSDLSLMVKAGVQWGLFGGAVENLGTERHHETYVPKIISLELRGCFAMTETGHGSDVQSLETTATYDAETQEFVIDSPTPSARKDYIGGAAETATMAAVFAQLITTEDGKPVNHGVHCVLVPIRDEDGNDLPGITTSDCEYKGGLPGVDNGRIVFDHVRVPRVNLLNKYGDVAPDGTYSSPIENPNRRFFTMLGTLVRGRITVGGSAGAAGRVALDIATRYALQRRQFSAPDDGSEVLIMDYLVHQRRLFPLIAKSYALQFAQNELVSKCHDVQSADAPDADEQRELEARAAGLKAANTWHASRAIQESREACGGAGYMAENRLIGLRGDTDVFTTFEGDNHVLTQLVAKELLTAYADDIKSMSPVEWVRFAANTVGERVIKRTAAEAIIQTIVDSRQDSEEEGSLFNRGTQIKMFEDREEYLLASVARRLQAKSKEMSEFDAFNSVQDHVLHAASAHIDRVVLEAFVAGIDGCANEEARELLGILCDLYALSVIEDDKAWYIEHRYLSTERAKAVTRGINDRCRALRPHAATLVDGFGVPEQLRYAEMLHPENLADAVTS

SEQ ID NO: 224 - protein, 640 aa, Rhodococcus equi; identical to SEQ ID NO: 190

SEQ ID NO: 225 - protein, 634 aa, Aeromicrobium marinum
MTLSDEVRIALDGKWRHIREQSRVDLAQMDLAFDHDLTMDEARERSFAQLKPLVATGIPAAGFRAENGGTGDPGLSVTGIEMLAQFDLSLMVKAGVQWGLFGGAVENLGTEQHHALIPDIINLDLIGCFAMSESGHGSDVQNLETTATYDPGTQEFVIHSPTVSSRKDYIGNAAKHATIAAVFAQLITRGESHGVHCFLVPLRDEKGNDLPGVTTSDDGHKGGLRGVDNGRLQFDQVRVPRENLLNRYGQVDEGGAYSSPIDATGARFFTMLGTLIRGRVSVGGSAGAAGEVALSIAGRYALKRRQFGPEPGTEILLADYRMHQRRLLPLIARSYAYRFAQNQLTARMHRLQTTEDPDPQEQRELEGRAAGLKAMNTWHASRAVQESREMCGGNGYLAENRLTTLRGDIDVFTTFEGDNHVLLQLVAKELLTAYAKEVGGLDPLGMVRFVASTFTDTVRERTAASQLIQRLIDARPGGDDEHDLLDRGTQLELFEDREQHVLETAARRLQRASKSDSAEAFMIFNNAQDHVIRAGRVHIDRIVLEAFTAGIARCEDEEAADLLRDVCSLYALSTVEEDLAWFMGHNRISDQRAKVVTSEINALLDKLRPHLLTLIEGFGVPEESLGAAMLHDLD

SEQ ID NO: 226 - protein, 660 aa, Rhodococcus erythropolis
MGSNRVARGALRAIVGSMATTADHLRTTLDGRWREVRERVRGELNDERFAPHYTPNTAIARSKALEQMRVLADLGYAANGFAVSHGGTGDAGGAVTSIEMLAMSDLSLMVKAGVQWGLFGGAIENLGTERHHQAYVKPLIDLDLLGCFAMTETGHGSDVQELETTATYDVETGEFVVNSPTPSSRKDYIGGAAQHATVAAVFAQLITGGESQGVHCFVVPIRDDAGNDLPGVTTSDCGLKGGLPGVDNGRIVFDQVRIPRENLLNRYADVAEDGTYSSAIENPNRRFFTMVGTLVRGRVTVGGSAAAAARVGLAIAGRYALQRRQFSAPKSDDEVLIMDYLVHQKRLLPLIARSYALQFAQNELVAAMHDIQSSDDPDPQEQRELEGRAAGLKAANTWHATRAIQEAREACGGAGYLAENRLTALKADTDVFTTFEGDNHVLTQLVAKELLTSYADEVRGMSPVDWMRFAATTVSDVVKKRTAAQQILQTIVDTRQDNEEDGSLFNRGTQMKMFEDREEYLLATAARRLQAAQKREENPFDAFNFVQDHVLKAAQAHIERVILEAFVAGIDSCEDETAQELFGEVCDLYALSVIEEDKAWFMEHRHLSVERSKAVTRGINERCRTLRPHVETLIDGFGIPDILLGSAMLDGPGTDAVRLK

SEQ ID NO: 227 - protein, 768 aa, Flavobacteria bacterium; identical to SEQ ID NO: 191

SEQ ID NO: 228 - protein, 715 aa, Corynebacterium urealyticum; identical to SEQ ID NO: 178

SEQ ID NO: 229 - protein, 634 aa, Aeromicrobium marinum; identical to SEQ ID NO: 225

SEQ ID NO: 230 - protein, 699 aa, Glomerella graminicola
MPTTPDWVKALQPSGPQGTELLAQERAKSNLNVDQLATFMFTDEALRRNERILNILKNDPVFDKTQNYFRGREARIETALARGKRLFQLNKEHQWSQDEYMAANDLIAEATPYGMHASMFLVTLREQGTPEQHELFLKPALDYEIIGCYAQTELGHGSNVRGLETTATWDPSDKTFVLHSPHLTASKWWIGSLGKAATHAVVMAQLVLNGKNIGPHPFVVPIRDMKTHEPLPNVHVGDIGPKFGFNTMDNGFLLLNNVKVPHNHMLARFSSVDPNTSKYSRPANPSLIYGTLTWVRSNIVLQSGSVLAKGVTIATRYCAVRRQFQDRDAPANEPGENQVLNYTMVQIRLLPLLAATFALHFTGRGMISLYNENQKRMSALAGKVGDGNRNPGPEELNPGTDLLADLHATSCALKAYGSTVAGEGLEICRRACGGHGYSSFSGIGSWYADYLPTLTWEGDNYMLTQQVSRYLLKSARSVLKGNYGNNDTTRILSEFLRRRDIGAAFDVLDSDEDLVAAFAWRVSFLTFEALRHRDEDKQSWNSLLVDFWRLSTAHAQYMVVKNFYEALNDKATTEQLDKDTVGLLHKLFRLYALNTLEQEASEFYSSAAVTVRQITLARTKAVMTLLEEIRPHAVRLVDAWKFDDWVLDSSLGRYDGKVYEDMFKRASEDNPLNSVVFDPNPNSKVLFKKDERKNLRSKL

SEQ ID NO: 231 - protein, 652 aa, Streptomyces clavuligerus; identical to SEQ ID NO: 128

SEQ ID NO: 232 - protein, 629 aa, Amycolatopsis mediterranei; identical to SEQ ID NO: 134

SEQ ID NO: 233 - protein, 677 aa, Coprinopsis cinerea
MAKPYDVNEQTGKDMTAARAATTIAVEEVRNYLYNGAEEFQTRHNIVEVLQNDPVFDKSQRDFMSRTERYTRGMALTNRIYELQEKLGWNQQQTSTATAILDEQLPIALHNIAFQPVFNLQGSPELVKKYGRLIATRGIFGCYLQTELGHGTNVSRLETTATYIPETREFEINSPTVTSSKWWIGALGKTATHGVVQAKLIIEGKDYGPHLFFVQLRSMEDHKPLPGIIIGDIGPKSGGGFAPTDNGFARFDHVRIPKEHMLSKFAQVTDDGKYIQPPHAKLSYGGMLYIRANMVTGGGWLMAKAATVAIRYGTVRRQGAVGPDGLEQAVISYPSTYYRLLPILSHAYVFIQLGKQLTKAFDTMAGRLAKGDTSLLAEMHATTSGLKVLVSSTGVQDIEVARRSMGGHGYSAFSGLGRIYNDYLPSVTYEGDNFALDQQVVRAALKSLKGLSSSTNLSPSSYYLRLLIPPVSVPNFKLTPDQWLDPANPVLLLEWRAALVVQEMARNLKEPDASVNQRVSKAVTEAFVARQVGDMINEAQTKLGNKRQKEALVLGQVFLLYLLTTLEAGITDVLSFGLLSSTTGSDATRSLRLAIQRVCQALLPEAIGLTDAFGFTDWELDSALGVYDGKVYEALWKRAQQEPLNQMEVPEAYEKSIKPILQRGQRQAGVKVDRAKL

SEQ ID NO: 234 - protein, 677 aa, Coprinopsis cinerea; identical to SEQ ID NO: 233

SEQ ID NO: 235 - protein, 626 aa, Trifolium repens
MQTLKSNNESNSEAERRIERLSLHLNPILNLTWNHHPLEMENCSRGKKLIVDANSLTGYMRGKYRDIQEKVFDYFNANPQLQTPLEISKDNHRELCMNQLLGLVREAGIRPLHYVVHDPAKYFAILEAVGSVDMSLGIKMGVQYSLWGGSVINLGTQKHKDKYYDGMDNLDFPGCFAMTELHHGSNVQGLQTVATFDPITDEFIVDTPNDGAIKWWIGNAAVHGKFATVFARLKLPNYDAKGISDMGVHAFIVPIRDMKTHQTLPGIEIHDCGHKVGLNGVDNGALRFRSVRIPRDNLLNRFGDVSRDGQYTSTLPSVNKRFGATLGELVGGRVGLAYSSVSVLKVAATIAIRYSLIRQQFGPPNQPEVTILDYQSHQHKLMPMLASTYAFHFATTNLVEKYAQMKKSHDEELVADVHALSAGLKAYVTSYTAKSLSICREACGGHGYAAVNRFGSLRNDHDIFQTFEGDNTVLLQQYRTSRLLHSVAVRLQKHSKPLGQFGAWNRCLNHLLTLAESHIESVILAKFIEAVQSCPDPSAQAALKLVCDLYALDRIWNDIGTYRNVDYVAPNKAKAIHKLSEYLSFQVRNIAKELVDAFDLPDHVTRAPIAKQSGAYSQYTQYVGFE

SEQ ID NO: 236 - protein, 705 aa, Glossina morsitans
MPCWLDFVNFLIKEQVHIYTQYIYIYVDFLYPLSNIMSTINPDLQQERNGATFNPYELTIWWDGGTEKYEKRKALEKLFLEDPELKDDLPLSYMSHREIYENSVRKAVLIAKKLRDLRDIGELSVDTYTALLGGTLGCALLKEGNPLSVHFVMFLPTILGQGTIKQQIEWLSKAWELNIIGTYAQTELGHGTFLRGLETRADYDEKAQEFVLNSPTLTAYKWWPGGLGHTANYAVVVAQLYTLRKFRSLAPFIVQIRDEETHMPMPGIDIGEIGPKLGMKSGNNGYLGFKNVRVPLDHMLMKNQQVLSDGTYIPPKNSALTYGTMMFVRVVLIRDASFALAKASTIAVRYSAVRRQSPIDPNRPEPQIMDHITQQLKVFPQVAKAVVFKATGDIVYDMYAHVSQEIEKGALERLPEMHALSCCLKAVCSADAASGVEVCRLACGGHGYMDCSNFPTLYGMSTAVCTYEGENTVMLLQTARYLVKAYGQAAINPHVQLVPTVAYIKKIINEPKFVGFSGSSEAIVEAFQYVAANKIRIAYERLEQQMREGAIPEVATNRCGIEMIQAAELHGRAFLALTALTELQALSQKVSPALSEIFQLLLELYLVDACLQKIGDFLRFITLTEQDVNGLELHLQECLKRLRPNVVTLVDGFDLHDRILDSALGAYDGNVYEKIFAAAKKSPLNKEAVNASFHKYLKPLMKSNL

SEQ ID NO: 237 - protein, 688 aa, Leifsonia xyli; identical to SEQ ID NO: 170

SEQ ID NO: 238 - protein, 629 aa, Dictyostelium discoideum
MYKNRIEIIKKHLEVNNSQTTNNKDEVLEKELFNSIDTNINVGELKLLIDSVEESKYKDETREFIRNHPKFKENFIGLDMATYRQLVLEQCAAIANRGLIHFTDIKNNLHRYIGALEMFALYNNNILTKLSVQYTLFGGPIIFLGTSRHEKYIEDANTLKTMGCFAMTEIGHGSNVRGIETTAHYDKQTKEFIIHSPTPTSEKFWIGCAYLHATYAVVFANLIIDGTNYGIHAFIVPLRCPKSGAIMKGITIKDCGHKLGLNGIDNGQIRFDQVRIPRENLLNKYSDVSEDGVYKSQFNTPIKNFAATMSPFIVGRMAITKGCSGAAKTSLSIAIEFSHIRKQFGPSSNKELPLITLSSQQRRLMAPLARTILFDLYIQRLTNELCQEKLPASIHAHCSGIKAVYSWFCVAALQTCREACGGQGYRSANRIAEFKNDCDIICTYEGDNTVLMQQLAKYLLGVKQKQTNTTTNRIYLDGEDAKSLFFNFSNINQLFETREEMRLAELKQIIDNSKESAYFAFNNAIPWAVKLGFAHMTKIVFQNSINTLKLKNVKPLTHLIMLDALVSIEEDLGWFVSNHLISPNVAQSIPFLIQDLCFEVTKVSKQIIASFDIPENCKPSSKDLISDLF

SEQ ID NO: 239 - protein, 628 aa, Dictyostelium discoideum
MYKNRIEIIKKHLDVNSQTTNNKNEVLEKELFNSIDANINVGELKLLIDSVEASKYKDAAREFIRNHPKFKENFIGLDMATYRQLVLEQCVAVANSGLIHLTDIKNNLHRYAGVVEMFSLYNNNVCTKLGVHYTLFGGTIMFLGTSRHEKYIEDANTLKTMGCFAMTEIGHGSNVRGIETTAHYDKQTKEFIIHSPTPTSEKFWIGGSYLHATYTTVFANLIIDGTNYGVHALVVPLRCPKSGAIMKGITIKDCGHKLGLNGIDNGQIRFDQVRIPRENLLNKYSDVSEDGVYKSQFNTPIKNFAATMAPFIVGRMAITKGCSGAAKTSLSIAIEFSHIRKQFGPSANNELPLITLSSQQRRLMAPLARTILFDLYIQRLTNELCQEKLPASIHAHCSGIKAVYSWFCVAALQTCREACGGQGYRSANRIAEFKNDCDIVCTYEGDNTVLMQQLAKYLLGVKQKQTNTTTNRIYLDGEDAKSLLFNFSNINQLFETREEIRLAELKQIISNSKEPAYFAFNNAIPWAVKLGFAHMTKIVFQNSINTLKLKNVKPLAHLIMLDALVSIEEDLGWFVSNHLISPNVAQSIPFLIQDLCFEVTKVSKQIIASFDIPENCKPSSKDLISDLF

SEQ ID NO: 240 - protein, 643 aa, Polysphondylium pallidum
MTQNFKPSIDINVLYRIRNGPLKDYQSDIDEFQKLIADNRIKYNEMFDVDMKTQKRLTNDTVKEICKLGKMQVQLLKDDPKKMLAYLYALFAQIEFSAIAKIVIHFQLFGGTILEVGTDYHHQKYFNDINNFNIVGGFAMTEMGHGSNVRQIETTSTYDLTTKEFVINSPSLSSTKFWIGNVSMFGTHVVLFTKLIFQGQDKGVHVIIVPLRDPVTMEVYKGIQLGDCGHKVGWNGIDNAWIRFTNYRVPRENLLNRFATITEDGQYLTNISSPNKLFQITISQLVFGRLLYIFGPTIFLAIGLKTAIRYAFSRRQFGEKGKPEELIIDYPTHNRVLLPMLATNMVFEFSRNWIIDNLQESSRSDEKREEYHSIVSGVKAMVCEFTIQSVSKLRVFCGGNGVSSYNYFGAMRNDLDVFQTAEGDGAVLYQQLSKFLLSEYKKWYKKQGMTGYIMKEVQTFLTTSNPIHTHYRSMPYLLSNEFHHHAFLFRFEKTRSIVIDHLNQCKGKGLSFLQSWNASLIQVVDLAKTYTHLFILENAQRTIQKVTDPITRHVLNDIVRLYALYNIEQDVGFYRNWNYLSSGKALAISEAVGELCNTLKPYALSILDSHKFHEDSLNIPLAKKDLDYVKHMADRVGIPYSSL

SEQ ID NO: 241 - protein, 700 aa, Polysphondylium pallidum
MSNTLTNNPSAASSIEKPFGSVGIKAVEQNIMMNQFPMDRISGSLLSSSGKTKGTNTTLSDKLYAWSTINTEHQELRRTALDLFTDKSVFQPSSTETKERQRVIVLNQLQYFLSKTFGKGLINISDLRNDPSKICALMDCASQFDDNSFMTKMVVNNFLFGAAVFNLGTEKHHRLLPDIQSGKLLGCFAMTELGHGSNVRSLETTATYIPETNEFVIQTPKRTATKWWIGNAGHAVMASVFARLIVNGEDQEVHCFLVPIRQPNGVDLMPGVRIGDCGPKFGMNGVDNGWIQFESVRIPYDNLYDKYGSIVNGVYQSPIANPSRRFANILAQMITGRISISYGCARTLKVALTIAVRYSNKRVQFGATPTAPETPIIEYPTHYTVLMPMIATVYAFDAIKSYLCKRFCERSDEGEIHVLASGLKATISHYVTTSILELRRLCGGHGYSSYSRFSSLIASNDVARTFEGDNTLLYQQVAKDLLIQFKKEYSSNKFTGTLKYLGKNTSLLLSEHTYTTYRSDKDHLLNLQFLRSCMEYRSSKLLIDSANTVSKAYKVSKDAFDSWNQSLETLIHLAKSHTEMMIVSKFIDSVKNVQDKETRETLKKLCQLYALKCIREDMEFFRNTNYLKKNKAKAISKLISSLCHDLSKQSLELVAGYGNEEALIESPLGQLDGDLYENICAKVGLFSKDNYPQHILDAKL

SEQ ID NO: 242 - protein, 657 aa, Polysphondylium pallidum
MNMFLNSMESKEISTFRRISNTLQHLSTYHLSLPVEDGTENEHPLRSPDIDMLKHLLDGDFKRDRTQIRQLIQNSKSFEEIHLIESISPEVHRERTIQAVREVIDLSIVSVTDMKDNPEKFLSWFETVSICDLSVVLKFAVQYNLWGGTVLFLGTKKHHDKYLNDISNGKLLGVFGLTELGHGSNVQGLETTSTYDNATGEFIINSPTWTSQKYWPGNISAHGQMATVFARLIVDGTDHGVHAFIVPIRSAPSPGKPYGEVLPGVEIRDITQKSAYNGIDNGGLLFRNVRIPKDNMLDRFSCVNERGQYQSTVPPNRHFAAMMSVFFIGRLCISSISLTAMKSGLVVALSYSHNRKQFGPPKQPEQPIINYSTHQRRLIPWIARCYTLDFTHKYVVKSSKSMDVLHSYSSGLKAVTSWDSLVALQNARECMGGQGMRLKSRITVLRAHSDMCTTGEGDNIVLCQQVAKFLLFKYNNSINEGGSFTGELEYVNNIHRPTTENWRSLSYQQWLLEKREFALIKELHKKMYTSNPSIKPNSEEWYHLWDKCLNLAIQLTKANVDRLVHSIFLQKIISITKESNASTLQMLKKLCCLDGLVQIQRDLGFFCSTGIISGHDKWVKLDDEINALCKEITPFSRELVEPFGIPPRFHPYQNSLE

SEQ ID NO: 243 - protein, 690 aa, Polysphondylium pallidum
MSQQQQQQVVVHPDLLKERSKTSFDVPTLNRFINNNDPTVIDLKKKIRTEFLADPILSDHPEYVNFLSREDQFKRAVEISERVIKIKRKLGIIDSTGIEFYRELYQEIPLILHDVVFVGCMRSLASEEQLAEWLPKALNYQIIGAYAQTELGHGSNVQALETTAHYLAESDEFVLNSPTLTSSKWWIGALGRICTHAVVFAQLHLKDKDGKLVNHGPHPFLVQVRSHEQHQPMSGITVGDIGPKLGYSTVDNGFMRLDHVKIPRKNLFARYAQVTKEGRYVPPPHPRLVYAGMVGVRVYLVGDSFSAICRAVTVAARYSVIRRQFGPSGKEETQVLDYQNQQARIVPSIAAAYAFLFVGRRLSDMFSNVMYAAKSRKDTTDLPELHALSSGLKTTITYITSKCIEDARFSCGGHGYNQASGLVRLYNNYLHLVTAEGENNILPQQTARFLLKEYKSVMVDGKTKLGETTQYLVDEQNAPNTLTALLAATGKQWSDPAILVRVFAHRSAFLIARLARLIQEGLGSGRTMQDVWNSLNVDCIRVSEAHSQLYILNSFATQLSLVPLDARPVLVRLCQLYALNNIERNSGEFLIDQFISQDQIEEISKFILNLYAQLRPDIIGLVDTFDVADHTLGSSLGRYDGQVYPALWEWANKHPLNTSDVGLSQFFKNINNNNNNSVPTSKLKSNHHFA

SEQ ID NO: 244 - protein, 670 aa, Culex quinquefasciatus
MPATEVNKDLQNERKKCTFKNEEFTVWWVGGEAKLKEKRFREKFFLGEPEFFDKVPLHFVSHKEVYEESVRKATVIFRKVKQMQEQGKDGVDNYMALLGGLLGSGIIKEGNPLGVHFVMFLPALMGHGTPEQQAEWIGKAWNCEIIGTYAQTELGHGTFIRGLETTATYDEKTKEFVLNSPSLTAYKWWPGGLGHTANYCVVIAQLYSKGKCHGIHPFIVQLRDEDTHMPLPGISIGEIGNKLGMNGVNNGFLGFEQVRIPRTNMLMKNAKLLEDGTFVKPPSSVLTYGTMMFVRVVIVRDMANYLSKAVTIATRYSCVRRQSVINPDQPEVQVIDHVTQQYKLFPAIAKSIIFKLTSDNLWDMYNQVTSELDKGDLERLPELHAIACCLKAVCTADAAQAVETCRLACGGHGYMTCSNLFGTYGMVTAACTYEGENTVLLLQTARYLLKVWTQAMKGQELVPTVQYLKSFISNKNQRQAWDDSVPGIIRGLQTVAAGKLRLAYEHIEQRKRSGYTQEEAVNLTSIELSRAADAHCRAFLVQSGYEMIEKSCTTLSPELGRVIRDIYELYAYDEAVKAVGDLLRFTTLSESDVTRLQQKLEDSLAAIRPNAVGIVDSFDIPDMVLGSALGAYDGNVYERLFEEAKKSPLNQEPVNKSFHMYLKPFMKSNL

SEQ ID NO: 245 - protein, 841 aa, Culex quinquefasciatus
MPEEDKPSPIPDLPRGPLCEYRQRAKFSWKALKQVLEDPNVIRIKYDVWQKLEREPLFAPLTNTLPVDQQKERAAKQVKRIAELKLDPQEIYSMDYKYRVRYLMSINEALHAVCPSMSVKIALGVGLFTNALLAMGSERHSAIYNAAWNREIITCLAITEVSHGSNTKRCRTTATYDPKTQEFIINTPDFEAAKCWVGNLGKTGSMALLFAILHTSDGQNHGLQGFLVPIRDPTTLQPYPGVIVGDIGEKIGLNGIDNGFVMFNNYRIPRENMLNRAGDVTPEGTYESTFTEPGKILGAVLESFSAGRLGIMQESSNTLSHATVIAVRYAALRKQFGPEKDGPEQSVMEYQLHQWRIFPYLAAACVLKASVFSLTDIYLATVQKSQKDSNGFELLSQIVSELHALVSSSKPLVTWTARDAIQESREACGGHGYLRAANLGELRNNHDPSCTYEGDNNVLGQQASNWLLRQWKAAKVESPVGTANFIERREAILGSSFDAIVRASGGAVESAESPEICSGCRDTLHRRPCSHHVTEGMERREINKHAPSVEPSLEKQAIYNSQRTTKGTPYRNSRQQTWYPTIYGKRHMTLKWPDDEHHPHLLQSFLIDAVDGKAIQNTPNAVLDLMWLELELDTQVVEVEFPMFLENNFRRTSTSSAVIITNCYEWLMCWLLHSTTEQLQHADKDGTDRFKARNDSQVYRARDLSRAYSEYYALECFRKRCLREDIAENLKPVLSNVYLIYGMWCIDRHLATFYAGGFAVGPRFADAIRSALLGACGQLKDSAVAVADAIAPPDWVLNSVIAKSDGRLYENIQNVMMTNPGAMERASWWKDIVPSKMKAKL

SEQ ID NO: 246 - protein, 673 aa, Culex quinquefasciatus
MPSTTSVVNKDLLDERSKCTFDREEFSVWWVGGKDRLDEKRNREHFCMNQPEFGDKIPLHYLSHKELYEETIRKATTIFAKSKEMVQKKHGYNAGNFVKFLDVLTGDGFMHQANPLAVHFSMFVPGIMGHGNAEQQERWLDRALNCKILGTYVQTELGHGTFLRGLETTATFDEETDEIVINSPRLSAYKWWPGGLGLTANHCIVMAQLYSKGRCHGVNPFMVQIRDEETHMPLAGIEIGEIGNKLGYNGVNNGFLGFKNFRIPRSNMLMKNAKLLRDGTYQKPISSVLNYGTMVFTRVLIVLDTSQMLARAATIAVRYSCVRRQSVIDPNKPEVQVIDHQTQQGKLLPQLAKAIALKLSADNLWKMYEATQVDLETGNTDRLPELHAVSCCLKAVSTGDAAAGVEVCRLACGGHGYLSSTNFLNLYGSATAAVTYEGENTVLYLQTARYLVKVWNQALKGQQLMPTVRYLEQYATKPVKRFAWSDSTPVIIEAFQAVTANRLRLANEHIQQRVKAGRTPQEATNETGLELVRLAEIHCRGFILQSAYAAIEQACQTASQPLGEVLREICRLVVYDEALRITGDLLMFTTMSDPDLVELQRKYEVSLGAIRPNAVSIVDAFDYPDFILGSTLGAYDGNVYERLFEDAMKSPLNQEPVNRTFELYLKPLMRGKL

SEQ ID NO: 247 - protein, 671 aa, Culex quinquefasciatus
MPSGSAVNKDLLDERSKCTFDKNEFTLWWVGGKEKLDAKRDREHFCMNQPEFRDSVPLHFASHQEVYEETVRKATAIFSKTRELLKKQGYDANNFVNFMEIMLGDGFIREVNPLRIHFSMFIPSIKAHGSAEQQDRWLQKAVNCEIIGSYAQTELGHGTFLRGLETTATFDEETDEIVINSPRLSSYKWWPGALGHTVNHCIVMAKLYSKGRYHGVNPFMVQIRDEETHMPLSGLEIGEIGHKVGFNGVNNGFLGFKNFRIPRSNMLMKNAKLLRDGTYQKPISSVLNYGTMVFVRVIITRNMAQLLAKAATIAVRYSCVRRQSVIDPNKPEVQVIDHQTQQVKLLPQIAKAIALKLTADNLWEMYEATQVDLETGNTGRLPELHAMACCLKAVSSADTAAGVEVCRLSCGGHGYLTSANFLSMYGLATAAVTYEGENTVLYLQTARYLVKVWNQALKGQQLMPTVRYLEQHATKPVKRFAWSDSTPVIIAAFQAVTANRLRLANEHIQQRVKAGRTPQEATNEAGLELVRLAEIHCRGFILQSAYAAIEQACQTASQPLGEVLREICRLVVYDEALRITGDLLRFTTMSDPDLVELQRKYEASLGAIRPNAVSIVDAFDYPDFILGSTLGAYDGNVYERLFEDAMKSPLNQEPVNRTFELYLKPFMRGKL

SEQ ID NO: 248 - protein, 682 aa, Ajellomyces dermatitidis; identical to SEQ ID NO: 173

SEQ ID NO: 249 - protein, 880 aa, Ajellomyces dermatitidis
MPMPAWSGLASLSDLMASEFKVQGNSAVCRSPSSGVLRVLGRDVRADSARHFGSYFIQIRKLTLLLPKPRAVLPNNIPTTFRITAEGETGAVRIAAGEISAHGEPYHCTIRSRAAPDGTLALARVQGGYQDLARHRSPLQSGWGAVTDLRNKKKKEKSQRSSSHAFPQGKGFLDKYHRRISCRGRGSSERLCEDCNNLADSAMCRRPKMWGKQTVTERVTSAPAQGEAARNNIGLPPTFLQPETSAVVNNYALSANSQSSMINGIIGHTMTDKDDFSAALNPAAPDGATILANERARSSIPVEKFSRYLLTSKYIEQQNRILKANLARPDLYKLALARAKRIRQLKDKVGWDDDEYQMAATLCDDVLPYYLHTAIFIATVLQQGSAAQKVYWMPKLEAWEVIGAYAQTELGHGSNVRGLELEARWDPRTKEFVLHSPHLTASKWWNGTMGRTANYVIAVAQLLLPVSGSGAETKVDPETGEYTKPKNPEVVYGSLTHVRAKLVMEARLALARAVTVAVRYLSIRRQFKDKDALQDTAPEINVLDYPTVQFRILPLLATTFALHYSGKAMGKLYERTRIDIERSGDFAALAELHSTSSGLKSLCTDISANGIETCRRAMGGHGFGGGSGLVQLNNNYLTKPTVEGDNYMITQQVARYLIKKVRELVERPNSQATTRTEESLRRFLASKDTKLYLSVLTSDEDIVEAFEWRAAYLSFKAYEKREIQKQTWNSLLIDFYRLSRAHSQSILVIKFYNAINNDSNNIPSAQTRSTLRDLFRLFALSTMETEAREFYSCGAISNEHLDAVTPRVFDLMQRIRPHVVSLVDAWIFCCTGRSDDKVYEELFELAHRQNPLNEIIFNPDYRTDELVLGSGDAGQILSKL

SEQ ID NO: 250 - protein, 672 aa, Corynebacterium jeikeium; identical to SEQ ID NO: 201

SEQ ID NO: 251 - protein, 629 aa, Dictyostelium discoideum; identical to SEQ ID NO: 238

SEQ ID NO: 252 - protein, 628 aa, Dictyostelium discoideum; identical to SEQ ID NO: 239

SEQ ID NO: 253 - protein, 687 aa, Dictyostelium discoideum; identical to SEQ ID NO: 171

SEQ ID NO: 254 - protein, 700 aa, Dictyostelium discoideum; identical to SEQ ID NO: 172

SEQ ID NO: 255 - protein, 683 aa, Ajellomyces capsulatus; identical to SEQ ID NO: 208

SEQ ID NO: 256 - protein, 682 aa, Ajellomyces dermatitidis; identical to SEQ ID NO: 173

SEQ ID NO: 257 - protein, 566 aa, Ajellomyces dermatitidis
MTDKDDFSAALNPAAPDGATILANERARSSIPVEKFSRYLLTSKYIEQQNRILKANLARPDLYKLALARAKWIRQLKDKVGWNDDEYQMAATLCDDVLPYYLHTAIFIATVLQQGSAAQKVYWMPKLEAWEVIGAYAQTELGHGSNVRGLELEARWDPRTKEFVLHSPHLTASKWWNGTMGRTANYVIAVAQLLLPVSGSGAETKVDPETGEYTKPKNPEVVYGSLTHVRAKLVMEARLALARAVTVAVRYLSIRRQFKDKDALQDTAPEINVLDYPTVQFRILPLLATTFPLHYSGKAMGKLYERTRTDIERSGDFAALAELYSTSSGLKSLCTDISANSIETFEGDNYMITQQVARYLIKKVRELESLRRFLASKDTKLYLSVLTSDEDIVEAFEWRAAYLSFKAYEKREIQKQTWNSLLIDFYRLSRAHSQSILVIKFYNAINNDSNNIPSAQTRSTLRDLFRLFALSTMETEAREFYSCGAISNEHLDAVTPRVFDLMQRIRPHVVSLVDATLGRSDDKVYEELFELAHRQNPLNEIIFNPDYRTDELVLGSGDAGQILSKL

SEQ ID NO: 258 - protein, 682 aa, Ajellomyces dermatitidis; identical to SEQ ID NO: 173

SEQ ID NO: 259 - protein, 880 aa, Ajellomyces dermatitidis; identical to SEQ ID NO: 249

SEQ ID NO: 260 - protein, 660 aa, Rhodococcus erythropolis; identical to SEQ ID NO: 226

SEQ ID NO: 261 - protein, 449 aa, Sphingobacterium spiritivorum; identical to SEQ ID NO: 198

SEQ ID NO: 262 - protein, 695 aa, Corynebacterium striatum; identical to SEQ ID NO: 199

SEQ ID NO: 263 - protein, 686 aa, Ajellomyces capsulatus
MPPVPEWVKALKPTSPQGSELLQQERDSSNVSVDKLAELIHTKDVLDRQQKILAIMEKEKVFDKSQILSMGRVERLTASLGKAKRIQHLRKQHNWTDDEFIMANDLLSEPTPYALHASMFLVTLRNQSTPEQAKLFLEPAERYEIIGCYAQTELGHGSNVQGLETTATWDPTDRTFVMHSPSLTASKWWIGSLGKTANHAVVMAQLIIEDKSYGPHPFVVQIRDMKTHEALEGVYVGDIGPKFGYNTMDNGFLLLNHVKIPHVNMLARFSHVDPATNKYVRSAAATLVYGTMTWVRSTIVLQSGKVLARGVTIATRYCSIRRQFQDRDTADKSSDENQVINYKMVQIRLLPLLAATFALHFTGRRMMEMYEENQKQMARGGSAKGGVLLLADLHATSCGLKALGSTIAAEGLEACRRACGGHGYSSYSGIGTWYADYLPTVTWEGDNYMLTQQVARYLLKSARAVYSNNAPDNDTSRILKNYISRRDMGAAFDILDNDADIVNAFAWRAAYLTFEALKHRDVAKRSWNSLLIDFWRLSTAHSQYLVVKNFYESVTAPATASALDSETTAVLHKLFRLHALYTLERESADFFTSGAVTIRQITLARTKAVVKLLDEIRPHAVRLVDAWKFPDWQLDSSLGRYDGKVYEDLFYRASEQNPVNNLTFDPSPSCTISDGDSPYPVYVWLH

SEQ ID NO: 264 - protein, 773 aa, Aedes aegypti; identical to SEQ ID NO: 211

SEQ ID NO: 265 - protein, 669 aa, Aedes aegypti; identical to SEQ ID NO: 210

SEQ ID NO: 266 - protein, 671 aa, Aedes aegypti; identical to SEQ ID NO: 209

SEQ ID NO: 267 - protein, 652 aa, Streptomyces clavuligerus; identical to SEQ ID NO: 128

SEQ ID NO: 268 - protein, 841 aa, Culex quinquefasciatus; identical to SEQ ID NO: 245

SEQ ID NO: 269 - protein, 673 aa, Culex quinquefasciatus; identical to SEQ ID NO: 246

SEQ ID NO: 270 - protein, 671 aa, Culex quinquefasciatus; identical to SEQ ID NO: 247

SEQ ID NO: 271 - protein, 670 aa, Culex quinquefasciatus; identical to SEQ ID NO: 244

SEQ ID NO: 272 - protein, 692 aa, Neosartorya fischeri; identical to SEQ ID NO: 220

SEQ ID NO: 273 - protein, 692 aa, Aspergillus clavatus; identical to SEQ ID NO: 221

SEQ ID NO: 274 - protein, 748 aa, Aspergillus clavatus; identical to SEQ ID NO: 222

SEQ ID NO: 275 - protein, 657 aa, Actinoplanes sp.; identical to SEQ ID NO: 132

SEQ ID NO: 276 - protein, 624 aa, Mycobacterium sp.
MRTTLTEDLFRPHYTPNTVIARTKVAEQMRIMAAFGAAADSFRKEHGGTGDVGAAITMIEMLAMSDLSLMVKAGVQWGLFGGAVENLGTERHHETYVPKIISLELRGCFAMTETGHGSDVQSLETTATYDAETQEFVIDSPTPSARKDYIGGAAETATMAAVFAQLITTEDGKPVNHGVHCVLVPIRDEDGNDLPGITTSDCEYKGGLPGVDNGRIVFDHVRVPRVNLLNKYGDVAPDGTYSSPIENPNRRFFTMLGTLVRGRITVGGSAGAAGRVALDIATRYALQRRQFSAPDDGSEVLIMDYLVHQRRLFPLIAKSYALQFAQNELVSKCHDIQTSDEPDADEQRELEARAAGLKAANTWHASRAIQESREACGGAGYMAENRLIGLRGDTDVFTTFEGDNHVLTQLVAKELLTAYADDIKSMSPVEWVRFAANTVGERVIKRTAAEAIIQTIVDSRQDSEEEGSLFNRGTQIKMFEDREEYLLASVARRLQAKSKEMSEFDAFNSVQDHVLHAASAHIDRVVLEAFVAGIDGCANEEARELLGILCDLYALSVIEDDKAWYIEHRYLSTERAKAVTRGINDRCRALRPHAATLVDGFGVPEQLRYAEMLHPENLADAVTS

SEQ ID NO: 277 - protein, 650 aa, Mycobacterium intracellulare
MAPQKTSTAEHLRNALDGRWRDVRNRMRTTLTEDLFRPHYTPNTVIARTKVAEQMRIMAAFGAAADSFRKEHGGTGDVGAAITMIEMLAMSDLSLMVKAGVQWGLFGGAVENLGTERHHETYVPKIISLELRGCFAMTETGHGSDVQSLETTATYDAETQEFVIDSPTPSARKDYIGGAAETATMAAVFAQLITTEDGKPVNHGVHCVLVPIRDEDGNDLPGITTSDCEYKGGLPGVDNGRIVFDHVRVPRVNLLNKYGDVAPDGTYSSPIENPNRRFFTMLGTLVRGRITVGGSAGAAGRVALDIATRYALQRRQFSAPDDGSEVLIMDYLVHQRRLFPLIAKSYALQFAQNELVSKCHDVQSADAPDADEQRELEARAAGLKAANTWHASRAIQESREACGGAGYMAENRLIGLRGDTDVFTTFEGDNHVLTQLVAKELLTAYADDIKSMSPVEWVRFAANTVGERVIKRTAAEAIIQTIVDSRQDSEEEGSLFNRGTQIKMFEDREEYLLASVARRLQAKSKEMSEFDAFNSVQDHVLHAASAHIDRVVLEAFVAGIDGCANEEARELLGILCDLYALSVIEDDKAWYIEHRYLSTERAKAVTRGINDRCRALRPHAATLVDGFGVPEQLRYAEMLHPENLADAVTS

SEQ ID NO: 278 - protein, 650 aa, Mycobacterium intracellulare; identical to SEQ ID NO: 277

SEQ ID NO: 279 - protein, 567 aa, Aspergillus oryzae
MPSNGDSAHPQLPFDSAFLLNLDIFRVSTDDATRDEKIALAYHRARAIARAYAFKVEDILYLSDKFWKFHQDMIHTQDSAAFSLLAIQFNLCVGTLAPFLRHREDLECLIEPLLNFDISGQFLLTEVGHGLDAQAIETVATLLPDGAFDLHTPSPDAAKFMPATSPIPGFPRVGIVIARLIVEEEDRGVRPFFVWLNDGHEMSTGIYARVLPGRAGSKPLDHCITSFKHVRLPHSALLGSLEAPTDPRKSFRSAIHRVYIGTLSLSTVLISALKRSVFVAGKYSFRRYIWGPSNHPRPIISFRTQQRPILHTLAQIAVFDPYAKASIQQYMDPKIPYIVRQGIAAAFKAVLTRATQESLHQLIEARGNSIAEGDTLALSIRLASELILGKYTMPPPRYPFSLLAVFETGLFQHARDIVNSLGGAYRKAEFNTRILPRCQTLVEAVGHRLAYEAALDAGVASELLDLYEAGVVLHHSGWFVENLALDTETQFNMEMQAMNSILPRIGNLLNATGAEPYCTAPIVSDEAWMEFTRSLEVHHGNARMDICEYDADLAESVSIFGFLQDYE

SEQ ID NO: 280 - protein, 571 aa, Aspergillus niger
MQSHSPSNSSSLSLLSSKLFDDHYGDVSRIEELKRSYHRARAIGQLHRLTIEDVLYLAPKFCAVHKDSIIARDPIAHILVTIQLNLVVGTMAPFAIKRPDLHPLMESILNFDISTPFMLTEVGHGCDARNLKTTATLQHDGSFILHTPTPEAVKFMPPSMPIDGIRRVAIVWARLIVDEEDRGIRAFIVPVNNGKEMNKGVHSWLLPQITGGRMLDHGLTSFDNVHLPANAMLGELAMPADMRTQFLSAIHRVGIGALALSLAIIPFLKCATYCVGRYSQRRTVQAGVRGERIPIISFRTQQLPILHSLAQIAVMEAFADWITNRYSTDSALHPGAKHGLGVILKATFLQNGQWSLANLVERSGAQGLYPHNQMVSFETLTRGIGIAEGEILVLSIRLATELLVGQYAIPEPTKPNCPLAQHETGIICELRDRLKQIGTHRSDEYGNQVLPRLRSMVIAIGQRMAYEAAVDAHVDPDLLALYEAGVMKSDAAWYSEHLGINRDAQFQLECNALDAVLRRLDEHLDNLEIEPYCTAPMLSPDRWMQIIKAAPEFTGNVEMGFPGAQELQSKL

SEQ ID NO: 281 - protein, 641 aa, Dictyostelium discoideum
MDVKYIINKDQLHQARNSALHAHEKYYKDFSQLLKTNINNRPVIDMASDEHKAKTHRDAIEVCKMGVLDVRVIQKDPKIFLSYLTSLSSCDMSLMAKLVIHFQLFGGTILELGTEEHHNKYFPDIKTMRIVGGFGMTEMGHGSNVRQIETTAEYDHTTKEFIINSPTRSSTKFWIGNMAKYGTHIVLFCRLIYKGEDKGVHGIVTQIRDLDSKNVFPGIEIGDCGPKIGWNGIDNAWIRFTNYRVPKENLLNRFANISDSGDYTCKLSTPGKLFQVTISQLVFGRLLYICGPIKALTITLRTGLTYAFNRRQFGEKNKIEELIINYPSHYQVLLPMLSHLVAFEFARDSIIERLLEPKTTDERLDETNSTISGVKALVNEYTMIYLNKLRTFCGGNGVSSFNLFGYYRNEMDIFQTAEGDGAVLYQQLAKFLLSEYKKWYKKEGVTGYIIKEVQTFLATSNPMYTHTRSIPYILSNEFHHHAFLYRFERIRSTVIEKLSHSKSKKLTFLQSWNDSLLYIIDMAKAYSHLYILEQSHLAIRRCQDPSTRHLLNDLIKLYALSNIEQDFAFFRNCNFLSSGKAFAISDAIKELCIGIKPYALQIINSDYNILIDPLLNIPLANLDGDYINHMADCVGVPKSNL

SEQ ID NO: 282 - protein, 613 aa, Nocardia cyriacigeorgica
MVGDRFAGDPALDYRAARARVLEQMRALAGMGLAERGFRRENGGTGEPGAAVVGLEMLAYTDLSLWVKSGVQWGLFGGAVENLGTERHRDFIKRLISLDLLGCFAMTESGHGSDVANLETTATYDPATQEFVVHTPTPSARKDYIGGAAEHARMAAVFAQLITAEGNHGVHCLLVPIRDEQGNDLPGVTTSDCGLKGGLPGVDNGRIVFDHVRVPRENLLNRYADVAPDGTYSSEIENPSRRFFTTLGTLVRGRVSVGGAAAAGARVALSIAGRYALKRRQFGDPDDGGEILLLDYRNHQRRLLPLIARSYALAFAQNDLVRRMHLVQTGQDLDPGAQRALEKRAAGLKVAQTRHATRAIQECREACGGAGYLTENRLVTLKADTDVFTTFEGDNVVLTQLVAKELLTAYSDEVRDLDALGWVRFAATMAGDVVRKRSGVRQLIQTLRDRGDESVDEGDLSKRAVQLQLFADREDYLVRTAAHRLRARAEETSPFEAFNNAQDHILAAGSAHIDRLVLEAFIEGISGIDDPDARELAETVCDLFVYATLEENLSWFIMHRFMSVERGKAVRRGVNELVDRLRPDALTLIEAMGVPESMLRAAMLDDASVYERQ

SEQ ID NO: 283 - protein, 651 aa, Streptomyces albus
MTHGQLGPIHDSLATVTLQSVITEREIPLRHGSISASVSTADDLLFATRGEEHLRWRELFSTEEFGHRDLPHRERVELSYRRLRTVAAAIPDPRALALSAPALTALHEWAGPADPGMATLASIHYNLFLGSLLDHDHAERDLEPWLRMDRIGTFLCTEAEHGNDAVNMETTAEYDRASRQFVLNTPGPGAAKWMPNTSLTGGPKDAVVAARLLVDGRDLGIFLFLTPLSDERGHLPGVSVERLPHTSGAPVDHCATRFHHVRLPHSAMLQGDHGRLSPDGEFESTLGSPRIRFLRSIGRVSMGKLCMSGYSLGATRQAVAVAVRHGSTRLTSGMTKGRRVPLMAHRSHHEPLLDALATTYAATLLHRSVVRQWEVAEEAEREEVDRLVAVTKGWITWAARETMTTCRERCGAKGLLLTQGIAGQLAANEGTITAEGDNQVIWVKAAGELLMGGFTPKPPSETAPEQRSLRDGTHLQDLMADVERIWHERARTRLRTGGVRGNPMARWNGAVTPALELVAAHAHRLAGEALLEGSDRVTGDEAERIRDLHRLFALRQVAAHSGELLAGERLTAEQVRRLPDEVERVVADLEPHALALTERFFVPEQVPGSDPAGLVEAADLVEPVPEAVAGALPAGAESRAGGLRESEPDAT

SEQ ID NO: 284 - protein, 645 aa, Streptomyces ghanaensis
MTLLTFRTNACEVTGGPLQDDLPGSLPQLISPLPAAGELTHLLFDQDNQGDIHQPWRNLIAQEQFRHAHGLSPEERTTRSYARLRLVNNSLSSAEALTNDPHRLASLHEWTGVVDATLGTLSSIHYNLFLGSLYDHDAVTSRDLADFTSLRRTGTFLCTELEHGNDAASLQTTATFDRAADCFILHTPTPAAQKCMPNTGAAGGPKSALVAARLLIDGQDQGVFLFLTPVSDEAGPLPGITVRPLPERIGHPFDHSLTSFDQVRLPREALLEAEHGRLAPQGTLSSSLGNRRKRFLRSLHRVLMGKLCMSAAAVGVSRASLAIAVRYAHARYISGPRAGQRIPLVAHRSHHGRLLYGIATAYAMTFLHREVVSQWARHIAGEAAQDAESRAELERLVAITKSWTTWQARDIAIECRERCGALGLFPVNCLADITANVEGTITAEGDNLVIALKAAAEMLFGHRSRKGRSAELPVVEQHLTDLGFLRDLLGEAEALWQERARRDLRQGPAGDPVSRWNGASSAALKMVDIHARLQAADALLAAAGQAVGPAARDLLHQLARLFLLKEISEHTGDLLAEGFLTAGHIRRLPAAIDEVVAELAPHMMTLVEAFDLPDEFFSGIPIANDDYTLRWNELADSLAADCCDR

SEQ ID NO: 285 - protein, 650 aa, Mycobacterium intracellulare
MAPQKTSTAEHLRNALDGRWRDVRNRMRTTLTEDLFRPHYTPNTVIARTKVAEQMRIMAAFGAAADSFRKEHGGTGDVGAAITMIEMLAMSDLSLMVKAGVQWGLFGGAVENLGTERHHETYVPKIISLELRGCFAMTETGHGSDVQSLETTATYDAETQEFVIDSPTPSARKDYIGGAAETATMAAVFAQLITTEDGKPVNHGVHCVLVPIRDEDGNDLPGITTSDCEYKGGLPGVDNGRIVFDHVRVPRVNLLNKYGDVAPDGTYSSPIENPNRRFFTMLGTLVRGRITVGGSAGAAGRVALDIATRYALQRRQFNAPDDGSEVLIMDYLVHQRRLFPLIAKSYALQFAQNELVSKCHDVQSADAPDADEQRELEARAAGLKAANTWHASRAIQESREACGGAGYMAENRLIGLRGDTDVFTTFEGDNHVLTQLVAKELLTAYADDIKSMSPVEWVRFAANTVGERVIKRTAAETIIQTIVDTRQDSEEEGSLFNRGTQIKMFEDREEYLLASVARRLQAKSKEMSEFDAFNSVQDHVLHAASAHIDRVVLEAFVAGIDGCANEEARELLGILCDLYALSVIEDDKAWYIEHRYLSTERAKAVTRGINDRCRALRPHAATLVDGFGVPEQLRYAEMLHPENLADAVTS

SEQ ID NO: 286 - protein, 640 aa, Mycobacterium smegmatis
MTTTAEHLRNALDGRWRDVKNAMRENLSNEVFRPHYTPNTAIARAKVAEQLKIMAAAGAAEDGFRKEHGGNGNVGAAIAQIEMLAMSDLSLMVKAGVQWGLFGGAIENLGTERHHQAYVRRIIDLDLLGCFAMTETGHGSDVQSIETTATYDPATQEFVIHSPTPTARKDYIGGAAETARVAAVFAQLITPDGMNHGVHCLVVPIRDDEGNDLPGVTTSDCHYKGGLPGVDNGRIVFDHVRVPRENLLNRYADVSPEGVYSSPIENPGRRFFTMLGTLIRGRVTVGGSAAAAARVALDIATRYALQRTQFSAPDDEHEVVIMDYLVHQRRLLPLIAKSYALQFAQNELVAKCHELQTSDDPDPEEQRELEARAAGLKAANTWHASTAIQEAREACGGAGYLAENRLIALRADTDVFTTFEGDNHVLTQLVAKELLTAYADDIKGMSPVEWVRFAANFAGERVLKRTAAQTIIQTILDTRQDNEEEGSLFNRGTQIKMFEDREEYMVASVARRLQGKAKEMSAFDAFNAVQDHVLHAAQAHIDRVILEAFVAGIDACEDEAARELLADVCDLYALSVIEEDKAWFIEHRFLSTERAKAVTRGINERCRTLRPHAETLIDGFGIPEQLRYAAMLDPEELLNG

SEQ ID NO: 287 - protein, 650 aa, Mycobacterium avium
MAPETTSTAEHLRNALDGRWRDVRNRMRETLSEDLFRPHYTPNTVIARTKVAEQMRIMAAFGAAADGFRKEHGGTGDVGAAITMIEMLAMSDLSLMVKAGVQWGLFGGAVENLGTERHHETYVPKIISLELRGCFAMTETGHGSDVQSLETTATYDPATEEFVIDSPTPSARKDYIGGAAETATVAAVFAQLITTEDGKPVNHGVHCLLVPIRDADGNDLPGVTTSDCEYKGGLPGVDNGRIVFDHVRVPRVNLLNKYGDVAPDGTYSSPIENPNRRFFTMLGTLVRGRITVGGSAGAAGRVALDIATRYALQRKQFTTPDGDSEVLIMDYLVHQRRLFPLIAKSYALQFAQNELVSKCHDIQSADDPDADEQRELEARAAGLKAANTWHATRAIQESREACGGAGYMAENRLIALRGDTDVFTTFEGDNHVLTQLVAKELLTAYADDIKSMSPVEWVRFAANAVGDRVIKRTAAETIIQTIVDARQDSEEEGSLFNRGTQIKMFEDREEYLLASVARRLQAKSKEMSEFDAFNSVQDHVLHAASAHIDRVVLEAFVAGIDGCPDEQARELLGILCDLYALSVIEDDKAWYIEHRYLSTERAKAVTRGINDRCRALRPHAQTLVDGFGIPERLRYAEMLHPENLSEALTS

SEQ ID NO: 288 - protein, 670 aa, Streptomyces griseus
MNDAAPPSTNDLLTAVLFGPNFRQEHRFWRRLLTTEPFRRPGGGTPDERLALSYHRLRILNDALDSGARLAADPRALAALHEWLGPVDPALTTVAGIHYNLFLGSLLDHDAGAPRDVSDFLALRRVGTFLCTEVAHGNDAAAIETTATYDRERDGFVLHTPHAGAQKFMPNTSPAGGPKSGVVAARLLVDGADHGVFLFLVPLTDAHRALPGVRVRRLPPRMGSPVDHCLTSFDRRFVPRGALLAGQQGRVGDDGRFHSEVPNRRRRFLASIGRVTPGKLSMSACAVGSARVTLAIAVRYAGHRMISGSRAVGRIPVYAHRTHHGPLAGAMATVYAMSLLHRRALDRWESAPEADRGEAERLVAVAKGWITWQARAVIVECRERCGAQGLLENNGMTELFTGIEGAITAEGDNLAVHAKAAAEMLFSATAPEPAEDDGPGGLDDPVFLGRLFAAVEDLWFARARERMAAAPPGDPLGRWNAASSAALRGVEAHACRQADEAYAEAVASLPEGAARQRLSELRRLFALRWIAHNSGALLASGRLTADQVTFLPDAVEDAVAVVAEHTPALVETFALPERLMSDWPIAGPGYADVYDDPEGPWHRGRRAGIRGRAAEFRRPVCGSRRRPLREKVAALGTRGVLLAYWGTTSMLSRWFEKPQVSVDESVRPKA

SEQ ID NO: 289 - protein, 592 aa, Streptomyces griseus
MTDSQIPDTADASIALADVLFAGQLGTTHARWRRLFSSTPFRFEEGLTHRERIDLSYDRLRLVNEAVQAPQVLANDPAELTAIHEWGGAVDPGMATIVAIHYNLFFGSLADHEAAGRDLGEYVRADRIGTFLCTEIAHGNDAAHMETTATYDRAARGFVLHTPTPAAAKFMPNTSPAGGAKGAVVAARLIVDGTDHGVFLFLTPLSDSDGSPLPGVEVRALPQTASSPVDHCATTFHRVRLPYSALLQGDHGRLTPDGEFTSTLGSPRRRFLQSIGRVTMGKLCMTAHSLGVMRHALDIAMRYAHTRVTSGMTNGQRVPLIAHRGHHTPLLDAAATTYAATLLQRSVVRQWDRAAGEEREAYERLTAISKAWITWRARAVMTECRERCGAQGLIQSNGIALQLASIEGTITAEGDNQVIMQKAGGEMLLGGVDLKPESEIAPADRELTDPQHLQDLLADIERISHTRAKARLRQRAGSPLARWNATVTPAVALADAHVHRLAAECLLTAAGQVPSGLPEDLLRGLHALFALRRIAAHSGDLLARGRMTADQVEQLPDAVEAVLGFLEPHALTLTSAFAVPEALLETHPMLSA

SEQ ID NO: 290 - protein, 648 aa, Rhodococcus opacus
MATTADHLRSTLDGRWREVRERVRAELSGTPDFAPHYTPDLDEARAKALAQLRLLASNGYAAAGFAKDHGGTGDAGAAVTSIEMLAMSDLSLMVKAGVQWGLFGGAIENLGTARHHEAYVKRLVDLDLLGCFAMTETGHGSDVQALETTATYDPDTAEFVIHSPTPSSRKDYIGGAAQHATTAAVFAQLITGGESRGVHCFVVPIRDEDGNDLPGVHTSDCGYKGGLPGVDNGRITFDQVRIPRENLLNKYADVEPDGTYTSPIDNANRRFFTMVGTLVRGRVTVGGSAGAAARVALSIATRYALQRRQFNAPQDEDEVLLMDYLVHQRRLFPLIARSYALQFAQNELVATMHEIQSSADADPQEQRELEGRAAGLKVANTWHATRAIQEAREACGGAGYMAENRLTALKADTDVFTTFEGDNHVLTQLVAKELLTSYADEVRGMSPVEWMRFAATTVSDVVKKRTAAQQIIQTILDTRQDNEEDGSLFNRGTQLTMFEDREQYLLSTAARRLQGAQKREENPFDAFNFVQDHVLHAAQAHIDRVVLEAFVAGIDECEDDDARDLLSDVCDLYALSVIEEDKAWFMEHRQLSVERSKAVQRGINERCRSLRPHAQTLIEGLGVPEALLGSAMLDGPGTDTVRKTQIFR

SEQ ID NO: 291 - protein, 559 aa, Streptomyces sviceus
MFAYHEGLTHQERTELSYQRLRTVNAAVPDPQALARDPVALSALHEWAGVADAGMTTLASIHYNLFLGSLLEHDHEGRDLGPYLRMERIGTFLCTEQAHGNDAPQLETTATLDRATGGFVLTTPTRGARKWMPNTSVAGGPKDALVAARLVIDGKDQGVFLFLTALTDGNGRHLPGVEVELLPQTASSPVDHCATSFHGVRLPRTAMLQGEHGRLTDEGELVSCLGSPRKRFLRSIGRVTMGKLCMSAYSLGVTRHALTVAVRHAHQRVTSGMTSGQRVPLFAHRTHHAPLVEALATTYAATLLQREVVRRWAQAAEDEREEAERLVAVAKGWITWQARAVMTECRERCGAQGLLLSNGIAGQLAANEGTITAEGDNTVIWVKAAGEMLLGGFSPMPPSEVPPATRSLHDPAHLHDLMGDLERIRHERARGRLRTKRAGSPLDRWNGASGAALSLVDAHVHRLAAQQLLAAAAQATDPQVALLLEHLHRLFALRYVAAHSGELLAHERLTAEQVRYLPEVLEATVAALVPHALTLTGAFAVLDEITERHPALRSEVVPA

SEQ ID NO: 292 - protein, 650 aa, Mycobacterium avium; identical to SEQ ID NO: 287

SEQ ID NO: 293 - protein, 650 aa, Mycobacterium parascrofulaceum
MAPQSTTIADQLRNALDGRWRDTRNQLRSTMSEELFRPHYTPNTVIARTKVAEQMRIMAAFGAAADNFRKEHGGTGDIGAAITMIEMLAMSDLSLMVKAGVQWGLFGGAVENLGTERHHEAYVKKIISLELRGCFAMTETGHGSDVQSLETTATYDPETEEFVIDSPTPTARKDYIGGAAETATVAAVFAQLITTEDGKPVNHGVHCLLVPIRDADGNDLPGVTTSDCEYKGGLPGVDNGRIVFDHVRVPRVNLLNKYGDVAPDGTYSSPIENTNRRFFTMLGTLVRGRITVGGSAGAAARVALDIATRYALQRKQFSAPDDDSEVLIMDYLVHQRRLFPLIAKSYALQFAQNELVGKCHDIQTADAVDADEQRELEARAAGLKAANTWHASRAIQEAREACGGAGYMAENRLIALRGDTDVFTTFEGDNHVLTQLVAKELLTAYADDIRSMSPVEWVRFAANTVGERVVKRTAAETIIQTIVDARQDSEEEGSLFNRGTQIKMFEDREEYLIASVARRLQAKSKEMSEFDAFNAVQDHVLHAAQAHIDRVVLEAFVAGIEACPHEETRELLGILCDLYALSVIEDDKAWYIEHRYLSTDRAKAVTRGINDRCRALRPHAETLVDGFGIPEQLRYAEMLHPENLADAVTS

SEQ ID NO: 294 - protein, 661 aa, Dictyostelium fasciculatum
MDNTMLQFPKGDQSSSLDQQSSSNKEKKLEKKQIMDILHDKSIYNVDLDVTKDQNRLTVLKQLLHFLPLTFGKGIVNISDLRNDPGRVVALIDSLSQFDDCKRKRENESLMTKMVVNNFLFGASVFNLGTERHHTLLPDIQSGKLLGCFAMTELGHGSNVRALETTATYDSEKNEFVINTPVRTATKWWIGNSAHAVIATVFARLIIDGVDNEVHAFLVPLRKSNGYDLLPGVKIGDLGMKFGLNGVDNGWIQFDNVRIPASNLLDKFGGVENGVYRSPISSPSKRFATILAQMITGRISICAGTIRNLKIGLAIACRYATKRLQFGPDLKSTENAIMDYPTHYLSLMPMVASVYAYDATRSYLAKKFQERTGEDEIHVLASGLKAFLTQYTTTSLLEMRRMCGGHGYWGLSRFGRLIASNDIGRTFEGDNTLLLQQVAKDLLTQFKKEYTSNKFTGTLKYLSKNTSLFMDRINPITTRRSDEKHILSLKFLLDAMEYRSSKLLIDSANTVAKNYKETKKPFDSWNVSLEILVHLAKAHTETIIVTKFIESIKAVQDRELKDSLKKLCQLYALCKIREDFEFFRNTNYLKNGKAIAIGKIISTLCFELSREAITLVEGFGNDEELLESPLGLADGDLYENICKKVGGPFSPANYLVTPSKL

SEQ ID NO: 295 - protein, 1655 aa, Dictyostelium fasciculatum
MDTPLKRIAVTIQHLKNEITGVHHQHNEGHCCNIYDDITSTPLGGSPNVEYLTSLLDGDFKQDRDHLFRLFQNNEEFDEPFLTEPGYTNYKHRERTLIASKLIADQEIVTLEDMKNRPDKFLAWFETISYADLSVSLKFAVQYNLWGGTILFLGTEKHHSKYLSGIQDCTKLGVFGLTELGHGSNVNGLETTATYDQETKEFIVNSPTWTSQKYWPGNIATHGQFCTVFARLILKGRDHGVHAFVVPIRTPPLSGHPYGLPMPGVEIRDIGLKSSFNGIDNGGLLFKQVRIPLDNMLDRFSRVTESGETMMSVFYIGRLCISVLCLAAAKTAVSIGLSYSHNRKQFGEPGKPEQPIIHHTTQQRRLLPNLARCFALDFAHKRVILTDAMELKHSYSSGLKAIGAWDCFSATQLARECMGGQGFRLSARVPVLRNHLEVGLTGEGDNTILCQQTSKFLLATYHKQLQDIKSNNTQQFTGELSYINNIKQYDYHTNKKPISFSHLKQFTYQQLAFQKREYLLIEKLYNIMYSTKNNNIIIKINSVEWYRLWNENLSLTLKLARANVDRFVHKFFLEKIQSLAKDTDVNTVAVLKKMCALDAFDLIQRDLGVFVSNGILAAKENGTGIWFDMEKEITHVCSELTPYSLDIASAFKIPKKLYTFNINIYQSYLVINTYLRHSPGAQLPSEQVTLLKQLNNYALTYWMPIGSTPGCGSTGLQVRSLVMCNPENTQITGLTIETQLLNLNIDMIDFSVVPYLKSLTFYTSTPVLFPATLLTHKNITTFELIYLTPVQDNTQGMFVDVTRSNWTGMTSLEKVYIDGMWGTLPILPPSVTFVHISSPSQQSLRQFSTAAIHTNLFTPELLVYELNTFNFILQGPAFNISIAQCTKLQSLQIQSAGYNVDFKSFYTLPPVLTSLRLINVFASVANRTMPLYKELTGWDNLVTLELQGLQLTGPLDEQYFKIPYLSVLNLNYNALLTFTLPNYLNTSQLTVIRFSGCNGLSGSIPANILDNLLMEIVDVSQTSITGELPRVLLCAFHGLFSTNYFISGLVFSNYNGSIFQRDCNPTISQIEPFSTNSSIVINGNDLGPKAPYLFLALTNTMGDAIQTSCGFTIPNYRLECTNPLTLGFGKLQVYVLVNLQYTIINSNFTYQRPSILQSTPCPTLGGRITLYGYDLMANAVRKKDTGISIYGRPCTNYQVLASYRAVSCEYAAGITSNVPISIQVSGLYNNASNDAYFRYLPPNVVSSFATKPNEATQLTITGSDFWNDVSLISVVIEDTPPIPCPVTYSNHSYFVCDFPASPYTTGRKNIKVTVNGQTSAPNKLFEFLDETVCPKYCNNNGICDVAIGFCVCNSITNNNNTLFGPSCEQESYDNNAVFSTLEPILEITPSFNEKTVLTAKLISVVENGAEIIIPSWRYTLLANSSTHQYEWTSGAKIVTVSIIPNQDGGSALFGGSYLTFPSNSYTYAINYTLEGGSDDSVQFKFAIDMTPDECTTAPITLASPVGLNESTGVIGDLRWSLLTVYDVEWFTRHPGIAHVNNGGSGNVETSLLKQDGSSQLLIVYVKPPAGETKIRNVFFQYDFAVLKASSSRSPKTGGCDDTSFAKWKIAVSVIGAVIGAALLGVAGYFLVKQQLKINKTKSALDKRLRELNSNL

SEQ ID NO: 296 - protein, 643 aa, Dictyostelium fasciculatum
MEMDYKAVIDTQQLSAIRNESLIHYDKERKEFEKIIYDSIEHGPFLDVDSTTQKRLTNEIVKKVMAMGRFRVQLLREDPKKLLSYLHALFPSLDLSPIAKIVIHLQLFGGTILEIGTEQHHKRYFDDINNYKIVGGFAMTEMGHGSNVRQIETTATYDHSTKEFIINSPSLTSTKFWIGNMSMFGTHVVLFCRLIYKGEDKGVHVIVTPIRDPETLTVYNGISIGDCGHKVGWNGVDNAWIRFSNYRVPRENLLNRYATITEDGEYISKLSSPSKLFQITISELVFGRMLYVCGPIQYLGIALKASIRYAFSRRQFGEKGKTEELIMNYPTHYRILLPMLAQNTAFEFARNWVIDNIQESSKSEEKREEFHAIVSGIKAMVTEFAIVALSRLRVMCGGNGMSSHNLLGYMRNELDVFQTAEGDGAVLYQQLSKYLMVEYKRWYKKEGMTGYIKKEVQSFLVTSNPIYTHYRSMPYLLSNEFHQHAFSFRFEKTRSMVIEQLNQTKAKGLTFQQSWNASLILVAELAKAYTHLHTLECAHRAVRKCSDPITRHVLNDLIKLYALHNIEQDFGFFRNTNFLSSGKAVAISEAVTSLCQTLKPYALSIVESINDFEGRLDIPIGKSDLDYITHMARKVGIPLQKHA

SEQ ID NO: 297 - protein, 476 aa, Dictyostelium fasciculatum
MDTPLKELLSYVTIQHLKNEITGVHHQHNEGHCNIYDDITSTPLGGSPNVEYLTSLLDGDFKQDRDHLYRLFQNNEEFDEPFLTEPGYTNYKHRERTLIASKLIADQEIVTLEDMKNRPDKFLAWFETISYADLSVSLKFAVQYNLWGGTILFLGTEKHHSKYLSGIQDCTKLGAFGLTELGHGSNVNGLETTATIDQDRKEFIVNSPTWTSQKYWPGNIATHGQFCTVFARLILKGRDHGVHAFVVPIRTPPLSGHPYGLPMPGVEIRDIGLKSSFNGIDNGGLLFKQVRIPLDNMLDRFSRVTESGEYESTIAPNRHFGAMMSVFYIGRLCISVLCLAAAKTAVSIGLSYSHNRKQFGEPGKPEQPIIHHTTQQRRLLPNLARCFALDFAHKLVILTNTMDLKHSYSSGLKAVGAWDCFSATQLARECMGGQGFRLSARVPVLRNHLEVGLTGEGDNTILCQQTSTDKNKFKNY

SEQ ID NO: 298 - protein, 694 aa, Aedes aegypti
MPTDEERRIIPDVPRGPLCEYRSRSKFNWKDFKLVLENSTLARIKYDVWKKLESEPLFTPVTSTLTADQQKERAAKQVNRVADLELAPAEVYSMDYKYRVRYLMSINEALHSVCPSMSVKIALGVGLFTNSLLAMGTERHSAVYNAAWNREIITCLAITEVSHGSNTKRCRTTATYDPKTQEFVINTPDFEAAKCWVGNLGKTASIALLFARMYTGEGEDHGLQGFLVPIRDPKTLQPYPGVIVGDIGEKIGLNGIDNGFVMFNNYRIPRENLLNRTGDVTPEGVYECTFTEPGKILGAVLESFSAGRLGIMQESSNTLSHAAVIATRYAALRKQFGPDRDGPEQSIIEYQLHQWRIFPYLAAACILKVSVYALTEIYLETVQKSQAESNGFELLTQIVSELHALVSSSKPLVTWTARDAIQESREACGGHGYLKAANLGELRNNHDPSCTYEGDNNVLGQQASNWLLRQWKGSKVESPVGTAHFIERREAVLRNSYDAIVKTGCKVESPEFVTQCYEWLMCWLLYSTVDQIQLSSDNGADRFKARNDSQVYRARDLSRAYAEYYALQSFRSRCQRADISEELEPVLNNVYCIYGMWCIDRHLATFYAGGFASGPRFADAIRSTLLQACGQFKDSAVSVADALSPPDWVLNSVIAKSDGRLYENLQNQFMTNPGAMERASWWKDIIPTKMKSKL

SEQ ID NO: 299 - protein, 456 aa, Loa loa
MFIVQLRDLDTHMPLSGITVGDIGPKMGIPGSDNGFLIFNNYRIPRKNMFMRYSQVLSNGEYIAPKNSKLRYGTMVFVRSIMVRHQAMQLAAAVTIAIRYSAVRRQGEWKPGLKEVQILDYRTQQYRILPYLAQSFVFLFAATEVKDLYMKVSEQLSHGNTELLQELHILSSGLKAVVTWEIAKGIEQCRLACGGHGYSHASGLPEIYSFAVAGCTYEGENIVMLLQVARFLMKTIKEIRSDSAHLAAVASYLLDGRRYKSSFRIWRTVKYEDLIGDFEQVARNQIYWTFDYLQQLQKDNRSPDDAWNCASVELCQASRLHILCFMAKSYFSRIAQCREPEIARILDLIGKLYLLHEISAHCYSFRKVNYMSDEQMKNVKCGIYEILGNLRPDAVAIVDSFDFSDRELHSVLGRRDGNVYAAMLEWAKYSELNETEVLSTFKKYLGPMMKDGRSKI

SEQ ID NO: 300 - protein, 652 aa, Streptomyces sp.
MSCGTSSAAAGWRQPAVSEEPVDVPAVPEKVDPDALTEVLDGRWAELKRDVRAQMSAEKFRETIGLDVEAHRVQVLDQLRKLAETDRPALGFDAAYGGLSDVGGSVMSFEMLGYGDLSLMVKAGVQWGLFGGAVQLLGTATHHEKYLRRIMNLDLLGCFAMTEHGHGSDVQHLRTTATYDPAAREFVVHSPDPGATKEYIGNAARDGQLAVVFAQLITGGESRGVHAFLVPIRDDSGAPAPGVTIADCGIKAGLNGVDNGRLTFDQVRVPREALLNRFGDVAEDGTYSSPIESDGRRFFTMLGTLIRGRVSVGGSAGCATQRALTLAIRYGDQRRQFQRPEGDEVVILDYLGHQRKLLPALAKTYALHFAQEELVAALHDIAPDAPEEEQRELESRAAGLKALNTWHATAAIQTAREACGGSGYLAENLLAGLKADTDVFTTFEGDNTVLLQLVAKGLLTQYKEHFEDLSPLATARFVAEQLVDTVMERSAARKFLERLTESDDASVLFDREWQQRLFEDREEHVLSGVANRLRGAASDPFGVFNSVQDHVLLAGRVHVDRLILDAFARAVAACPDTDAAALLSRLCDLYALSTIEADRAWFLEHGRISASRSKAVTAAVNALCGALRPHARTLVDGFAVPEQFLAAPMLNG

SEQ ID NO: 301 - protein, 456 aa, Loa loa; identical to SEQ ID NO: 299

SEQ ID NO: 302 - protein, 652 aa, Streptomyces sp.; identical to SEQ ID NO: 300

SEQ ID NO: 303 - protein, 566 aa, Coprinopsis cinerea
MPTRATLHRRTRLSLVSARQTADADIPYNRFPVMASTCADAPPGLSAQDVELCSPKYWAMMRDPICSQDIAMFTILAAHVGLTIGTLSRHLRKRPDLRPLVDRLLRFDTVGIYLLTERGHGLDSFNIETTATKTKDGFVLHTPREEASKFMPASTPLFGIPKVALAMARLIVDEQDRGCRFFVVPICDSRQMYKGVSSIRLPPRSGTGPLDFSITTFTNVHLPPTALVASDIFDFSLPSRPLEAWWDEVWRIQLGTLAVPAPWISAMKATAFIGGRYSMQRCILGKSSEPTPIITFRTQQWPVAHCTAAAMIMDNWYPLVVKTAMTQRDPRIRHALSVIAKATVCRHFQRCIPEIAERCGAQGTFDQNYMARIENDGKGVIIAEGDVLTLCIRLFSELVQGRYTLSLPDPSESALAYHAHSLLQENIDLYNSLGCNHRSDEFNFLILPQSQLAIEAIGHAMAYSAAVEAGMPKAILDVYECAVIRQDPAWYSEVLGITRMQQRIREDAAVTSFMQHLPDYLIQLDIENYVQAPIVTDQGWKSYVSLLPKYSGDSVPSDLGQLQAML

SEQ ID NO: 304 - protein, 566 aa, Coprinopsis cinerea; identical to SEQ ID NO: 303

SEQ ID NO: 305 - protein, 559 aa, Streptomyces sviceus; identical to SEQ ID NO: 291

SEQ ID NO: 306 - protein, 650 aa, Mycobacterium parascrofulaceum; identical to SEQ ID NO: 293

SEQ ID NO: 307 - protein, 651 aa, Streptomyces albus; identical to SEQ ID NO: 283

SEQ ID NO: 308 - protein, 645 aa, Streptomyces ghanaensis; identical to SEQ ID NO: 284

SEQ ID NO: 309 - protein, 641 aa, Streptomyces fradiae
MSLLTPRRAPGHTDTDHSSSDADAPLAGSAPFTASRTDAQDTAASELTHLLFDRDDRTRLHGPWRNLLTTEMFRHRPGLPAARRTALAYDRLRFVNELVGEPAELARDVRLLASLHEWTGVVDGAAGTLAGIHYNLFLGSLLDHDRSDERDLSEFLSMRRTGTFLCTELAHGNDAAALRTTAELDRRTDKFVLNTPTPGAQKFMPNTSTTGGPKTALVAARLVVDGTDHGVFLFLTPLSDPAGTLPGIRIRRLPERTGHPVDHCLTSFDHVRLPREALLEGVHGRLASGGFESFLGNRRKRFLHALGRVTAGKLCMSAAAVGVTRAALSIAVRYSHHRHISASRTGERVPLARHRSHHGRLLEGLADAYAMTFLHRRALSRWAGRDETDQAEAERLVAIAKGWITWQARAVTIECRERCGAQGLFPVNGLADHPLNLEGTITAEGDNLVIWLKAASEMLFHRRTEQRPRLDGPPEEQSLTDPRFLHDLLADAEGLWRERARGALRQGPSGDPLGRWNGASSAAVEMVRAHAVLQAAGSLLEAAGHADGAAPRQLLVWLSRLFMLRHLAPHTGDLLAEGRMTADQVRALPGSVDEVIAGLAPHMMTLVEAFDLPGEFLGGIPLANAAHETRFDQIVDTLLSA

SEQ ID NO: 310 - protein, 667 aa, Dictyostelium discoideum
MLQFKPSNNDVQQKINDQNSKSKLSLSDKLKNWSIQGFENHNIRDELNRIMSTSEVFKVKELDMTKEANRVLVLKQVLEITRGVFEKGLIQISDLRDDPSKILAFIDIVSQFDDASLMTKLIVNNFLFGAAVFNLGTERHHKLLPDIQSGRLLGCFAMTELGHGSNVRSLETTATYDPKTDEFIIQTPYRTSTKWWIGNAGHAQISSVFARLIMDDGKDHEVHCFLVPIRKSNGVDLLPGVKIGDVGSKFGLHGVDNGWIQFDNVRIPASNLLDRFGSVENGIYSSPIKNPSRRFANILAQMITGRITISFGSTRTLKSGLIIATRYACKRLQFGPTSTGPEIPILSYPTHQLTIMPMIASTYAFDAIKIYLGKRFQERTDEAEIHVLASGLKAITSQFTTVSLMELRRLCGGHGYGGYSRLGKLVAAIDVGRTFEGDNTLLLQQVAKDLLTQFKKEYSGNKFTGTLKYLGKNTSLLLSGMNPITTMRSDDNHLLSFQFLLDCMEFRSSKLLIQSAQTVSKNYKKSKESFTAWNQSLEILIHLAKAHTETIILQKFIEKIQSEKDLELASILKKLCQLYGLYIIREDFEFFRNSNYLKKGKAKAIIKLIGQLCSDLSQQAMLLVKGFGNEEYLMNSPLGMEDGDLYENICNQVGGPFTKDNYIQSKL

SEQ ID NO: 311 - protein, 699 aa, Ajellomyces dermatitidis
MASLNRQLILMRNARQAATFDPYRLTCILHKGYKDSRKAAINREETVQRRREAFWRVEQATGTDDQSKLPAAYANADRESVYLQGVEAGTAAFVDGIRYNHDFFYGLDQYYTLSNGTPYGLHYMMFIPTVELQGSSEQIEYWVPLAKQGKICGCYCQTELAHGTFVRGIETTATLDTEKDEFIINSPTLTSAKFWPGAMASSCTHGILMARLVIRGEDHGVHPFIVPLRNVDGFKPVQGVEFGDLGMKMGYNGTTNGYALFSGLRIPRNHLLMGHTKVHRDGTYVRAPHDKAAYLTMLHARSTIAAGAGFKLAQAATIATRYSVVREQGAGIGDGPEMPIIHYRSQNFRLLTIIARSYAIHFTRNTLEYLEKDLKHIASNHDYTSIHLDHVLLAGFKAWNTQVAADGAEDARKSCGGHGFVLTSGLPSIVAEATAPATFEGENYVMYQQVGRYLLKCWKNLKLGNPIDSRLGILREAFTRLQTTRGKQQCCKAFGTEFLNPDIQCTIFKHRAFRLLHQCSEELENAEQKGQSAVDAFNHNLVEIIAAARAYIELLVLQDFINSVEPTSATDPAIYAALSRLRSLFALTTITHPQSYDAISFVEDQHLNAKQMRDIRCCVNGLLDQLLPDAIALTDAWDFTNASLRSAIGQYDGNAYETLMSWTRQMPINRGMEQAGGTCEVAWNTWIKPALSPELRGKL

SEQ ID NO: 312 - protein, 641 aa, Dictyostelium discoideum; identical to SEQ ID NO: 281

SEQ ID NO: 313 - protein, 667 aa, Dictyostelium discoideum; identical to SEQ ID NO: 310

SEQ ID NO: 314 - protein, 563 aa, Ajellomyces dermatitidis
MSTTLHFPSFCGVEGRIEGRKQLLKALTSNPIFSRTAVTIPSLARKDAWKRAVSQARKLVVLKHKEKWTGPQFHDAVRMQDYFLPVQPQLRIFISNLERQMTDEQKAVWIPKAERFEILGSYAQTELSHGSNVRGLETTATFDRATDEFIINSPTVSSAEYWIGATGIWATHSIVVARLIIDGKEYGNHLFLTQLRDLETHKLLPGVEIYELGPKVFQGMVGVHNGAMQVHNVRIPRDHMLARNAQVLRDGTDIPPKNTKHSYGSMITVRAIMAEITGYDLLRASSSVPLYEFPVKYRLLPLLAKGTALVLVRQDINRAFDEYSELVIKTGNTSQLEDLHLQTVGAKVYSTDITANGVETCRIACGDHGYSALSGFGQMYAHTVNAVTYEGDNYVIAQQAPRVILKHYKAILRRPESSSKLNVSSESDWFEPDNQQWVLERRLPTLVKAHMEASDVMLVEIPVSLFTSSPWHIAISSTGEDSGILTSAYDKAIQTLSDFSKAIIDAYGFAEFEMDSALARAEMNPYEALVAGPKNSDMNNMRDVWPVDSRRTWAKLDVEEKAK

SEQ ID NO: 315 - protein, 699 aa, Ajellomyces dermatitidis; identical to SEQ ID NO: 311

SEQ ID NO: 316 - protein, 699 aa, Ajellomyces dermatitidis; identical to SEQ ID NO: 311

SEQ ID NO: 317 - protein, 694 aa, Aedes aegypti; identical to SEQ ID NO: 298

SEQ ID NO: 318 - protein, 630 aa, Aspergillus fumigatus
MYLLSTKKSFAQPPPEYKSPLLAGRELWIAYPSTSTARRPDHNMLPSEPKAFDAGQPVHSGQALYKWVWQSPSPTLELAQSPCFRSPASFLTLEERTRFTYERAKKICLAVDDILTLSPKFWKLQTEPIAAVDGGALTLISIQYNLFIDTVAPFAASRPDLQWILQRALSFDISADSKDGLRAQFMLTEVGHGLDARNLKTTATLLPDGSFELHSPSWAAAKFMPPTTPRSGLPVVAVVIARLIVGGENYGVRPFLVPLGDGHEMALPPRAGAHPVDHALILFKRVVLPNSALLGSLEKPRNERDHFFATIHRVSAGTVFLSGASTPALQLAVYNAAQFSLRRRVTGHDGNPMAVIKFCTQHLPILHAIAQYRVLQAFLVEAATTFRNRKVDPRVRHAIATVSKAVALQHFQKSIKALNDECGWHGYCGHNQILQLELEFRAVGTAEGDIRVLAIRLASELLIGRYQLPSPRDPNSAVARHEAALLTEAKYRLIEFGGVHRSEDFNRNILPLSLPMIQAIGHRMALEAAKDANIDSNLCALYESGVILEDSAWYTEQGGISRRVQREMEAQAADTLLPDLERLVYETGAGPYSSAPMTSERLWNTFVSELETYSGEAFLNIGASPVQANL

SEQ ID NO: 319 - protein, 750 aa, Muricauda ruestringensis; identical to SEQ ID NO: 70

SEQ ID NO: 320 - protein, 763 aa, Cellulophaga algicola; identical to SEQ ID NO: 71

SEQ ID NO: 321 - protein, 765 aa, Cyclobacterium marinum
MEKKLSQPTHGSLVLLPTLYKVWSDANITNNEHKAFQSFFNKVDWLSKEDREYLTNKLDPESPPSREELEMWWQTIKSAIAEEKSYPHLSSIGVDILKKNAPIFAETFPVEKAEIELGKLENQLGIIGKSAALTFKSIHSNISTSYETQTAFATEKLTYLLDGKRKPLIDEVKSFISKKEFDYVDPGNLREYREQVLLWCKMLADKGYGSIGFPKEYGGADDMEGYFTVMETLSYRDLSTVIKFGVQFGLWGMSVFSLGTKKHHEKYLKDIGSLQLPGCFAMTETNHGSNVRGIETTATYNHKEKTFTIHTPHINARKEYIGNAALHGKMATVFAKLIIDGKDYGVSTFIVPLRNEEGKTLPGISITDCGRKMGLNGVDNGLISFDSITIPKENMLDRFSSVDEKGNFQSPIASDNKRFFTMLGTLVGGRIGIPRSALAASKSGLTIAIRYADKRRQFGPDGTAEVPILNYRMHQRRMLPLLAKTYACHFAMEYVTDRFLNRKEEEMQEIEALAAGLKSYVTWHNTETLQECREACGGKGFLSENRIDALKNDSDVYTTFEGDNTVLLQLVAKSRLSAYKEQFENMNLFTIIDYVVAKAKTSLTEKNLIITRNKGEAHLLDSEFHMNAFYYRENSILNSAANRLKRLMSEGMDPFDAVNVAQHHLYTLSLAFIERVVLEKFIEKIEQTSDPELKQVLKQLCDLYALHQIEKHNGWYLEQGYMEGGKSKAIRKMVNQLCWDIRKDAVPLVNAFNIPDACLAAPIAI

SEQ ID NO: 322 - protein, 760 aa, Runella slithyformis; identical to SEQ ID NO: 150

SEQ ID NO: 323 - protein, 752 aa, Flavobacterium johnsoniae
MKPAKLQAFTPLFYLVWSDDLLTQKEFSTLKEFINSLNVLSQEEKEYLLSKVDISNPPSRNELTQWKLDIEKSIQDKSSIKSIFDIAEALSGSDLDLTPIESDFIKLENDLGILGEEALQNFKTKADSFTANSHTTSNFDIQKITEFLDGKEAPIIKKVKSVISRPEFAYETSTDINVFRQTVYNWCKILADENLGNMAYPKEYGGGGNVEDYFAIMETLSYHDLSLVIKFGVQFGLWGMSVQSLGTEKHYAKYLKDIGSLKLPGCFAMTETHHGSNVKGLETTATYNHSDQTFTIHTPNKNAQKEYIGNAAVHGQMATVFAKLVIDDHDYGVNAFVVPLRDTDGNTVKGVTIGDCGHKMGLNGVDNGTISFDNVVIPKENMLDRFASVNDKGEFESPIPSDNRRFFTMLGTLVGGRIGIPRSALAAAKSGLTIAIRYSDQRRQFGPEGGSEVPILNYRMHQRRLLPHLAKTYAVHFALQYLTKRFLNKKEEEMQEIEALAAGMKSYSTWSTRDILQECREACGGKGYLSENRIDALKNDTEIYTTFEGDNTVLMQLVAKNRLSEFRKSFGEMGSLGIINYVYENAKTAITEKNPIATRRTDDEHLLDKEFHLQAFVHREKTILASAARRIKKLVDGGLEAYDAFNVVQHQMIDVAQAYLERIVLEQFQEAVKTIEDENSKQILTKLYQLYALSQIEKNKAWYLEDGYMEAVKTKAVRKIVNQLCWDIRPDAVALVNAFDIPESCLAAPIAV

SEQ ID NO: 324 - protein, 684 aa, Gordonia polyisoprenivorans; identical to SEQ ID NO: 96

SEQ ID NO: 325 - protein, 629 aa, Amycolatopsis mediterranei; identical to SEQ ID NO: 134

SEQ ID NO: 326 - protein, 680 aa, Populus trichocarpa
MAQESSINRASRRTRILNNHLVQSPSDPTSCLRSNSCLSYTPPEETESLDFDTKEMRKILDLHNLEDRDWLFGVIKQGKVFNGKERGGRLFVLPEYNQTMEQQREMTMKRIEYLFERGVFDGWLMKKGVEAELKKLAFLDVIQNFDQSLAVMLGVHFFLWGGAIQFMGTKRHHDKWLRDTETFGLKGCFSMTELGHGSNVRGIETVTTYDLKTGEFVINTPCESAQKYWIGGAANHATHTIVFSQLNIDGVNQGVHAFIAQIRDADGNICPNIRIAECGHKIGLNGVDNGRIWFDNLRIPRENLLNSVADVSPDGQYLSAIKDPDQRFAAFLAPLTSGRVTIATSAVFSSKVGLATAIRYSLGRRAFSVTPNGPEVLLLDYPSHQRRLLPLLAKSYAMTFGGNYLKMTYVNRTPGSAKTLHVVSSAFKAIFTWHNMRTLQECREACGGQGLKTENKIGHLKGEFDVQSTFEGDNNVLMQQVSKALLSEYAAAKKKNKPFKGLGLEHMNGPVPVIPSNLTSSTLRSSQFQMNAFCLRERDLLNRFAAEVSLYQSKGESKEHAFILSYQLAEDLGRAFSDRAILQTFIDAEANVSAGSLKNVLGLLRSMYALICLEEDAAFLRYGYLSTDNAAAVRKEVTKLCGELRPHALALVSSLGIPDAFLGPIAFNWIDANSWSSVKH

SEQ ID NO: 327 - protein, 680 aa, Populus trichocarpa
MAQESSINTASRRTRILNNHLVQSPSKPTSCLQSNSCLSYSPPELTESFDFDIKEMRKILDFHNLEDRDWLFGVIKQGRVFNGKERGGRLFVSPDYNQTMEQQREMTMKRIEYLLERGAFDGWLTKKGVEAELKKLALLEAIQIFDHSLAIKIGVHFFLWGGAIQFMGTKRHHDKWLRDTETFAIKGCFSMTELGHGSNVRGIETVTTYDSKTGEFVINTPCESAQKYWIGGAANHATHTIVFSQLNINGVNEGVHALIAQIRDVNGNICPNICIADCGHKIGLNGVDNGRIWFDNVRIPRENLLNSVADVSPDGQYLSAIKDQDQRFAAFLAPLTSGRVTIATSAIYSSKIGLAIAIRYALSRRAFSITPNGPEVLLLDYPSHQRRLLPLLAKSYAMSFGGNYLKMMYVNRTPESAKTLHVVSSAFKAIFTWHNMRTLQECREACGGQGLKTENRVGHLKGEFDVQSTFEGDNNVLMQQVSKALLSEYVAAKKKNKPFKGLGLEHMNGPVPVIQSNLTSTTLRNSQFQMNAHCLRERDLLNRFAAEVSLYQSKGESKERAFILSYQLAEDLGRAFSDRAILQTFIDAEANVSAGSLKNVLGLLRSMYALICLEEDAAFLRYGYLSTDNAAAVRNEVTKLCGELRPHALALVSSLGIPDAFLSPIAFNWIDANSWSSVQK

SEQ ID NO: 328 - protein, 437 aa, Populus trichocarpa
MAIPKNQDEVEQNARSSYFNLPPLDVSVAFPQATPASTFPPSVSDYFQISDLLTAEDQAIRMRVRQCMEKEIAPIMAEYWEKAKFPFHVIPKLGALGIAGGTIKGYGCPGLSITTSAVAIAEVARVDASCSTFILVHSSLAMLTIALCGSEEQKQKYLPSLAKFSTVACWALTEPDYGSDASSLQTTATKVEGGWILEGQKRWIGNSTFADLLVIFARNTTTDQINGYIVKKDAPGLTVTKIENKIGLRIVQNGDIVMKRVFVPDEDRLPGVNSFQDTNKVLAVSRVMVAWQPIGISMGVYDMCHRYLKERKQFGAPLAAFQINQQKLVHMLGNVQAMVLVGWRLCKLYEKGTMTPGHASLAKSWISLKARETAAIGRELLGGNGILSDFLVAKAMGDLEPIYTYEGTYDINSLVTGREITGLASFKPAMLSKRSRL

SEQ ID NO: 329 - protein, 664 aa, Populus trichocarpa
MKGVDHLAHERNKTEFDVDAMKIVWAGSRHAFELSDRMARLVASDPAFQKDGRTRLGRKELFKNTLRKAAHAWKRILELRLTEEEAGWLRSFVDEPSFTDLHWGMFIPAIKGQGTDEQQQKWLPLAYKMQIIGCYAQTELGHGSNVQGLETTATFDPETDEFVIHSPTLTSSKWWPGGLGKVSTHAIVYARLITNGQEHGVHGFIVQLRSLDDHMPLPGLTIGDIGMKFGNGAYNTMDNGVLKFDHIRIPRNQMLMRVLQVTREGKCVQSNVPRQLIYGTMVFVRQTIVADASTALSRAVCIATRYSAVRRQFGSQDGGMETQVIDYKTQQSRLFPLLASAYAFRFVGEWLKWLYTDVTQRLQANDFSTLPEAHACTAGLKSLTTTATADAIEECRKLCGGHGYLCASGLPELFAVYVPACTYEGDNVVLLLQVARFLMKTVSQLGSGKKPVGTTAYLGRVQDLLQCCCDVQTAEDWLKPSVVLEAFEARSARMCVARAQNLSKFENPEDGFAELSADLVEAAVAHCQLIVVSKFIDKLQQDIPGKGVNQQLQNLCYIYALNLLHKYLGDFLSTGCITPKQASLANDQLRSLYSKIRPNAIALADAFNYTDHYLGSVLGRYDGNVYPKLYEEAWKDPLNDSVVPDGYHEYVHPMLKQQLRNARL

SEQ ID NO: 330 - protein, 689 aa, Populus trichocarpa
MEQKKQNPKAEDETQIVSRRIQRISLHITPIPRPLHDHDSNLGLLPCARREKLEVETEKLSVYMRGKYRDIQEKIYEYFNARPELQTPVEISKDEHRELCWRQMYGLIREAGIRPLKYVVEEPAKYFAIVEAVGAVDISLGIKLGVQYSLWGGSVINLGTKKHKDKYFEKIDSLEYPGCFAMTELHHGSNVQGIQTVATFDPITDEFTINTPNDGAIKWWIGNAAVHGKFASVFAKLMLPTHDAKGVSDMGVHAFIVPLRDLKTHQALPGIEIHDCGHKVGLNGVDNGALRFTSVRIPRDNLLNRFGDVSRDGKYTSSLPTINKRFAATLGELVGGRVGLAYSSVGVLKIANTIAIRYSLLRQQFGPPKQPEISILDYQSQQHKLMPMLASTYAFHFATVYLVEIYSQMKMTHNEQLVGDVHALSAGIKAYVTSYTAKSLSVCREACGGHGYAAVNRFGTLRNDHDIFQTFEGDNTVLLQQVAADLLKQYKEKFQGGTLAVTWNYLRESMNTYLSQPNPVTSRWEGAEHLQDPKFQLDAFRYRTSRLLQSAAVRLRKHSKTLGGFGAWNRCLNHLLTLAESHIESVILAKFIEAVEKCPDASSQAALKLVCDLYALNRIWNDIGTYRNVDYVAPNKAKAIHKLTDYLSFQVRNIAKELVDAFDLPDHVTRAPIAMQSEAYARYTHHVGF

SEQ ID NO: 331 - protein, 436 aa, Populus trichocarpa
MSIPKNKDEVEQNPRSSYFNLPPLDVSVAFPQATPVSTFPPSVSDYYQFSDLLTVEDQALRMRVRECMEKEIAPMMTEYWEKAKFPFHAIPKLGALGIAGGTIKGYGCPGLSITASAIAMAEVARVDASCSTFILVHSLAMLTIAFCGSEEQKLKYLPSLAQFSTVACWALTEPDYGSDASGLKTTAIKVEGGWILEGKKRWIGNSTFADLLVVFARNTTTNQINGFIVKKDAPGLTVTKIENKIGLRIVQNGDIVMKRVFVPDEDRLPGVNSFQDTNKVLAVSRIMVAWQPIGISMGVYDMCHRYLKERKQFGAPLAAFQINQQKLVHMLGNVQAMVLVGWRLCKLYEKEKMTPGQASLAKAWISLKARETASIGRELLGGNGILADFLVAKALCDLEPIYTYEGTYDINSLITGREITGLASFKPAMLSKRSRM

SEQ ID NO: 332 - protein, 691 aa, Populus trichocarpa
MEQKKQNPTAENETLIVSRRIQRVSLHLAPVPRPLHEHDTQEQLGLFPCARSAKLEVETEKLSLYMRGKYREIQEKIYEYFHARPELQTPLEISKDDHRELCWRQMYGLIKEAGIRPLKYVVEDPGKYFAIVEAAGAVDIFLGIKLGVQYSLWGGSVINLGTKKHKDKYFEGIDSLEYPGCFAMTELHHGSNVQGLQTVATFDPITDEFIINTPNDGAIKWWIGNAAVHGKFASVFAKLMLPAHDAKGVSDMGVHAFIVPIRDLKTHQALPGIEIHDCGHKVGLNGVDNGALRFTSVRIPLDNLLNRFGDVSPDGKYTSSLPTINKRFAATLGELVGGRVALASSSTSVLKIANAIAIRYSLLRQQFGPPKQPEVSILDYQSQQHKLMPMLASTYAFHFATSYLVEIYSQMKTTHVEQLVGDVHTLSAGLKAYVTSYTAKSLSVCREACGGHGYAAVNRFGILRNDHDIFQTFEGDNTVLLQQVAADLLKQYKQKFQGGTLAVTWNYLRESMNTYLSQPNPVTARWEGTEHLRDPKFQLDAFRYRTSRLLQSAAVRLRKHSKTLGGFGAWNRCLNHLLTLAESHIESVILAKFIETVEKCPDASTRAALKLVCDLYALNQIWNDIGTYRNVDYVAPNKAKAIHKLTDYLSFQVRNIAKELVDAFDLPNHVTRAPIAMQSEAYAQYTQYVGF

SEQ ID NO: 333 - protein, 639 aa, Populus trichocarpa
MEGVDILPHERSKKQFDVDAMKIVWAGSRQAFEVSDRMARLVASDPAFQKDNRSRLGRKELFKNTLRKATYAWKRIIELRLTEEEAGRLRFFVDEPAFTDLHWGMFVPAIKGQGTEEQQQKWLPLAYKMQIIGCYAQTELGHGSNVQGLETTATFDPDKDEFVIHSPTLTSSKWWPGGLGKVSTHAVVYARLITNGEEHGVHGFIVQLRSLDDHMPLPGITIGDIGMKFGNGAYNTVTREGKCVQSNVPRQLIYGTMVFVRQTIVADASSALSRAVCIATRYSAVRRQFGSQDGVETQVIDYKTQQNRLFPLLASAYAFRFVGEWLKWLYTDVTQRLQANDFSTLPEAHACTAGLKSLTTTATADAIEECRKLCGGHGYLCASGLPELFAVYVPACTYEGDNVVLLLQVARFLVKTVSQLGSGKEPIGTTAYLGRVQDLMQCCCEVQTAEDWLKPSVMLEAFEARSARMCVARAQNLSKFANPEDGFAELSADLVEAAVAHCQLIVVSKFFDKLQQDIPGNGVKQQLQNLCYIYALNLLHKHLGDFLSTGCITPKQASLANDQLRSLYSQVRPNAIALVDAFNYTDHYLGSVLGRYDGNVYPKLYEEAWKDPLNDSVLPDGYNEYIRPMLKQQLHNARL

SEQ ID NO: 334 - protein, 768 aa, Salinibacter ruber
MLDTDSPRVRAVLPLLYVAWADGVLTPSEAETIRGHLRTQEWLDASTREAICDHLDPQSPPTPTQYFRWIRTLRDGAGDAAVTTRSSLAELGMALANVGGDGTALPEASRRALEDIEAALNIDGEEVVRDLLGERPEPSPVEPEAPFDTDAMRRLLDGPHAELREDIRTLLQDPVFEYQDGLGTEAYREQVLRWCEHLADQGLGALAYPDAYGGGGDMEKFIVAFETLAYHDLSLVVKFGVQFGLFGGSIHHLGTERHHEEYLDRVGTLDLPGCFAMTEWGHGSNVRELETTARYDPTTEEFVINTPHDGARKEWIGNAAAHGQVATVFAQLRTDGEEHGVHAFLVPIRADDGTPKPRVRIEDCGEKVGLNGVDNGRLWFDQVRIPRANLLDRYAQVAPDGTYDSPIPSSGKRFFTMLSTLIGGRISVARAGLSATKSGLTIAVRYGNRRRQFGPKDEPEVPLLDYRTHKRRLLPRLATTYALHFALDDLTARFARKGRGESLEAIEAEANALKAYATWHTSATLQEAREACGGQGYRADTRIGRLRADTDVFTTFEGDNTVLMLQVAKGLLSDFQREFRDMNLWGMARLVADEVATQVQELNPVVTRTTDPDHLRALPFQQSALTYRAEKQLQNVGRRLQRRIDDGMEPFDAFVDVQDHLVQCARADAERVILERFADAVEGVEDADLRETLTTLRRLFALSRIEADLDWFLEAGYVSGSKAKAIRGAVNDLCDEVRPQAEALVNAFGIPDALLGAPIATKPGPGPK

SEQ ID NO: 335 - protein, 650 aa, Mycobacterium intracellulare; identical to SEQ ID NO: 285

SEQ ID NO: 336 - protein, 650 aa, Mycobacterium intracellulare; identical to SEQ ID NO: 277

SEQ ID NO: 337 - protein, 650 aa, Mycobacterium intracellulare; identical to SEQ ID NO: 277

SEQ ID NO: 338 - protein, 613 aa, Nocardia cyriacigeorgica; identical to SEQ ID NO: 282

SEQ ID NO: 339 - protein, 640 aa, Mycobacterium smegmatis; identical to SEQ ID NO: 286

SEQ ID NO: 340 - protein, 617 aa, Streptomyces cattleya
MTPELTAARAELAALAHVGCDPALRTETLAALSADPPCAVRHGGRAQAALLRLAPRLPPAGALLADPHRLADVQAWAAVVDPAVYMALVNHYVLCLGSVTEFGAAAPLQSCVTALQEGAAKGVYLVTEIGRAGSHLGVRTTAVYDAERREFVLTTPDAAAAKFSSVTPHGVRVLAVVIARTVVDGADRGAFPFLVDLTGTDGPAPGVEISGPLQVSALPLEYALIRFRGVRVPAERWLSDRAWLDPVGRLHDPLGSPDARLRRTMSVGQRLWATVPAAMAAMARECAVSALRFSGGRSSRGGPVPGTPLLARRTQQRALFGALAESYALTCAAEAALDVWPATAHGGTGEGGAPSPAAAFSPWVAVDRSLALFKALATEGAARVAAVCRRHCGLAGFLDLNRLAGYHGAARAFTVAGGDNQLIFLDAGRAALTAPDPAPQPPAPAEPGAGHPTVPDAHTWWLRTARAHEQRLAAELRHAVTAHQADGRTGADLWNPLLPRARDLGEATAATMLARCVHDTTDHLTSPELRAALRPLAALFGVAQAQRHAGALVATGVLPPRTLRSLPETADRLCEALLPHLPLLRAGLTTPVPERPVPLVAPDYAGALWDAVRVPCG

SEQ ID NO: 341 - protein, 661 aa, Rattus norvegicus
MNPDLRKERASATFNPELITHILDGSPENTRRRREIENLILNDPDFQHEDYNFLTRSQRYEVAVKKSATMVKKMREYGISDPEEIMWFKKLYLANFVEPVGLNYSMFIPTLLNQGTTAQQEKWMRPSQELQIIGTYAQTEMGHGTHLRGLETTATYDPKTQEFILNSPTVTSIKWWPGGLGKTSNHAIVLAQLITQGECYGLHAFVVPIREIGTHKPLPGITVGDIGPKFGYEEMDNGYLKMDNYRIPRENMLMKYAQVKPDGTYVKPLSNKLTYGTMVFVRSFLVGNAAQSLSKACTIAIRYSAVRRQSEIKQSEPEPQILDFQTQQYKLFPLLATAYAFHFVGRYMKETYLRINESIGQGDLSELPELHALTAGLKAFTTWTANAGIEECRMACGGHGYSHSSGIPNIYVTFTPACTFEGENTVMMLQTARFLMKIYDQVRSGKLVGGMVSYLNDLPSQRIQPQQVAVWPTMVDINSLEGLTEAYKLRAARLVEIAAKNLQTHVSHRKSKEVAWNLTSVDLVRASEAHCHYVVVKVFSDKLPKIQDKAVQAVLRNLCLLYSLYGISQKGGDFLEGSIITGAQLSQVNARILELLTLIRPNAVALVDAFDFKDMTLGSVLGRYDGNVYENLFEWAKKSPLNKTEVHESYHKHLKPLQSKL

SEQ ID NO: 342 - protein, 681 aa, Homo sapiens
MGSPVHRVSLGDTWSRQMHPDIESERYMQSFDVERLTNILDGGAQNTALRRKVESIIHSYPEFSCKDNYFMTQNERYKAAMRRAFHIRLIARRLGWLEDGRELGYAYRALSGDVALNIHRVFVRALRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 343 - protein, 681 aa, Rattus norvegicus
MGSPMHRVSLGDHWSWQVHPDIDSERHSPSFSVERLTNILDGGLPNTVLRRKVESIIQSDPVFNLKKLYFMTREELYEDAIQKRFHLEKLAWSLGWSEDGPERIYANRVLDGNVNLSLHGVAMNAIRSLGSDEQIAKWGQLCKNFQIITTYAQTELGHGTYLQGLETEATYDEARQELVIHSPTMTSTKWWPGDLGWSVTHAVVLAQLTCLGVRHGMHAFIVPIRSLEDHTPLPGITVGDIGPKMGLEHIDNGFLQLNHVRVPRENMLSRFAEVLPDGTYQRLGTPQSNYLGMLVTRVQLLCKGILPSLQKACIIATRYSVIRHQSRLRPSDPEAKILEYQTQQQKLLPQLAVSYAFHFTATSLSEFFHSSYSAILKRDFSLLPELHALSTGMKATFADFCAQGAEICRRACGGHGYSKLSGLPTLVARATASCTYEGENTVLYLQVARFLMKSYLQAQASPGATPQKPLPQSVMYIATQRPARCSAQTAADFRCPDVYTTAWAYVSTRLIRDAAHRTQTLMKSGVDQHDAWNQTTVIHLQAAKAHCYFITVKNFKEAVEKLDKEPEIQRVLQRLCDLYALHGVLTNSGDFLHDGFLSGAQVDMAREAFLDLLPLIRKDAILLTDAFDFSDHCLNSALGCYDGHVYERLFEWAQKYPANTQENPAYKKYIRPLMLGWRHKM

SEQ ID NO: 344 - protein, 681 aa, Oryctolagus cuniculus
MGIPVHRVSLGDAWSSRMHPDMESERCAQSFSVERLTNILDGGAQHTALRRKVESIIHGNPQFSSKDNYFMSQNELYEAATRKRYHLQKIAQRMGWTEEGRELEYAHRALSADLNLNLQGIFLKALRSLGSEEQIAKWEPLGKTFQIISTYAQTELGHGTYLQGLETEATYDAATQEFVIHSPTVTATKWWPGDLGRSATHALILAQLICSGARRGMHAFIVPVRSLQDHTPLPGITIGDIGPKMGLQHIDNGFLKMDHVRVPRENMLSRFAQVLPDGAYIKLGTAQSNYLGMLVTRVHLLLGAILSPLQKACVIATRYSVIRHQCRLRPSDPEVKILEHQTQQQKLFPQLAMCYAFHFLATGLLEFFQQAYKNILDRDFTLLPELHALSTGTKAMMSDFCTQGAEQCRRACGGHGYSKLSGLPSLVTSVTASCTYEGENTVLYLQVARFLVKSCLQAQGFPGSTSQRSLPRSVSYLALPDLARCPAQTAADFFCPALYTAAWAHVAARLTKDSVHHLQALRQSGADEHEAWNQTTIIHLQAAKAHCYYISVKSFKEALEKLENEPAIQQVLKRLCDLHALHGILTNSGDFLHDGFLSGAQVDMARTAYMDLLPLIRKDAILLTDAFDFTDQCLNSALGCYDGNVYERLFEWAQRSPTNTQENPAYKKYIQPLLQSWRSNL

SEQ ID NO: 345 - protein, 681 aa, Mus musculus
MGNPGDRVSLGETWSREVHPDIDSERHSPSFSVERLTNILDGGIPNTELRRRVESLIQRDPVFNLKHLYFMTRDELYEDAVQKRFHLEKLAWSLGWSEDGPERIYADRVLAGYNNLNLHGIAMNAIRSLGSDEQIAKWGQLGKNFQIITTYAQTELGHGTYLQGLETEATYDATTQEFVIHSPTMTSIKWWPGDLGRTVTHAVVLAHLICLGARHGMHAFIVPIRSLEDHTPLPGITVGDIGPKMGFENIDNGFLRLNHVRVPRENMLSRFAEVLPDGTYQRLGTPQSNYLGMLVTRVQLLYKGFLPTLQKACTIAVRYAVIRHQSRLRPSDPEAKILEYQTQQQKLLPQLAVSYALHFMTTSLLQFFHSSYSDILKRDFSLLPELHALSTGMKAMSSDFCAQGTEICRRACGGHGYSKLSGLPTLVTQAIASCTYEGENTVLYLQVARFLMKSYLQAQVSPGSIPQKPLPQSVMYLATPRPARCPAQTAADFRCPEVYTTAWAYVSARLIRDATQHTQTLMRSGVDQYDAWNQTSVIHLQAAKAHCYFLTVRNFKEAVEKLDNEPEIQRVLQNLCDLYALNGILTNSGDFLHDGFLSGAQVDMARTAFLDLLPLIRKDAILLTDAFDFSDHCLNSALGCYDGHVYQRLFEWAQKSPANTQENPAYKKYIRPLMQSWKPKL

SEQ ID NO: 346 - protein, 660 aa, Homo sapiens
MNPDLRRERDSASFNPELLTHILDGSPEKTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 347 - protein, 675 aa, Arabidopsis thaliana; identical to SEQ ID NO: 103

SEQ ID NO: 348 - protein, 709 aa, Candida tropicalis
MTFTKKNVSVSQGPDPRSSIQKERDSSKWNPQQMNYFLEGSVERSELMKALAQQMERDPILFTDGSYYDLTKDQQRELTAVKINRIARYREQESIDTFNKRLSLIGIFDPQVGTRIGVNLGLFLSCIRGNGTTSQLNYWANEKETADVKGIYGCFGMTELAHGSNVAGLETTATFDKESDEFVINTPHIGATKWWIGGAAHSATHCSVYARLIVDGQDYGVKTFVVPLRDSNHDLMPGVTVGDIGPKMGRDGIDNGWIQFSNVRIPRFFMLQKFCKVSAEGEVTLPPLEQLSYSALLGGRVMMVLDSYRMLARMSTIALRYAIGRRQFKGDNVDPNDPNALETQLIDYPLHQKRLFPYFVPPMSSPSVPSRLNTPSRPPWSNWTSPLKRTTPRLIFKSIDDMKSLFVDSGSLKSTATWLGAEAIDQCRQACGGHGHSSYNGFGKAYNDWVVQCTWEGDNNVLGMSVGKPIVKQVISIEDAGKTVRGSTAFLNQLKEYTGSNSSKVVLNTVADLDDIKTVIKAIEVAIIRLSQEAASIVKKESFDYVGAELVQLSKLKAHHYLLTEYIRRIDTFDQKELAPYLITLGKLYAATIVLDRFAGVFLTFNVASTEAITALASVQIPKLCAEVRPNVVAYTDSFQQSDMIVNSAIGRYDGDIYENYFDLVKLQNPPSKTKAPYSDALEAMLNRPTLDERERFQKSDETAAILSK

SEQ ID NO: 349 - protein, 700 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 350 - protein, 700 aa, Rattus norvegicus
MGSSSERRDSVLWSDIPKGPLSAYRARASFNSKELMLFWDGQDVLDFKKTIFSTLENDPLFARPFGADLPLEKERELNFLRCKRVFEYGFFNAEDMLKNPLKILVLMNCLGMYDWSLANKCVLHMLVFGSTIIGSGSEHHFKYLEKIYNLEIFGCFALTELSHGSNTKAMRTTAHYDPATQEFILHSPDFEAAKFWVGNLGKTATHAVVFAQLYTPDGQCRGLHSFLVQIRDPKTLLPMPGVMVGDMGKKLGQNGLDNGFAMFHKVRIPRQNLLDRTGNVTSEGHYHTPFKDVRQRLGASLGSLSSGRISIISISVVNLKLAVIIAIRFSATRRQFGPTDKEEIPVLEYPLQQWRLLPYLAAAYALDHFSKTIFLDLIELQRAGKVGTTVTGRQSSGREIHALASAGKPLASWTAQRGIQECREVVGGHGYLAMNRFGELRNDNDPNCTYEGDNNVLLQQTSNYLLSLLEHPLQDGAHFTSPLKTVNFLEAYPGILGQKFMASSKADWLDSEAPLAAYRWLVCYLLRESHQRYCQEKKSRGSDFEARNNSQVYGCRPLALAFMELTVMQRFHEHTHSSSVPPSLRTVLGRLSMLYGLWCLSQHTALLYRGGYISGEQTGKAMEDAILMLCVQLKDDAVALVDAIAPSDFVLGSPIGRADGELYKNLWAAVLQQSGVLERAAWWPEFTANKSVANRLKSQL

SEQ ID NO: 351 - protein, 700 aa, Pongo abelii
MASTVEGGDTALLPEFPGGPLDAYRARASFSWKELALFTEGEDMLRFKKTIFSALENDPLFARSPGADLSLEKYRELNFLRCRRIFEYDFLSVEDMFKSPLKVLTLIQCLGMYDSSLAAKYLIHSLVFGSAIYSSGSERHLTYIQKIFRMEIFGCFALTELSHGSNTKAIRTTAHYDPATEEFIIHSPDFEAAKFWVGNMGKTATHAVVFAKLYVPGDQCHGLHPFIVQIRDSKTLLPMPGVMVGDIGKKLGQNGLDNGFAMFHKVRVPRQSLLNRMGDVTPEGTYVSSFKDVRQHFGATLGSLSWSRVSIVSLAILNLKLAVAIALRFSATRRQFGPTEEEEIPVLEYPMQQWRLLPYLAAIYALDHFSKSLFLDLMELQQGLASGDRSARQAELGREIHALASASKPLASWTTQQGIQECREACGGHGYLAMNRLGVLRDDNDPNCTYEGDNNILLQQTSNYLLGLLAHQVQDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPCVPPSLRAVLGRLSALYALWSLSRHAALLYRGGYFSGEQAGEVLESAVLALCSQLKDDAVALVDVIAPPDFILDSPIGRADGELYKNLWGAILQESKALERASWWPEFSVNKPVIGSLKSKL

SEQ ID NO: 352 - protein, 700 aa, Mus musculus
MGSLPEEKDSALWSDTPKGPLSAYRARASFNSGELLLFWDGQDVIHFKKTIFSTLENDPLFARSYGADLPLEKLRELNFLRCKRVFEYGFFKVEELLKNPLKILVLINCLGMYDWSLANKCVLHMLVFGTTVFVSGSEKHFKYLEKIYSLEIFGCFALTELSHGSNTKAMRTTAHYDPDTQEFILHSPDFEAAKFWVGNLGKTATHAVVFAQLYMPDGQCHGLHSFLVQIRDTKTLLPMTGVMVGDIGKKLGQNGLDNGFAMFNKVRIPRQNLLDRTGNITSEGTYNSPFKDVRQRLGASLGSLSSGRISIISMSVVNLKLAVSIAIRFSATRCQFGPTDKEEIPVLEYPLQQWRILPYLAAAYALDHFSKTIFMDLIEVQSARLRGDHSDQQAELGREIHALASAGKPLASWTAQRGIQECREACGGHGYLAMNRFGDLRNDNDPNCTYEGDNNVLLQQTSNYLLSLLEPPLQDGAHFTSPLKTVDFLEAYPGILGQKFLGSSKADWMDSAAPLAAYRWLVCYLLQESHRRYCQEKKSRGSDFEARNNSQVYGCRPLALAFMELTVMQRFHEHIHSSGLSPSLRTVLGRLSTLYGLWCLSQHMALLYRGGYISGEQTGRAMEDAILTLCEQLKDDAVALVDVIAPSDFVLNSPIAKADGELYKNLWAAVLQQNGVLERAAWWPEFSANKSVADRLKSQL

SEQ ID NO: 353 - protein, 600 aa, Streptomyces coelicolor; identical to SEQ ID NO: 51

SEQ ID NO: 354 - protein, 436 aa, Arabidopsis thaliana
MAVLSSADRASNEKKVKSSYFDLPPMEMSVAFPQATPASTFPPCTSDYYHFNDLLTPEEQAIRKKVRECMEKEVAPIMTEYWEKAEFPFHITPKLGAMGVAGGSIKGYGCPGLSITANAIATAEIARVDASCSTFILVHSSLGMLTIALCGSEAQKEKYLPSLAQLNTVACWALTEPDNGSDASGLGTTATKVEGGWKINGQKRWIGNSTFADLLIIFARNTTTNQINGFIVKKDAPGLKATKIPNKIGLRMVQNGDILLQNVFVPDEDRLPGVNSFQDTSKVLAVSRVMVAWQPIGISMGIYDMCHRYLKERKQFGAPLAAFQLNQQKLVQMLGNVQAMFLMGWRLCKLYETGQMTPGQASLGKAWISSKARETASLGRELLGGNGILADFLVAKAFCDLEPIYTYEGTYDINTLVTGREVTGIASFKPATRSRL

SEQ ID NO: 355 - protein, 690 aa, Cucurbita sp.
MASPGEPNRTAEDESQAAARRIERLSLHLTPIPLDDSQGVEMETCAAGKAKAKIEVDMGSLSLYMRGKHREIQERVFEYFNSRPELQTPVGISMADHRELCMKQLVGLVREAGIRPFRFVNEDPAKYFAIMEAVGSVDVSLAIKMGVQFSLWGGSVINLGTKKHRDRFFDGIDNVDYPGCFAMTELHHGSNVQGLQTTATFDPITDEFIINTPNDGAIKWWIGNAAVHGKFATVFAKLVLPTHDSRKTADMGVHAFIVPIRDLKSHKTLPGIEIHDCGHKVGLNGVDNGALRFRSVRIPRDNLLNRFGEVSRDGKYKSSLPSINKRFAATLGELVGGRVGLAYSSASVLKIASTIAIRYSLLRQQFGPPKQPEVSILDYQSQQHKLMPMLASTYAFHFSTMQLVEKYAQMKKTHDEELVGDVHALSAGLKAYVTSYTAKSLSTCREACGGHGYAVVNRFGTLRNDHDIFQTFEGDNTVLLQQVAAYLLKQYQEKFQGGTLAVTWNYLRESMNTYLSQPNPVTARWESADHLRDPKFQLDAFQYRTSRLLQSVAVRLRKHTKNLGSFGAWNRCLNHLLTLAESHIESVILAQFIESVQRCPNANTQATLKLVCDLYALDRIWNDIGTYRNVDYVAPNKAKAIHKLTEYLCFQVRNIAQELVDAFDLPDHVTRAPIAMKSNAYSQYTQYIGF

SEQ ID NO: 356 - protein, 690 aa, Cucurbita sp.; identical to SEQ ID NO: 355

SEQ ID NO: 357 - protein, 743 aa, Clavibacter michiganensis; identical to SEQ ID NO: 52

SEQ ID NO: 358 - protein, 671 aa, Ciona intestinalis
MSKQSRLLEEERRKVNFSVEELTNIYDGGVEQTEMKRKVEAAIHNDPECRCKDVGMMTREERFNDGMRRTIHLNKVVFPREGWNAFSKELDYVLRNIGKEFCLGIHTGVFLPCILSFGSDEQIAKWLPLGAQLQIIGTYAQTELGHGTFLRGLQTVATYDKASQEFVINCPEISAMKWWPGDMGKSANHALVMAQVVIDGKKYGMHPFIVQIRDLTTHMPLPGITVGDIGNKVGFETTDNGFLHFNKVRIPRENLLCKNSEVKPDGTYVAKTKDKMVYGSMVRLRAIFLEGEVVSALGKACTIAVRYSLVRQQGELEPGKPEVAVMEYMTQQKKLLPYVAMTYATHFACLKLKKMYNIFEQKVKEGDLSGLPELHALSAGMKASVAEQCTDGIEILRKSCGGHGYSNASGIPIIWARAVAGCTYEGENTVMYLQCARYLVKCYNQVQTNRLHGTVAYLNNMNQSTCRVNKANDFQQPAVLVACFQYRAREVIKSVAMKINHLTKNGYPNHEAWNKCSVELVNVVKAHITQYIVATFASVIDELSCSPPVKTVLLQMCALYALENITLYSGDFLKVGYLSPKQCDLALEAELDLLSCLRPNAVGLVDAFDYSDDLLQSCIGAYDGNVYERLFEWAKKSPLNKTEVHEETYKYLKPYLHAGRDILEGKTKSKL

SEQ ID NO: 359 - protein, 609 aa, Pseudomonas fluorescens
MTHPSNPGTVAPLARDELRDLLFAGTFESHHQSIREVLLDPIFDPQPGLNMEQAGRLAYARSRHVHAALERPLQILANPRRLFALAEWPSLLDVASFSLLMVHYNLCLGTVFDHAQGRPDIAGLTEALDELTSFGPYMATELGFGNNVAALQTEAVYDRHSQTFTLNTPSAGAQKYMSYSGFGDIPKVATVMARLKIEGKDHGVFPFLIRLSTEAGLCPGIRAALCPEKPVQGLDNGLTWFDNVRVPRSSLLHGDMGHFAEDGSFVLGAGNARSRFLRAMSRIVPGRLCVASAAQGASRASLYIALRYGQQRLTNAPGTNDMPVIEYRSYQRAMFSALASTYAMTLLLNEAKARFLANTAEPAADVVSLINITKALATWDASAVIAECRERCGAQGIFSVNRIADYGSLLQGLVTAEGDNLVLLATVAGQLLAQAWQGPLPLRPARARRLAEPEWLIAAIAFREYQLWLTVREEMNADERGYFEVWNDAMNPGLELARLRGERLALEQLWSAALHAQQDEAKAALNGLASLYGLNLLQRDAAWFLAHELIDAGQALSLPGRIDQQCVALRPCVSTLIDGFALSPELLRAPIAEGDYIQAFCKQVHANVD

SEQ ID NO: 360 - protein, 609 aa, Pseudomonas fluorescens; identical to SEQ ID NO: 359

SEQ ID NO: 361 - protein, 700 aa, Yarrowia lipolytica
MISPNLTANVEIDGKQYNTFTEPPKALAGERAKVKFPIKDMTEFLHGGEENVTMIERLMTELERDPVLNVSGDYDMPKEQLRETAVARIAALSGHWKKDTEKEALLRSQLHGIVDMGTRIRLGVHTGLFMGAIRGSGTKEQYDYWVRKGAADVKGFYGCFAMTELGHGSNVAGLETTATYIQDTDEFIINTPNTGATKWWIGGAAHSATHTACFARLLVDGKDYGVKIFVVQLRDVSSHSLMPGIALGDIGKKMGRDAIDNGWIQFTNVRIPRQNMLMKYAKVSSTGKVSQPPLAQLTYGALIGGRVTMIADSFFVSQRFITIALRYACVRRQFGTTPGQPETKIIDYPYHQRRLLPLLAFTYAMKMAADQSQIQYDQTTDLLQTIDPKDKGALGKAIVDLKELFASSAGLKAFTTWTCANIIDQCRQACGGHGYSGYNGFGQAYADWVVQCTWEGDNNVLCLSMGRGLIQSCLGHRKGKPLGSSVGYLANKGLEQATLSGRDLKDPKVLIEAWEKVANGAIQRATDKFVELTKGGLSPDQAFEELSQQRFQCAKIHTRKHLVTAFYERINASAKADVKPYLINLANLFTLWSIEEDSGLFLREGFLQPKDIDQVTELVNHYCKEVRDQVAGYTDAFGLSDWFINAPIGNYDGDVYKHYFAKVNQQNPAQNPRPPYYESTLRPFLFREDEDDDICELDEE

SEQ ID NO: 362 - protein, 436 aa, Arabidopsis thaliana; identical to SEQ ID NO: 354

SEQ ID NO: 363 - protein, 661 aa, Mus musculus
MNPDLRKERAAATFNPELITHILDGSPENTRRRREIENLILNDPDFQHEDYNFLTRSQRYEVAVKKSATMVKKMREFGIADPEEIMWFKKLHMVNFVEPVGLNYSMFIPTLLNQGTTAQQEKWMHPSQELQIIGTYAQTEMGHGTHLRGLETTATYDPKTQEFILNSPTVTSIKWWPGGLGKTSNHAIVLAQLITRGECYGLHAFVVPIREIGTHKPLPGITVGDIGPKFGYEEMDNGYLKMDNYRIPRENMLMKYAQVKPDGTYVKPLSNKLTYGTMVFVRSFLVGSAAQSLSKACTIAIRYSAVRRQSEIKRSEPEPQILDFQTQQYKLFPLLATAYAFHFLGRYIKETYMRINESIGQGDLSELPELHALTAGLKAFTTWTANAGIEECRMACGGHGYSHSSGIPNIYVTFTPACTFEGENTVMMLQTARFLMKIYDQVQSGKLVGGMVSYLNDLPSQRIQPQQVAVWPTLVDINSLDSLTEAYKLRAARLVEIAAKNLQAQVSHRKSKEVAWNLTSVDLVRASEAHCHYVTVKVFADKLPKIQDRAVQAVLRNLCLLYSLYGISQKGGDFLEGNIITGAQMSQVNSRILELLTVTRPNAVALVDAFDFKDVTLGSVLGRYDGNVYENLFEWAKKSPLNKTEVHESYYKHLKPLQSKL

SEQ ID NO: 364 - protein, 700 aa, Yarrowia lipolytica
MNPNNTGTIEINGKEYNTFTEPPVAMAQERAKTSFPVREMTYFLDGGEKNTLKNEQIMEEIERDPLFNNDNYYDLNKEQIRELTMERVAKLSLFVRDQPEDDIKKRFALIGIADMGTYTRLGVHYGLFFGAVRGTGTAEQFGHWISKGAGDLRKFYGCFSMTELGHGSNLAGLETTAIYDEETDEFIINTPHIAATKWWIGGAAHTATHTVVFARLIVKGKDYGVKTFVVQLRNINDHSLKVGISIGDIGKKMGRDGIDNGWIQFTNVRIPRQNLLMKYTKVDREGNVTQPPLAQLTYGSLITGRVSMASDSHQVGKRFITIALRYACIRRQFSTTPGQPETKIIDYPYHQRRLLPLLAYVYALKMTADEVGALFSRTMLKMDDLKPDDKAGLNEVVSDVKELFSVSAGLKAFSTWACADVIDKTRQACGGHGYSGYNGFGQAYADWVVQCTWEGDNNILTLSAGRALIQSAVALRKGEPVGNAVSYLKRYKDLANAKLNGRSLTDPKVLVEAWEVAAGNIINRATDQYEKLIGEGLNADQAFEVLSQQRFQAAKVHTRRHLIAAFFSRIDTEAGEAIKQPLLNLALLFALWSIEEDSGLFLREGFLEPKDIDTVTELVNKYCTTVREEVIGYTDAFNLSDYFINAPIGCYDGDAYRHYFQKVNEQNPARDPRPPYYASTLKPFLFREEEDDDICELDEE

SEQ ID NO: 365 - protein, 661 aa, Phascolarctos cinereus
MNPDLRRERDAASFDAEKLTYILDGGSERTRRRREIENLILNDPDFKHEDLNFLTRSERYEIAVRKSATMVKKMRDFGIADPEEIMWFKKPQLINFVEPVGLTYSMFIPTLLDQGTTAQQQKWLPPTQGLQIIGTYAQTEMGHGTHLRGLETTATYDPKTQEFILNSPTVTSIKWWPGGLGKTSNHAIVLAQLYTKGECYGLHAFIVPIREMGTHKPFPGIIVGDIGPKFGYDEMDNGYLKMDNYRIPRENMLMKYAQVKPDGTYVKPLSNKLTYGTMVFVRSFLVGEAARSLSKACTIAIRYSLIRHQSEIRPGDPEPQILDFQTQQYKLFPLLATAYAFQFVGAYMKETYHRINVDINQGNLNELPELHALTAGLKAFTSWTTNSGIEACRMACGGHGYSHCSGLPNIYVTFTPTCTFEGENTVMMLQTARFLMKSYDQVHSGKLVGGMVSYLNDLPSQRIQPQQVAAWPAMVDINNPDSLTEAYKHRAARLVEAAARNLQAEMKHRKSKEIAWNFTSVDLVRASEAHCHYVVVKLFSGNLSKIDDKPIQAVLTNLCLLYALYGISQNSGDFLQGGILTESQLTQVNQRVKELLTLIRPESAALVDAFDFQDVSLGSVLGRYDGNIYENMFEWAKKSPLNKSEVHESYHKHLKPLQSKL

SEQ ID NO: 366 - protein, 664 aa, Arabidopsis thaliana; identical to SEQ ID NO: 146

SEQ ID NO: 367 - protein, 692 aa, Arabidopsis thaliana; identical to SEQ ID NO: 167

SEQ ID NO: 368 - protein, 690 aa, Cucurbita maxima; identical to SEQ ID NO: 355

SEQ ID NO: 369 - protein, 689 aa, Yarrowia lipolytica
MTTNTFTDPPVEMAKERGKTQFTVRDVTNFLNGGEEETQIVEKIMSSIERDPVLSVTADYDCNLQQARKQTMERVAALSPYLVTDTEKLSLWRAQLHGMVDMSTRTRLSIHNNLFIGSIRGSGTPEQFKYWVKKGAVAVKQFYGCFAMTELGHGSNLKGLETTATYDQDSDQFIINTPHIGATKWWIGGAAHTSTHCVCFAKLIVHGKDYGTRNFVVPLRNVHDHSLKVGVSIGDIGKKMGRDGVDNGWIQFTNVRIPRQNMLMRYAKVSDTGVVTKPALDQLTYGALIRGRVSMIADSFHVSKRFLTIALRYACVRRQFGTSGDTKETKIIDYPYHQRRLLPLLAYCYAMKMGADEAQKTWIETTDRILALNPNDPAQKNDLEKAVTDTKELFAASAGMKAFTTWGCAKIIDECRQACGGHGYSGYNGFGQGYADWVVQCTWEGDNNVLCLSMGRGLVQSALQILAGKHVGASIQYVGDKSKISQNGQGTPREQLLSPEFLVEAFRTASRNNILRTTDKYQELVKTLNPDQAFEELSQQRFQCARIHTRQHLISSFYARIATAKDDIKPHLLKLANLFALWSIEEDTGIFLRENILTPGDIDLINSLVDELCVAVRDQVIGLTDAFGLSDFFINAPIGSYDGNVYEKYFAKVNQQNPATNPRPPYYESTLKPFLFREEEDDEICDLDE

SEQ ID NO: 370 - protein, 709 aa, Candida maltosa; identical to SEQ ID NO: 117

SEQ ID NO: 371 - protein, 660 aa, Bos taurus
MNPDLQKERAGASFNPELLTNVLDGSPENTRRRREIENLILNDPDFQHENLNFLSRSQRYEVAVKKSAIMVQKMRKFGIADPAEIMWFKKLHLVNFVEPVGLNYSMFIPTLLNQGTTAQQEKWLHSSKGLEIIGTYAQTEMGHGTHLRGLETTATYDPETQEFILNSPTVTSIKWWPGGLGKTSNHAIVLAQLFTQGKCYGLHAFIVPIRELGTHKPLPGITVGDIGPKFGYDEMDNGYLKMDNYRIPRENMLMKHAQVKPDGTYVKPLNNKLTYGTMVFIRSFLVGESARSLSKACTIAVRYSAVRHQSEINPGEPEPQILDYQTQQYKLFPLLATAYAFQFVGAYMKETYLRINEDIGHGDLSELPELHALTAGLKAFTSWTTNTAIEACRMACGGHGYSHCSGLPNIYVTFTPTCTFEGENTVMMLQTARFLMKSYDQVHSGKLVCGMVSYLNDLPSQRIQPQQVAVWPTMVDINSPDSLTEAYKLRAARLVEIAAKNLQTEVIHRKSKEVAWNLTSIDLVRASEAHCHYVVVKLFTEKVLQIQEKSIQAVLRRLCLLYSLYGISQNAGDFLQGSIMTESQITQVNGRIKELLTAIRPDAVALVDAFDFQDVTLGSVLGRYDGNVYENLFEWAKKSPLNKTEVHESYKHLKSLQSKL

SEQ ID NO: 372 - protein, 660 aa, Pongo abelii
MNPDLRRERDSASFNPELLTHILDGSPEKTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMGHGTHLRGLETTATYDPETQEFILNSPTVTSIKWWPGGLGKTSNHAIVLAQLITKGKGYGLHAFIVPIREIGTHKPLPGITVGDIGPKFGYDEIDNGYLKMDNYRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDIHSPESLTEAYKLRAARLVEIAAKNLQKEVIHRKSKEVAWNLTSVDLVRASEAHCHYVVVKLFSEKLLKIQDKAIQAVLRNLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 373 - protein, 661 aa, Cavia porcellus
MNPDLRRERAAATFNPELITHLLDGSPEKTRRRREIENKILSDPDFQHENHNFLTRSERYEAAIKKSAVMVKKMREFGIADPDEIMWFKRLLLGNFVEPVGLNYSMFIPTLLNQGTTAQQEKWLHPSTGLQIIGTYAQTEMGHGTHLRGLETTATYDPKTQEFIINSPTVTSIKWWPGGLGKTSNHAIVLAQLITQGKCYGLHAFIVPIREIGTHKPLPGITVGDIGPKFGYEEMDNGYLKMDNYRIPRENMLMKYAQVKPDGTYVKPVSNKLTYGTMVFVRSFLVGAAAQSLSKACTIAIRYSAVRHQSEIKPGEPEPQVLDFQTQQYKLFPILATAYAFQFVGSYMKDTYHRINESIGQGDLSELPELHALTAGLKAFTTWTANAGIEECRLACGGHGYSHCSGIPNIYVTFTPACTFEGENTVMMLQTARFLMKVYDQVQSGKLVHGLVSYLNDLPSQRIQPQQVAVWPTVVDINNPDSLTEIYKLRAARLIDIAAKSLQGEMSHRKSKEVAWNLTSVGLVRATDAHCHYVVVKLFADKLLKIQDKTIQAVLRNLFLLYSLYGISQKAGDFLQGNIMTGSQITQVNQRVLELLAVIRPNAVALVDAFDYKDITLGSVLGRYDGNVYENLFEWAKKSPLNKTEVHESYHKYLKPLQSKL

SEQ ID NO: 374 - protein, 724 aa, Candida tropicalis
MAMLSQPNDGHDHPEKKDPDTTPKQVAGVISSQDPPHPAKDVAEERARTDWDLKEMHEFLEGDEAKSEQILRLYQSIERDPILQTRPEQFDYTQKQERELVANRINQMTKFLETEPYGKFRRRLQLMTVIDPSLGIRMLVNIGLFLNCVRGNGTQKQFDFWSNKKEAGIVKQLYGCFGMTELGHGSNVAGCETTATFDEKTDEFIIDTPHIGATKWWIGGAAHSATHTVCYARLIVKDVDYGVKTFIVPLRDSRHSLLPGIAIGDIGAKMGRQGVDNGWIQFTEVRVPRFFMLQRWCKVDRQGNVTLPPLEQLSYISLLEGRVGMATDSYRIGARYTTIALRYAVGRRQFSKKAGEPETKLIDYTLHQRRLLPYLALTYAAAVGTDRLERQHEELLANLDIALAKKDKLLLKNTITGTKSMFVDSGSLKSTLTWLAADLINETRQACGGHGYSSYNGFGKTYDDWVVQCTWEGDNNVLAMSAGKTIIKTVQQVLNGKELKDSTLEFLNAAPELSKAKKAVIRIRDHVDDVDRVLKAIAGLISKFSKDLIPISYQSWDSIGAQRVILSKLRCHYYLLETFNERLNDKIKAKSPARPHLENIIKLYYVTNILGPFIDEFLRFGVISPQVAKYITYEYPQKLCANIRPYVIGLTDSFQQPDNFINSLIGKYDGNIYTNYLESVKDVNDPSNYKAPYSEALEAMLNRSALENRERSERGKAAADILSK

SEQ ID NO: 375 - protein, 662 aa, Candida tropicalis; identical to SEQ ID NO: 32

SEQ ID NO: 376 - protein, 724 aa, Candida maltosa; identical to SEQ ID NO: 55

SEQ ID NO: 377 - protein, 706 aa, Phaeodactylum tricornutum
MPVNEDLRRERARATFDVKQLTHMLDGGSDRTARRRQLQAIIERDPTGIFSNDDNAYLHRTDRHVRGLAKHVRMVELCRTLGIGDKYDGQVVMDPDFPVLLAALADDLPTALHWIMFVPNIVSLCDEEQQRAWLPLCRDWKMIGCYAQTELGHGSNVRALETTATFVSEDQDGTKGGSFVINSPTITSAKFWPGTLGRTANHAMVIARLIDGHGKDQGMHNFLVPLRSMKDHKLLPGVKSGDIGPKIGYNVMDNGFAQFDNVKIPRRNMAMRFAHVDERGRYSKKSVSAAASKISYITMMQVRAHICNEAGKNLAVACTIVTRYSALRRQGYASDGESELQILDYKQQQHRVFPLIAASYCFFFTGKRVMEQLKDIEDKLVSNKSISKAAVTDIHASSSALKSFTTTVAADGIEDCRKACGGHGFLQCSGLPELITTYLQSPTVEGDNQMLPQQVVKVLLKLVQTVQDDGDLSDYVSCDSYGLISSLQSNLKGVKEDCRIVSEIDVMNLDALLAALCHRSARLLVGVASQIQGSISSGKSYQEAWNDALVEMARVSRAYSQFLLLRNFMEGIDGEERSGAIGVAEVTVLQNLARLFALYWMEKELGDFLEDGYVTADHSRWVRSAVLQLLDCIRTDAVSLVDARDFSDFKLKSALGRYDGDVYPAILKAALRDPLNHSDPGPGYEQHLKRLIAGGTGTYKATVSRL

SEQ ID NO: 378 - protein, 706 aa, Phaeodactylum tricornutum; identical to SEQ ID NO: 377

SEQ ID NO: 379 - protein, 725 aa, Scheffersomyces stipitis
MISLPKELQANSTPQIKIDPKKPSIVTNTIDSEPRPTPAKSIEEERNRTNWDTVKMHQFLEGSPEKSLEILKLYKSLERDTILQSSFEHYDNTKDQDRELVAQRINQMTKFIEIDSPKKFRRRLNLMTVYDPSMGIRIAVNLGLFLNCIRGNGTAAQYEFWAKHRESAIIKQMYGCFGMTELGHGSNVAGCETTATFDEETDEFVIDTPNISATKWWIGGAAHSATHSSVYARLIVKGKDYGVKCFIVPLRDSQHNLCPGVAIGDIGSKMGRQGVDNGWIQFSDVRIPRFFMLQKWCKVDRHGNVTLPPLEQLSYISLLGGRVDMAVDSYRQGARFMTIVLRYAAGRKQFKQEGAKVETTVLDYANVQKRLLPYLALVYAMAVGTDRLEKQHEQILEQMDRAILNNDKNGINQSLNSTKSLFVDSGSLKSTCTWLTSSLIDESRQACGGHGYSSYNGFGKTYNDWAVQCTWEGDNNVLGMSAGKTIVKNVQQILKGKTIKSSTLDFLNNAKQLLDTKNILATEADLKDSSKFRVALQAVIVKYAASLSDVLAKNKNNWDLVGASRVELSKLRAHYYLLETFEERVKSLSPASDLYPHLANLLQLYYVSVILIPFAADFIRFGVISSDLVYYATSEYFGTLCGAVRPYVVGLTDSFQQPDNFLNSAIGKYDGNIYENYFGVVKSAHPPRNDKAPYNSALTGMLNRPSQEERERFEKSAEAAKILSR

SEQ ID NO: 380 - protein, 725 aa, Scheffersomyces stipitis; identical to SEQ ID NO: 379

SEQ ID NO: 381 - protein, 675 aa, Arabidopsis thaliana; identical to SEQ ID NO: 66

SEQ ID NO: 382 - protein, 714 aa, Scheffersomyces stipitis
MSSYKTANVVSSAAPPDPKSLLQTERAATKFDTDKLHWFLEGNQERSELFKSLTQQMERDPILAADLKYYDLTKEQQRELTAVKIDRIGRYLENDTIPEFQRRLSILGLFDPQVATRVGVNLGLFLSCIRGSGTVEQLKYWALQKETATIKGIYGCFGMTELAHGSNVMGLETTATFDEDNDEFIINTPHIGATKWWIGGAAHSATHCTVYARLIVKGEDYGVKTFVVPLRDSQHNLYPGVTVGDIGAKMGRDGIDNGWIQFSSVRIPRFFMLQKFCKVSRDGEVILPPLEQLSYSALLGGRVVMVADSFRMISRMITIAIRYAIGRRQFKSAEAEAEAEDEDDVKETQLLDYPLHQKRLLPYIALAYVVSAGAYKIERSIESTVNDLEDAVDDDDEAGILKSIDAMKSLFIDSGALKSTCTWLAAEVIDNARQSCGGHGYSSYSGFGKAYNDWVVQCTWEGDNNVLGINIGKPIVKHTIAVIDDGKIVKGSSAFLTNTKEYVEANGKKPILSSAADLKDLKTALKSLEVAIIRLSYNTSKTVRKHNFDYAGAELVNISKLKAHHYLLDEFLRRIDEFEQTELKPYLILLGQLYFSGIVVERFAGILLTVNVITTELVGELASSVIPDLCREVRPHAVGFTDGFQLSDMLVNSALGRYDGNIYENYFTAVKELNPPRNHKAPYSAALEGMLNRPSLEERERFEKTLETGELLSR

SEQ ID NO: 383 - protein, 714 aa, Scheffersomyces stipitis; identical to SEQ ID NO: 382

SEQ ID NO: 384 - protein, 662 aa, Candida dubliniensis
MTTELQKEREQIKFNPKEVNYFLEGSKERSEIVSNIVEQMEKDPVLKVDASYYNLTKEEQREVTAKKIDRISRYFENEFPDQQAQRLSIIGVFDPQVFTRIGVNLGLFVSCIRGNGTNSQFFYWTINKGVDKLRGIYGCFGMTELAHGSNVQGIETTATFDKETDEFVINTPHIGATKWWIGGAAHSATHCTVYARLKVNGKDYGVKTFVVPLRDSNHDLMPGVTVGDIGAKMGRDGIDNGWIQFSNVRIPRFNMLQKYAKVSREGEVTMPPSEQLSYSALIGGRVTMMMDSYRMTSRFITIALRYAITRRQFKSKISGDKETQLIDYPLHQKRLFPFLAAAYLFSQGALYLEQTMNETNERLDDAVAEGDKNEIDKAIVASKKLFVASGCLKSTCTWLTADAIDQARQACGGHGYSSYNGFGKAYSDWVVQCSWEGDNNILAINVAKPMVKEILQEPEQKGLVIANVSDLNDPAKLDKAFEHALSGLARDIGAVAKDKGYDVTGPSLVLVSKLNAHKFLIDGFFKRITPEFGPVLKPLGFLYADWIIETFSSVFLSYGVIAPEVIKKISSEHFPALAKQIRPNVVGLTDAFNLSDMLTNAAIGRADGNVYDHYFETVKSLNPPENTKAPYSQALQDMLNRPSVEERQRGEKSEEAAEILSS

SEQ ID NO: 385 - protein, 774 aa, Candida dubliniensis
MLQNLSHFDISYLKINLSAPLFPFITSIFFFVIFHISLLSTFNIKHFISKMAMLTKSIHDEDHVEKKDPDTTPRTVQNVVSSRSPPNPAKDIAEERNRTDWDLKEMHEFLEGDEAKSEQVLRLYQSIERDPILQTRPEQFDITQKEERELVATRINQMTKYMEIESAEKFRRRLQLMTIIDPSMGIRMLVNIGLFINCIKGNGTQKQYDFWAKSKEGAIVKQIHGSFGMTELGHGSNVAGCETTATFDEKTDTFIIDTPHIGATKWWIGGAAHSATHTVCYARLIVKDVDYGVKTFVVPLRDSNHNLLPGVAIGDIGAKMGRHGVDNGWIQFTEVRIPRFFMLQRWCKVDRQGNVTLPPLEQLSYISLLEGRVGMATDSYRIGARYITIALRYAVGRRQFANGKGKEETKLIDYTLHQRRLLPYLAMTYAAALGTDRLERQHEELLENLDKALATKDKLLLKNTINGTKSMFVDSGSLKSTLTWFAADLINETRQACGGHGYSSYNGFGKSYDDWVVQCTYEGDNNVLGMSAGKTIIKTVQQVLNGKPLQDSTLEFLNDAPTLAKAKKAVIRIKEHVDDVDRVLKAIAGLISKFSSDLIAVSHQSWDSIGPQRVILSKLRCHYYLLETFNERLNDKIKAKSPARPHLENIIKLYYVTNILGPFIDEFLRFGVISPKVAKYITGEYPQRLCAIARPYIIGLTDSFQQPDNIINSLIGRYDGNIYTNYLDSVKDINNPLNHKAPYSEDLEAMLNRQSIPQRERFERSKEAAAQLSK

SEQ ID NO: 386 - protein, 419 aa, Arabidopsis thaliana
AQIRDQDGSICPNIRIADCGHKIGLNGVDNGRIWFDNLRIPRENLLNAVADVSSDGKYVSSIKDPDQRFGAFMAPLTSGRVTIASSAIYSAKVGLSIAIRYSLSRRAFSVTANGPEVLLLDYPSHQRRLLPLLAKTYAMSFAANELKMIYVKRTPETNKAIHVVSSGFKAVLTWHNMHTLQECREAVGGQGVKTENLVGQLKGEFDVQTTFEGDNNVLMQQVSKALFAEYVSCKKRNKPFKGLGLEHMNSPRPVLPTQLTSSTLRCSQFQTNVFCLRERDLLEQFTSEVAQLQGRGESREFSFLLSHQLAEDLGKAFTEKAILQTILDAEAKLPTGSVKDVLGLVRSMYALISLEEDPSLLRYGYLSQDNVGDVRREVSKLCGELRPHALALVTSFGIPDSFLSPIAFNWVEANAWSSV

SEQ ID NO: 387 - protein, 449 aa, Arabidopsis thaliana
MAVLSSADRASNEKKVKSSYFDLPPMEMSVAFPQATPASTFPPCTSDYYHFNDLLTPEEQAIRKKVRECMEKEVAPIMTEYWEKAEFPFHITPKLGAMGVAGGSIKGYGCPGLSITANAIATAEIARVDASCSTFILVHSSLGMLTIALCGSEAQKEKYLPSLAQLNTVACWALTEPDNGSDASGLGTTATKVEGGWKINGQKRWIGNSTFADLLIIFARNTTTNQINGFIVKKDAPGLKATKIPNKIGLRMVQNGDILLQNVFVPDEDRLPGVNSFQDTSKVLAVSRVMVAWQPIGISMGIYDMCHRYLKERKQFGAPLAAFQLNQQKLVQMLGNVQAMFLMGWRLCKLYETGQMTPGQASLGKAWISSKARETASLGRELLGGNGILADFLVAKAFCDLEPIYTYEGTYDINTLVTGREVTGIASFKPATRSRLDDDGKLEHHHHHH

SEQ ID NO: 388 - protein, 449 aa, Arabidopsis thaliana; identical to SEQ ID NO: 387

SEQ ID NO: 389 - protein, 449 aa, Arabidopsis thaliana; identical to SEQ ID NO: 387

SEQ ID NO: 390 - protein, 449 aa, Arabidopsis thaliana; identical to SEQ ID NO: 387

SEQ ID NO: 391 - protein, 449 aa, Arabidopsis thaliana; identical to SEQ ID NO: 387

SEQ ID NO: 392 - protein, 449 aa, Arabidopsis thaliana; identical to SEQ ID NO: 387

SEQ ID NO: 393 - protein, 681 aa, Rattus norvegicus; identical to SEQ ID NO: 343

SEQ ID NO: 394 - protein, 622 aa, Homo sapiens
MILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 395 - protein, 660 aa, Homo sapiens; identical to SEQ ID NO: 346

SEQ ID NO: 396 - protein, 660 aa, Homo sapiens
MNPDLRRERDSASFNPELLTHILDGSPEKTRRRREIENMILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 397 - protein, 436 aa, Arabidopsis thaliana; identical to SEQ ID NO: 354

SEQ ID NO: 398 - protein, 436 aa, Arabidopsis thaliana; identical to SEQ ID NO: 354

SEQ ID NO: 399 - protein, 661 aa, Rattus norvegicus; identical to SEQ ID NO: 341

SEQ ID NO: 400 - protein, 681 aa, Homo sapiens; identical to SEQ ID NO: 342

SEQ ID NO: 401 - protein, 700 aa, Rattus norvegicus; identical to SEQ ID NO: 350

SEQ ID NO: 402 - protein, 675 aa, Arabidopsis thaliana; identical to SEQ ID NO: 103

SEQ ID NO: 403 - protein, 675 aa, Arabidopsis thaliana; identical to SEQ ID NO: 103

SEQ ID NO: 404 - protein, 664 aa, Arabidopsis thaliana; identical to SEQ ID NO: 146

SEQ ID NO: 405 - protein, 664 aa, Arabidopsis thaliana; identical to SEQ ID NO: 146

SEQ ID NO: 406 - protein, 646 aa, Arabidopsis thaliana
MESRREKNPMTEEESDGLIAARRIQRLSLHLSPSLTPSPSLPLVQTETCSARSKKLDVNGEALSLYMRGKHIDIQEKIFDFFNSRPDLQTPIEISKDDHRELCMNQLIGLVREAGVRPFRYVADDPEKYFAIMEAVGSVDMSLGIKMGVQYSLWGGSVINLGTKKHRDKYFDGIDNLDYTGCFAMTELHHGSNVQGLQTTATFDPLKDEFVIDTPNDGAIKWWIGNAAVHGKFATVFARLILPTHDSKGVSDMGVHAFIVPIRDMKTHQTLPGVEIQDCGHKVGLNGVDNGALRFRSVRIPRDNLLNRFGDVSRDGTYTSSLPTINKRFGATLGELVGGRVGLAYASVGVLKISATIAIRYSLLRQQFGPPKQPEVSILDYQSQQHKLMPMLASTYAYHFATVYLVEKYSEMKKTHDEQLVADVHALSAGLKSYVTSYTAKALSVCREACGGHGYAAVNRFGSLRNDHDIFQTFEGDNTVLLQQVAADLLKRYKEKFQGGTLTVTWSYLRESMNTYLSQPNPVTARWEGEDHLRDPKFQLDAFRYRTSRLLQNVAARLQKHSKTLGGFGAWNRCLNHLLTLAESHIETVILAKFIEAVKNCPDPSAKAALKLACDLYALDRIWKDIGTYRNVDYVAPNKAKVCFLV

SEQ ID NO: 407 - protein, 692 aa, Arabidopsis thaliana; identical to SEQ ID NO: 167

SEQ ID NO: 408 - protein, 646 aa, Arabidopsis thaliana; identical to SEQ ID NO: 406

SEQ ID NO: 409 - protein, 692 aa, Arabidopsis thaliana; identical to SEQ ID NO: 167

SEQ ID NO: 410 - protein, 651 aa, Arabidopsis thaliana
MEGIDHLADERNKAEFDVEDMKIVWAGSRHAFEVFEKSNRARLSRKELFKSTLRKCAHAFKRIIELRLNEEEAGRLRHFIDQPAYVDLHWGMFVPAIKGQGTEEQQKKWLSLANKMQIIGCYAQTELGHGSNVQGLETTATFDPKTDEFVIHTPTQTASKWWPGGLGKVSTHAVVYARLITNGKDYGIHGFIVQLRSLEDHSPLPNITVGDIGTKMGNGAYNSMDNGFLMFDHVRIPRDQMLMRLSKVTREGEYVPSDVPKQLVYGTMVYVRQTIVADASNALSRAVCIATRYSAVRRQFGAHNGGIETQVIDYKTQQNRLFPLLASAYAFRFVGEWLKWLYTDVTERLAASDFATLPEAHACTAGLKSLTTTATADGIEECRKLCGGHGYLWCSGLPELFAVYVPACTYEGDNVVLQLQVARFLMKTVAQLGSGKVPVGTTAYMGRAAHLLQCRSGVQKAEDWLNPDVVLEAFEARALRMAVTCAKNLSKFENQEQGFQELLADLVEAAIAHCQLIVVSKFIAKLEQDIGGKGVKKQLNNLCYIYALYLLHKHLGDFLSTNCITPKQASLANDQLRSLYTQVRPNAVALVDAFNYTDHYLNSVLGRYDGNVYPKLFEEALKDPLNDSVVPDGYQEYLRPVLQQQLRTARL

SEQ ID NO: 411 - protein, 651 aa, Arabidopsis thaliana; identical to SEQ ID NO: 410

SEQ ID NO: 412 - protein, 701 aa, Clavibacter michiganensis
MPVAGEVDAEVAQDLDRTDGRQDAPGAGPRIDVEGLGRVLLGRWADVRRSSRELTSRPELHRVEGLDMHQHRARVSEQLRILVEHGGVHRAYPVSVGGLEDHGGNIAGFEELVAADPSLQIKAGVQWGLFGSAVMHLGTERHHRELLPGIMTLETPGAFAMTETGHGSDVASIGTSATYDPETGEFDLHTPFRAAWKDYLGNAAVDGRAATVFAQLVTQGVNHGVHCFFVPLRDETGAFLPGVGGEDDGLKGGLNGIDNGRLHFDHVRVPRANLLNRYGDVAEDGTYTSEIASPGRRFFTMLGTLVQGRVSLDGAATSAAKIALQIAITYGNQRRQFVAGGTDEEVLLDYQRHQRRLIPRIATTYAASFAHEELLGQFDSVFSGKTDTDQDRQDLETLAAAFKPLSTWHALDTIQEAREACGGQGFLAENRLVGLRADLDVYATFEGDNTVLLQLVAKRLLTDVNRRFAKADFGVLARYAVEQAADRTLRSTGLRTLGQALADRGSTARSVGQLREPDTQRALLTGRVETMVGEIATALRATRKMPPAEAAALFNRHQDALIEAARAHAQLLQWEAFTEALDPASETGRAMDDGTRRILTWTRDLFGLRLIEDDLAWYLIHGRISSARARAVTAYVDRLVARLRPHAQDLVDSFGYTQAHVRAPVASGEEKDRQDEARAYRDARIADGTAPRMEKSEKKKG

SEQ ID NO: 413 - protein, 701 aa, Clavibacter michiganensis; identical to SEQ ID NO: 412

SEQ ID NO: 414 - protein, 765 aa, Cyclobacterium marinum; identical to SEQ ID NO: 321

SEQ ID NO: 415 - protein, 438 aa, Fusarium oxysporum
VDFKLSPSQLEARRHAQAFANTVLTKASAEYSTQKDQLSRFQATRPFYREAVRHGLIKAQVPIPLGGTMESLVHESIILEELFAVEPATSITIVATALGLMPVILCDSPSLQEKFLKPFISGEGEPLASLMHSEPNGTANWLQKGGPGLQTTARKVGNEWVISGEKLWPSNSGGWDYKGADLACVVCRVSDDPSKPQDPNVDPATQIAVLLVTRETIANNKKDAYQILGEPELAGHITTSGPHTRFTEFHVPHENLLCTPGLKAQGLVETAFAMSAALVGAMAIGTARAAFEEALVFAKSDTRGGSKHIIEHQSVADKLIDCKIRLETSRLLVWKAVTTLEDEALEWKVKLEMAMQTKIYTTDVAVECVIDAMKAVGMKSYAKDMSFPRLLNEVMCYPLFNGGNIGLRRRQMQRVMALEDYEPWAATYGSSKVDKSRL

SEQ ID NO: 416 - protein, 438 aa, Fusarium oxysporum; identical to SEQ ID NO: 415

SEQ ID NO: 417 - protein, 438 aa, Fusarium oxysporum; identical to SEQ ID NO: 415

SEQ ID NO: 418 - protein, 438 aa, Fusarium oxysporum; identical to SEQ ID NO: 415

SEQ ID NO: 419 - protein, 438 aa, Fusarium oxysporum
VDFKLSPSQLEARRHAQAFANTVLTKASAEYSTQKDQLSRFQATRPFYREAVRHGLIKAQVPIPLGGTMESLVHESIILEELFAVEPATSITIVATALGLMPVILCDSPSLQEKFLKPFISGEGEPLASLMHSEPNGTANWLQKGGPGLQTTARKVGNEWVISGEKLWPSNSGGWDYKGADLACVVCRVSDDPSKPQDPNVDPATQIAVLLVTRETIANNKKDAYQILGEPELAGHITTSGPHTRFTEFHVPHENLLCTPGLKAQGLVETAFAMSAALVGAMAIGTARAAFEEALVFAKSDTRGGSKHIIEHQSVADKLIDCKIRLETSRLLVWKAVTTLEDEALEWKVKLEMAMQTKIYTTDVAVECVIDAMKAVGMKSYAKDMSFPRLLNEVMCYPLFDGGNIGLRRRQMQRVMALEDYEPWAATYGSSKVDKSRL

SEQ ID NO: 420 - protein, 438 aa, Fusarium oxysporum; identical to SEQ ID NO: 419

SEQ ID NO: 421 - protein, 438 aa, Fusarium oxysporum; identical to SEQ ID NO: 419

SEQ ID NO: 422 - protein, 438 aa, Fusarium oxysporum; identical to SEQ ID NO: 419

SEQ ID NO: 423 - protein, 438 aa, Fusarium oxysporum
VDFKLSPSQLEARRHAQAFANTVLTKASAEYSTQKDQLSRFQATRPFYREAVRHGLIKAQVPIPLGGTMESLVHESIILEELFAVEPATSITIVATALGLMPVILCDSPSLQEKFLKPFISGEGEPLASLMHSEPNGTANWLQKGGPGLQTTARKVGNEWVISGEKLWPSNSGGWDYKGADLACVVCRVSDDPSKPQDPNVDPATQIAVLLVTRETIANNKKDAYQILGEPELAGHITTSGPHTRFTEFHVPHENLLCTPGLKAQGLVETAFAMAAALVGAMAIGTARAAFEEALVFAKSDTRGGSKHIIEHQSVADKLIDCKIRLETSRLLVWKAVTTLEDEALEWKVKLEMAMQTKIYTTDVAVECVIDAMKAVGMKSYAKDMSFPRLLNEVMCYPLFDGGNIGLRRRQMQRVMALEDYEPWAATYGSSKVDKSRL

SEQ ID NO: 424 - protein, 438 aa, Fusarium oxysporum; identical to SEQ ID NO: 423

SEQ ID NO: 425 - protein, 438 aa, Fusarium oxysporum; identical to SEQ ID NO: 423

SEQ ID NO: 426 - protein, 438 aa, Fusarium oxysporum; identical to SEQ ID NO: 423

SEQ ID NO: 427 - protein, 438 aa, Fusarium oxysporum; identical to SEQ ID NO: 415

SEQ ID NO: 428 - protein, 438 aa, Fusarium oxysporum; identical to SEQ ID NO: 415

SEQ ID NO: 429 - protein, 438 aa, Fusarium oxysporum; identical to SEQ ID NO: 415

SEQ ID NO: 430 - protein, 438 aa, Fusarium oxysporum; identical to SEQ ID NO: 415

SEQ ID NO: 431 - protein, 700 aa, Homo sapiens; identical to SEQ ID NO: 349

SEQ ID NO: 432 - protein, 764 aa, Marivirga tractuosa
MLNSVQFSKNPNLYIFLPLFYTLWEDFSLSKFDVETMRKLVNSQSWLEREEVELLEQYLNPNQKPSAQELKNWRNQIQFIKPKNLKNLTALGLELVKAHRNRHELQISEKDKEAFKTAEKELGLIFNESAYRFENTHSTVTSEQESKSSFDPKLMQEILDGSKIELIQKVKDTLTKPEFAYHQHEKIADQRGQVLEWCKLLAKEGYGSWAFPREYGGREDMEGYFTIMETLSYHDLSMVIKFGVQFGLWGMSIYFLGTEKHHQKYLKEIGSLELPGCFAMTETNHGSNVRGLETTATYNHKDKTFTIHTPHQDARKEYIGNAALHGQKATVFAKLIIDGEDYGVNTFVVPLRNKSGELHPGVEIEDCGHKMGLNGVDNGLIAFNKVVIPKEDMLDRFASVDDEGRFKSSISSDNKRFFTMLGTLVGGRIGVPRSGLSAAKSGLTIAIRYANQRKQFGPEGGGEVPILNYRMHQRRLMPLVAKSYAMHFALKYLTNRFLTKSEEEGQEIEALAAGMKAYGTWFTTETLQECREACGGKGYLSENRIDALKSDTDVYTTFEGDNTVLMQLVAKSRLTEFKQEMGDMNFTTIFNYLSKQAKTSITEKNPITVRSTDEKHLLDFEFHLNAFKYRERAIVASAGQRIKRLVDEGMDSFDAVNVAQHHLINVGRSYIERKVLERFQLAVETTQNKACREALQQLCQLYALHTIEQNKGWYLEQGYMEGVKTKAIRKMVNQLCWESRQDAIGFTDAFGIPDKLLAAPIAFN

SEQ ID NO: 433 - protein, 764 aa, Marivirga tractuosa; identical to SEQ ID NO: 432

SEQ ID NO: 434 - protein, 624 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRAERRCSCPGRRDRSS

SEQ ID NO: 435 - protein, 438 aa, Fusarium oxysporum; identical to SEQ ID NO: 415

SEQ ID NO: 436 - protein, 438 aa, Fusarium oxysporum; identical to SEQ ID NO: 415

SEQ ID NO: 437 - protein, 438 aa, Fusarium oxysporum; identical to SEQ ID NO: 415

SEQ ID NO: 438 - protein, 438 aa, Fusarium oxysporum; identical to SEQ ID NO: 415

SEQ ID NO: 439 - protein, 439 aa, Fusarium oxysporum
MVDFKLSPSQLEARRHAQAFANTVLTKASAEYSTQKDQLSRFQATRPFYREAVRHGLIKAQVPIPLGGTMESLVHESIILEELFAVEPATSITIVATALGLMPVILCDSPSLQEKFLKPFISGEGEPLASLMHSEPNGTANWLQKGGPGLQTTARKVGNEWVISGEKLWPSNSGGWDYKGADLACVVCRVSDDPSKPQDPNVDPATQIAVLLVTRETIANNKKDAYQILGEPELAGHITTSGPHTRFTEFHVPHENLLCTPGLKAQGLVETAFAMSAALVGAMAIGTARAAFEEALVFAKSDTRGGSKHIIEHQSVADKLIDCKIRLETSRLLVWKAVTTLEDEALEWKVKLEMAMQTKIYTTDVAVECVIDAMKAVGMKSYAKDMSFPRLLNEVMCYPLFDGGNIGLKRRQMQRVMALEDYEPWAATYGSSKVDKSRL

SEQ ID NO: 440 - protein, 439 aa, Fusarium oxysporum; identical to SEQ ID NO: 439

SEQ ID NO: 441 - protein, 439 aa, Fusarium oxysporum; identical to SEQ ID NO: 439

SEQ ID NO: 442 - protein, 439 aa, Fusarium oxysporum; identical to SEQ ID NO: 439

SEQ ID NO: 443 - protein, 439 aa, Fusarium oxysporum
MVDFKLSPSQLEARRHAQAFANTVLTKASAEYSTQKDQLSRFQATRPFYREAVRHGLIKAQVPIPLGGTMESLVHESIILEELFAVEPATSITIVATALGLMPVILCDSPSLQEKFLKPFISGEGEPLASLMHSEPNGTANWLQKGGPGLQTTARKVGNEWVISGEKLWPSNSGGWDYKGADLACVVCRVSDDPSKPQDPNVDPATQIAVLLVTRETIANNKKDAYQILGEPELAGHITTSGPHTRFTEFHVPHENLLCTPGLKAQGLVETAFAMSAALVGAMAIGTARAAFEEALVFAKSDTRGGSKHIIEHQSVADKLIDCKIRLETSRLLVWKAVTTLEDEALEWKVKLEMAMQTKIYTTDVAVECVIDAMKAVGMKSYAKDMSFPRLLNEVMCYPLFEGGNIGLRRRQMQRVMALEDYEPWAATYGSSKVDKSRL

SEQ ID NO: 444 - protein, 439 aa, Fusarium oxysporum; identical to SEQ ID NO: 443

SEQ ID NO: 445 - protein, 439 aa, Fusarium oxysporum; identical to SEQ ID NO: 443

SEQ ID NO: 446 - protein, 439 aa, Fusarium oxysporum; identical to SEQ ID NO: 443

SEQ ID NO: 447 - protein, 1261 aa, Cyanothece sp.
MFPADSTLVDLLQHRATHQPQQLSYVFLTNGETEEITLSYQTLTEKVMAIAAQLQAMNLQNERALLLYAPGLDFVTAFLGCLAAGVGAVPVYPPQGKQPLSRLEAIAADAEAKIVLTTNNFLAKIKQYFSETARFTYLTTDSLDESLALQWKQPNINSKTLAFLQYTSGSTGNPKGVMVSHGNLLQNSANIYRGFKHNDNSRVVSWLPHYHDMGLIGGILQPLYGGFPVILMSPSSFIRKPIRWLRAISRYGATTSGGPNFAYKRCVETITPKQKAGLDLSSWKIAFTGAESISSETLDQFAEAFAPCGFRREAFYPCYGLAEATLFVTGKVLTKSELRSQNSEVREPNLIRVDSEALQQNRVVVTIDETVKTQKIVSCGQPTSDETVIIVDPETLLPCSPEKVGEIWVSGASVAQGYWQQKEITEATFKAYLADTKEGTFLRTGDLGFLHDGELFVTGRLKDVIIIRGHNYYPQDIELTVENSHPAIRPNNCVATSITHEEEEKLLIIAEIKRKFLQKLNLEETITKIRANISQNHGIQTDNIVLVKQGSIPKTSSGKIQRQACKQAYLEQNLPTIESLQVFKSSPHAPSNLIQWLRNYANEHINSRLMDERRCIPPHIVLDFGNQGLLGMQVPPEYGGLGLNHGETMKVIEQLGAIDTTLSLFVGLNNILGIRPLLQFGSQALKEELLPMLATGRELAAFALTEPSAGSNPQAITSSAMPLSSDKWVLNGTKIWSGSAAWAGVINVFVQQKDAQGKFQGISSFAVRRGTPGLKQGPEALTLGMRGMVQNTVYLNNVPVSASQQLGDPGEGMKVAQDAMMYGRLAIAAASVGGMKRCAQLWHRYSSRRQISTGRLLDNPLVLARLNGLTAAITTVETLVTSIAQLLDQGQEVPIEAYTVCKMAAPEFYWQAADNLVQFLGGRGYIETNIAPQILRDARVLRIFEGPTETLTAFLGSRLIYQPKGLKRLLRDTLGVPEIYEQLQQTVEQIQYYRKSPFTEATKTKHWTAMLCGEVAMWGVLLAVLQAKAIATPLESLDRAIAWTKEHFQQKIAQGFIKTPDELVISSANKTTELIADYETAIGDIEQTLAGEDRELDELLRKQKNGEIREYSAVKKIERAEKPLSEEDWEKRGVIEDWLKNWLGKKLNLSPQTIDPKRAFADYGIDSVMAVELAQDLQEWLGHTQELEASLAWNFPNIKSLAKYLTTVASVAEDEAVEEILSMAEPEMMSAIKNASEEEIQTAISQEMAELESLLKGGYQR

SEQ ID NO: 448 - protein, 1261 aa, Cyanothece sp.; identical to SEQ ID NO: 447

SEQ ID NO: 449 - protein, 681 aa, Oryctolagus cuniculus; identical to SEQ ID NO: 344

SEQ ID NO: 450 - protein, 436 aa, Arabidopsis thaliana; identical to SEQ ID NO: 354

SEQ ID NO: 451 - protein, 436 aa, Arabidopsis thaliana; identical to SEQ ID NO: 354

SEQ ID NO: 452 - protein, 436 aa, Arabidopsis thaliana; identical to SEQ ID NO: 354

SEQ ID NO: 453 - protein, 436 aa, Arabidopsis thaliana; identical to SEQ ID NO: 354

SEQ ID NO: 454 - protein, 677 aa, Gordonia bronchialis
MSTPTESPASDAARTPDVPVTPPDVSADDELSADERALLVENLRYTLDGRWRAVRDTVREQSNRSELLPDPSRTLDEARSHTLGVVRELSQHGFASAGFASDHGGTGDVGASITSIEMLGYADLSLMVKAGVQWGLFGGAVENLGTARHHERYVKGIIDLDVLGCFAMTETGHGSNVQALETTATYDRDTREFVIHSTTPGARKDYIGGAAEHARYAAVFAQLITAGPGAEPESQGVHCFVVPIRDEDGNDLPGITTSDCGYKGGLAGVDNGRIVFDNVRIPAENLLNRYADVEPDGTYTSPIENPNRRFFTMLGTLIRGRVSVAATAGAAGRKALTLATRYGLMRKQFEAPDETDEIIVMDYLGHQRKLLPLIAKSYAIACAQNEITAELHEVQSSSPDDSDAGRQRQLESDAAGLKAYATWHASHAVNVSREACGGAGYLDENQLSIIRGDIDVFTTFEGDNTVMTQLVAKELLSSYADDVQGLSAGGWVRFVVEMARDVVAEKTAVRQVVQTLLESSDEDTEKSNLTNRGTQIRLFRNREDHLIRTCAQRLRRALDDDNDAFEVFNNAQDHLLKVGRAHTERVVLEAFIEAINDCDSRSAAELLGKVCDLFVYSALEDDLGWFLMHRHISVERAKAIRRGVNTLCQELRPHARTLVDAFGIPENLLAAPMLEHG

SEQ ID NO: 455 - protein, 663 aa, Micromonospora sp.
MLDHASGRIDIARLQETLDGPWAEVRQAHRKHLDERFLPVYGETGDQARERITRLLGELPVELGIAAGFPAEYGGRSDVGASIVATEMLAQVDLSLMVKAGVQWGLFGGAVAALGTKRHHDAYLRDIVEGRIFGCFAMTETGHGSDVQQLRTTCVYDPQTQTFDLHTPHEAARKDYIGNAARDGRMAVVFAQLISGGRRHGVHAWLVPIRDEHGNPMPGVTIGDAGPKAGLLGVDNGRLSFDHVRVPRDMLLDRYAQVAEDGTYSSAIENDSRRFFTMLGTLVRGRVSVGGAASAATKAALAIAVRYGDIRRQFSDAEGDREVLLNDYLAHQRKLLPALATTYALHFAQTELVAALDEIQGGDGPIDEHRQRELESRAAGLKAAQTWHATRTIQACREACGGAGYLSENRLPSLKADTDVFTTFEGDNTVLLQLVAKGLLTGYRDEFGSLDGWGRASFVAEQVREMVLERTAARALIARLVGAVPGRDDEVAVTDRGWQLKVFEDREEHLLDSAVRRLRGGASTKKDRPFDIFNDVQDHVLAVAAAHVDRVTLEAFVAGIDATTDPAVKELLSRVCDLYALSVIEANKGWLLEHGRLTPARSKAITGVVNGLLKELRPYMRTLVDGFAIPDAWLHAAILREEPARQETMAAHDAATDPRSAPA

SEQ ID NO: 456 - protein, 653 aa, Streptomyces sp.
MATDNAHTATSGYVEPEVDVRALTEVLDGEYAEIRDLVRTNLVTYASVLEEAEELGVDAYRERVRELVVEMAATGQTGMGFPGRYGGGGDIGASIAAFETLAFGDLSVLVKVGVQFGLFGGAILQLGTERHHDAYLPDLITGRLMGCFAMTETGHGSNVQALGTLARYDAEGQEFVITTQGDQARKDYIGNAARHAELAVVFAQLEVAGKSEGVHAFVVPIRVDGEVAPGVRIEDDGRKMGLNGVDNGRIRFDGVRVPREALLNRFADVTAEGVYESSIDNPDRRFFTMLGTLVQGRVSVGGAGVNAAKVALAIATKYAVRRRQFEAASGAEEQRLLDYGLHQRRLLPLVARTYALHFAQDVVRTQLHEVFSGIEDDAQARRRLESRAAGTKALGTWHATRVVQECREACGGAGYLSVNRFAALKADSDIFTTFEGDNHVLLQLVAKGLLTHYASEFEDLDQLGTVRYVAGLAVETVMEKTSAHKLLERVRDLLPGGDEWDQEAGLLDSEYQLAMLRYREEHMLAGVARRLKRGVDQKGNPGVVFSQVQDHVIAVAHAHVERLVLEAFVEKVRALPDSGNKVALGLLCDLFALSTIEADRAWFMEHGRLTVQRSKAISREVNDLCRKVRPLAVDLVDAWGIPSEMLRAPDLVG

SEQ ID NO: 457 - protein, 663 aa, Micromonospora sp.; identical to SEQ ID NO: 455

SEQ ID NO: 458 - protein, 663 aa, Micromonospora aurantiaca
MLDHASRRIDIARLQETLDGPWAEVRQAHRKHLDERFLPVYGETGDQARERITRLLGELPVELGIAAGFPPEYGGRSDIGASIVATEMLAQVDLSLMVKAGVQWGLFGGAVAALGTKRHHDAYLRDIVEGRIFGCFAMTETGHGSDVQQLRTTCVYDPQTRTFDLHTPHEAARKDYIGNAARDGRMAVVFAQLISGGRRHGVHAWLVPIRDEHGNPMPGVTIGDAGPKAGLLGVDNGRLSFDHVRVPRDMLLDRYAQVAEDGTYSSAIENDSRRFFTMLGTLVRGRVSVGGAASAATKAALAIAVRYGDIRRQFSDAEGDREVLLNDYLAHQRKLLPALATTYALHFAQTELVAALDEIQGGDGPVDEHRQRELESRAAGLKAAQTWHATRTIQACREACGGAGYLSENRLPSLKADTDVFTTFEGDNTVLLQLVAKGLLTGYRDEFGSLDGWGRASFVAEQVREMVLERTAARALIARLVGAVPGRDDEVAVTDRGWQLKVFEDREEHLLDSAVRRLRGGASTKKDRPFDIFNDVQDHVLAVAAAHVDRVTLEAFVAGIDATADPAVKELLSRVCDLYALSVIEANKGWLMEHGRLTPARSKAITGVVNGLLKELRPYMRTLVDGFAIPDAWLHAAILREEPARQETMAAHDAATDPRSAPV

SEQ ID NO: 459 - protein, 653 aa, Streptomyces sp.; identical to SEQ ID NO: 456

SEQ ID NO: 460 - protein, 663 aa, Micromonospora aurantiaca; identical to SEQ ID NO: 458

SEQ ID NO: 461 - protein, 681 aa, Mus musculus; identical to SEQ ID NO: 345

SEQ ID NO: 462 - protein, 681 aa, Mus musculus; identical to SEQ ID NO: 345

SEQ ID NO: 463 - protein, 700 aa, Pongo abelii; identical to SEQ ID NO: 351

SEQ ID NO: 464 - protein, 655 aa, Kribbella flavida
MTGLREYLDGPHKAARDVVRDGLATHAGLLDAGLRLSRDEYRDQVLATLREVAAQGHPVRGFPKEYGGQGDLGGFIAGFETLAFGDLSLMVKAGVQFGLFAGAILHLGTERHHERYLADALTGDLLGCFAMTETGHGSNVQALETTATYDPATGEFVVHTPTASARKDYIGNAARHGRLAAVFAQLVVGGQTLGVHCLLVPIRTDDGQPVTGVTISDCGPKLGLNGVDNGRIVFDQVRVPREALLDRYAQVDADGTYRSEIENPDRRFFTMLGTLVQGRVSVGGAAINASKVALTIAVRYAEQRRQFGAPGSPEEALLLDYRMHQRRLLPLLARTYALHFAQAELVDEFARIFGADTATGQDGGSAPDGGSRSDEHDRRALEAQAAGTKAVGTWHATETIQLCREACGGAGYLAENRLSTLKADTDVFTTFEGDNTVLLQLVAKGLLTDYRESFGKLDPLGTARFVAGQAVEIAVEKTALRGLIERLRDAVPNRSDAGDPDAGLRDDDYHSGLLRFREQHMLAGVARRLRAGIDAGDEAFEVFNRCQDHVIAAGRAHVERVVLEAFQRAVHAAPEGETRDRLKELYDLHALTTIENDRAWFMEHGRLSGPRSKAITALVNDLCGRVRPHASSLVDAFGVPGAAVDVPMVVRSLHE

SEQ ID NO: 465 - protein, 655 aa, Kribbella flavida; identical to SEQ ID NO: 464

SEQ ID NO: 466 - protein, 754 aa, Zobellia galactanivorans
MQDSTYSSEILQYIPFFYVIWSDDLLTTSEIDVVQNAIDADNSLSERSRAQLLTWLNTNNPPANSELKKWKRTISNSSVKLTESETYPLTSFSQKIVCHYKKECPFNDQLKHIEIQLGIQPNHYNHLFDVEVVHKSTSDFYSADAIDTILKGKHATVVDSFRKTLADPIFKWEVHRNKEKFRETVLKQVKFLADKGYGAMAYPEAYGGTDDMEGYAYMFENMMFADGSLSIKFGVQFGLFGGSIQKLGTKKHHDQYLTKTGKTELLGCFAMTETGHGSNVRGIKTTATYNKATDEIVIHTPGKNDNKEYIGNALHSKMATVFAQLIVNGKNEGVHAILVPLRNKEHELLPGVTVEDNGYKLGLNGVDNGKIWFDQVAVPRENLLNRYGDIKEDGSYYSEIKNPNKRFFTMLGTLVGGRICVARAGLGGAKFALAVAIKHALKRRQFNDSVKIQEDLLMDYPSHQLRLTPLVASAYVYHVTLDKMMQLYCDPSEPDKRKVETQVAGLKSIITWYANDSIQECREACGGKGYLLENRIADLKGDVDIFTTFEGDNTVLLLLAAKGVLSDFKSEFNSAGFSAVLKILGMQINDKLTTINPIYSNKVDKDHLYNPKFHKHALEYRTRRLTYTLAMRIRDYIKQGVPSYQAFLKVQTHLLALGKAYSNELAYNTFIDFIQDIEDDKNRTLFQKLGTLHALHTIRQDAEWYLEQGYIGGTKSKAIRQRVERLCTELRPHIGVLVDGFGIPEHCMTAPITQ

SEQ ID NO: 467 - protein, 661 aa, Rattus norvegicus; identical to SEQ ID NO: 341

SEQ ID NO: 468 - protein, 675 aa, Arabidopsis thaliana; identical to SEQ ID NO: 66

SEQ ID NO: 469 - protein, 659 aa, Arabidopsis thaliana
MEGIDHLADERNKAEFDVEDMKIVWAGSRHAFEVSDRIARLVASDPVFEKSNRARLSRKELFKSTLRKCAHAFKRIIELRLNEEEAGRLRHFIDQPAYVDLHWGMFVPAIKGQGTEEQQKKWLSLANKMQIIGCYAQTELGHGSNVQGLETTATLDPKTDEFVIHTPTQTASKWWPGGLGKVSTHAVVYARLITNGKDYGIHGFIVQLRSLEDHSPLPNITVGDIGTKMGNGAYNSMDNGFLMFDHVRIPRDQMLMRLSKVTREGEYVPSDVPKQLVYGTMVYVRQTIVADASNALSRAVCIATRYSAVRRQFGAHNGGIETQVIDYKTQQNRLFPLLASAYAFRFVGEWLKWLYTDVTERLAASDFATLPEAHACTAGLKSLTTTATADGIEECRKLCGGHGYLWCSGLPELFAVYVPACTYEGDNVVLQLQVARFLMKTVAQLGSGKVPVGTTAYMGRAAHLLQCRSGVQKAEDWLNPDVVLEAFEARALRMAVTCAKNLSKFENQEQGFQELLADLVEAAIAHCQLIVVSKFIAKLEQDIGGKGVKKQLNNLCYIYALYLLHKHLGDFLSTNCITPKQASLANDQLRSLYTQVRPNAVALVDAFNYTDHYLNSVLGRYDGNVYPKLFEEALKDPLNDSVVPDGYQEYLRPVLQQQL

SEQ ID NO: 470 - protein, 659 aa, Arabidopsis thaliana; identical to SEQ ID NO: 469

SEQ ID NO: 471 - protein, 757 aa, Escherichia coli
MGSPSLYSARKTTLALAVALSFAWQAPVFAHGGEAHMVPMDKTLKEFGADVQWDDYAQLFTLIKDGAYVKVKPGAQTAIVNGQPLALQVPVVMKDNKAWVSDTFINDVFQSGLDQTFQVEKRPHPLNALTADEIKQAVEIVKASADFKPNTRFTEISLLPPDKEAVWAFALENKPVDQPRKADVIMLDGKHIIEAVVDLQNNKLLSWQPIKDAHGMVLLDDFASVQNIINNSEEFAAAVKKRGITDAKKVITTPLTVGYFDGKDGLKQDARLLKVISYLDVGDGNYWAHPIENLVAVVDLEQKKIVKIEEGPVVPVPMTARPFDGRDRVAPAVKPMQIIEPEGKNYTITGDMIHWRNWDFHLSMNSRVGPMISTVTYNDNGTKRKVMYEGSLGGMIVPYGDPDIGWYFKAYLDSGDYGMGTLTSPIARGKDAPSNAVLLNETIADYTGVPMEIPRAIAVFERYAGPEYKHQEMGQPNVSTERRELVVRWISTVGNYDYIFDWIFHENGTIGIDAGATGIEAVKGVKAKTMHDETAKDDTRYGTLIDHNIVGTTHQHIYNFRLDLDVDGENNSLVAMDPVVKPNTAGGPRTSTMQVNQYNIGNEQDAAQKFDPGTIRLLSNPNKENRMGNPVSYQIIPYAGGTHPVAKGAQFAPDEWIYHRLSFMDKQLWVTRYHPGERFPEGKYPNRSTHDTGLGQYSKDNESLDNTDAVVWMTTGTTHVARAEEWPIMPTEWVHTLLKPWNFFDETPTLGALKKDK

SEQ ID NO: 472 - protein, 439 aa, Fusarium oxysporum
MVDFKLSPSQLEARRHAQAFANTVLTKASAEYSTQKDQLSRFQATRPFYREAVRHGLIKAQVPIPLGGTMESLVHESIILEELFAVEPATSITIVATALGLMPVILCDSPSLQEKFLKPFISGEGEPLASLMHSEPNGTANWLQKGGPGLQTTARKVGNEWVISGEKLWPSNSGGWDYKGADLACVVCRVSDDPSKPQDPNVDPATQIAVLLVTRETIANNKKDAYQILGEPELAGHITTSGPHTRFTEFHVPHENLLCTPGLKAQGLVETAFAMSAALVGAMAIGTARAAFEEALVFAKSDTRGGSKHIIEHQSVADKLIDCKIRLETSRLLVWKAVTTLEDEALEWKVKLEMAMQTKIYTTDVAVECVIDAMKAVGMKSYAKDMSFPRLLNEVMCYPLFDGGNIGLRRRQMQRVMALEDYEPWAATYGSSKVDKSRL

SEQ ID NO: 473 - protein, 439 aa, Fusarium oxysporum; identical to SEQ ID NO: 472

SEQ ID NO: 474 - protein, 439 aa, Fusarium oxysporum; identical to SEQ ID NO: 472

SEQ ID NO: 475 - protein, 439 aa, Fusarium oxysporum; identical to SEQ ID NO: 472

SEQ ID NO: 476 - protein, 439 aa, Fusarium oxysporum; identical to SEQ ID NO: 472

SEQ ID NO: 477 - protein, 439 aa, Fusarium oxysporum; identical to SEQ ID NO: 472

SEQ ID NO: 478 - protein, 669 aa, Drosophila melanogaster
MPAKPVNPDLQKERSTATFNPREFSVLWAGGEERFKEKKALEKLFLEDPALQDDLPISYLSHKELYEHSLRKACIIGEKIRKLRADGEDGVDTYNALLGGSLGSAILKEGNPLALHYVMFVPTIMGQGTMDQQVEWLSKAWDCEIIGTYAQTELGHGTFLRGLETRADYDASTQEFVINTPSLSAYKWWPGGLGHTANHAVVVAQLYTKGEFRGLAPFIVQLRDSDTHRPMPGIDIGDIGTKLGMKGVNNGYLGLKNVRVPLNNMLMKNQQVLPDGTYVAPKNSVLTYGTMMFVRCALIRDTAQSLAKASTIATRYSAVRRQSPIDPNQPEPQIMDHTTQQLKLFPQIAKAIVFKTTGDGIWNMYNVISGEIEQGNLDRLPEMHALSCCLKAICSADAAAGVETCRLSCGGHGYMDCSNFPTIYGMTTAVCTYEGENTVMLLQTARYLVKVYGQALNGEKLVPTVSYISDAINQTKFVNFDGSLRSIVKAFQFVAANKTRIAYEQIELRRKQGYGTEVAANLCGTFLTAAADLHGRAFLAQTAYTELLALSREVSPELAEVLKVVLELYLVDACLNRIGDFLRFIDLTDQDVTKLEVRLENCLKRFRPNAVSLVDSFDLHDRVLDSALGAYDGNVYEHIFESTKKNPLNKEPVNGAFHKYLKPFMKAHL

SEQ ID NO: 479 - protein, 700 aa, Dictyostelium discoideum; identical to SEQ ID NO: 172

SEQ ID NO: 480 - protein, 664 aa, Arabidopsis thaliana; identical to SEQ ID NO: 68

SEQ ID NO: 481 - protein, 660 aa, Pongo abelii
MNPDLRRERDSASFNPELLTHILDGSPEKTRRRREIENMILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKGYGLHAFIVPIREIGTHKPLPGITVGDIGPKFGYDEIDNGYLKMDNYRIPRENMLMKYAQVKPDGTYVKPLSNKLTYGTMVFVRSLLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDIHSPESLTEAYKLRAARLVEIAAKNLQKEVIHRKSKEVAWNLTSVDLVRASEAHCHYVVVKLFSEKLLKIQDKAIQAVLRNLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 482 - protein, 628 aa, Catenulispora acidiphila
MPPVPAAVDPDTLTSLLDGRWAGLRADIRAEMAAAPYRDPIDLSVEEHRSRVFDQLTALAANDRAGLGFDKAYGGGSDIGGSVVSFEMLGFGDLSLMVKAGVQWGLFGGAVQLLGTAPHHERYLRRIRDLDLLGCFAMTEHGHGSDVQHLRTTATYDPDSGEFVVHTPDRGATKEYIGNAARDGRVAVVFAQLTTQGETRGVHAFVVPIRDDAGAPAPGVTIEDCGPKAGLNGVDNGRLSFDQVRIPREALLNRFGDVAPDGTYSSPIEGDARRFFTMLGTLIRGRVSVGGSAGSATKRALALAVRYAELRRQFATPDGEEVVILDYLGHQRKLLPALATSYALHFAQEELVAALHDITDDAPEQEQRELESRAAGLKVANTWHATAAIQAAREACGGAGYLAENLLPGLKADTDVFTTFEGDNTVLLQLVAKGLLTEYKDAFQNLSPLATVRFAAERVLGAVAERTSARKVVDRLTDGDDREALFDRDWQLKLFEDREQHVLGGVADRLRKAAQDPFGVFNAAQDHVLRAGRVHVDRLVLEAFVRAIARCTDPDAKALLERVCDLYALANIEADRAWFLEHGRLSTGRSKAVIAAVNTLCGELRPHARTLVDAFAIPEQYLAAPMLS

SEQ ID NO: 483 - protein, 628 aa, Catenulispora acidiphila; identical to SEQ ID NO: 482

SEQ ID NO: 484 - protein, 701 aa, Arthrobacter chlorophenolicus
MTEVVDRPAAKGSGPSRLPAPTDRTQPGVDSEALGRQLLGKWADVRRQARDLAARPELHKVEGQTHTDHRARVFGQLKFLVDNGAVHRAFPAELGGSDDHGGNIAGFEELVVADPSLQIKAGVQWGLFGSAVMHLGTAEHHAKWLPGIMSLEIPGCFAMTETGHGSDVASIATTATYEPASEEFIIHTPFRAAWKDYIGNAATDGLGAVVFAQLVTQGVNHGVHAFYVDLRDPDTKEFLPGIGGEDDGIKGGLNGIDNGRLHFTNVRVPRTNLLNRYGDVAADGTYSSPIASPGRRFFTMLGTLVQGRVSLDGAAVAASKVALKAAIQYATERRQFNASSHTDEEVLLDYQRHQRRLFTRLATTYAAGFAHEQLLQKFDDVFSGAADTDADRQDLETLAAALKPLSTWHALDTLQECREACGGAGFLIENRFASLRADLDVYATFEGDNTVLLQLVAKRLLADYAKEFRNVDFGVLARYVVGQATGAAIHRTGLRQVAQFITDTGSVQKAAIALRDEEGQRALLTDRVQTMVAEAATALKGSNRLPQDKGAALFNRHQNELIDAAQAHAELLQWEAFTEALADVTDPGTKKVLTWLRDLFGLSLIEKNLSWYLMNGRLSMQRARTVGGYINRLLEKIRPHALDLVDAFGYGDEHVRAAIATGAETVRQDEARAYFRSQRASGQSPVDEKVLLARKAGGRKA

SEQ ID NO: 485 - protein, 701 aa, Arthrobacter chlorophenolicus; identical to SEQ ID NO: 484

SEQ ID NO: 486 - protein, 704 aa, Arthrobacter sp.
MTDVVDRAASQARRPAGSAHHHADAAPAVDVAALGEQLLGKWAHIRRHSRDLSGRPELHKTEGLTHTEHRKRTFGQLQYLVENGAVHRAFPESLGGSDDHGGNIAGFEELVTADPSLQIKAGVQWGLFGSAVMHLGTEEHHAKWLPGIMNMDIPGCFAMTETGHGSDVASIATTATFDPATQEFVINTPFRAAWKDYIGNAAIDGLGAVVFAQLVTRGVNHGVHAFYVDLRDPKTKEFLPGIGGEDDGVKGGLNGIDNGRLHFSNVRVPRANLLNRYGNVDADGAYTSPIASPGRRFFTMLGTLVQGRVSLDGAAVAASKLALKTAIQYATERRQFNASSHTDEEVLLDYQRHQRRLFTRLATTYAAGFAHEQLLQKFDDVFSGAHDTDEDRQDLETLAAALKPLSTWHALDTLQECREACGGAGFLIENRFASLRADLDVYVTFEGDNTVLLQLVAKRLLADYAKEFRNVDVGVLARYVVSQAAGAAVHRTGLRQVAQFMADTGSVQKAAIALRDEDTQRLLLTDRVQTMVAEAGAALKGTNKLPQQKAAAAFNQHQHELIEAAQAHAELLQWEAFTEALADVKDPGTKRVLTWLRDLFGLSLIEKNLSWYLMNGRLSMQRARTVGDYINRLLVKIRPHALDLVDAFGYGPEHLRAAIATGAEKTRQDEARAFFRTQRADGKAPVDEKVLLARKARDTKAPRR

SEQ ID NO: 487 - protein, 661 aa, Sus scrofa
MNQDLQKERAAASFNPELLTHVLDGSPENTRRRREIENMILSEPDLQHEDLNFLSRSQRYEVAVKKSATTVKKIREFGLADPDEILWFKNFVQRGHPGPLDLHVGMFLPTLLHQATEEQQERFFMPAWNFKIIGTYAQTEMGHGTHLRGLETTATYDPATEEFILNSPTVTSIKWWPGGLGKTSNHAIVLAQLITQGKCYGLHAFIVPIREQGTHKPLPGITVGDIGPKFGYDEMDNGYLKMDNYRIPRENMLMKYAQVKPDGTYVKPLSNKLTYGTMVFIRSFLVGEAARCLSKACTIAIRYSAVRHQSELRPDEPEPQILDYQTQQYKLFPFLATAYAFQFVGAYIKETYHRINENIRQGDLSGLPELHALTAGLKAFTSWTANAAIEACRMACGGHGYSHCSGLPNIYVNFTPTCTFEGENTVMMLQTARFLMKSYNQVHSGKLVCGMVSYLNDLPSQRIQPQQVAAWPTVADINSPDSLIEAYRLRASRLVEIAAKNLQTEMSHRKSKEAAWNLTSIDLVRASEAHCHYVVVKLFAEKLHQIQERSIHAVLRNLCLLYALYGISQNSGDFLQGSIMTESQVTHVNERVKELLMAIRPEAVALVDAFDFQDVTLGSVLGRYDGNVYENMFEWAKKSPLNKTEVHESYHKHLKSLQSKL

SEQ ID NO: 488 - protein, 438 aa, Podospora anserina
MAIDFHLSASQKGTYQAARSLARNLLMPARQTYLQHPPNSPLRFQSTQPTYAAAVSAGILKGQISPAHGGTGGTLIESAILVEECYSVEPSAALTIFATGLGLTPINLAAGPQHAEFLAPFLSGEGSPLASLVFSEPGGVANALEKGAPGFQTTARLEGDEWVINGEKMWATNCAGWDFKGCDLACVVCRDATTPLEEGQDPENKVMIILVTRADLDRNGEGSFEVLRHVATPGHTSVSGPHVRYTNVRVPTKNVLCPAGQGAKVAFGAFDGSAVLVGAMGVGLMRAAFDAALKFAKEDNRGGAVPLLERQAFADLLSGVKIQTEAARALTWKAAHAMENGPGDYDARRELALAAKVFCSEAAVKACTDVINAVGISAYDLQRPFSDLLNTAVVLPIFDGGNVGIRRRHLQQLMLKPTYDAWSSTYGSFPGSHHHHHH

SEQ ID NO: 489 - protein, 438 aa, Podospora anserina; identical to SEQ ID NO: 488

SEQ ID NO: 490 - protein, 438 aa, Podospora anserina; identical to SEQ ID NO: 488

SEQ ID NO: 491 - protein, 438 aa, Podospora anserina; identical to SEQ ID NO: 488

SEQ ID NO: 492 - protein, 439 aa, Fusarium oxysporum; identical to SEQ ID NO: 472

SEQ ID NO: 493 - protein, 661 aa, Rattus norvegicus
MNPDLRKERASATFNPELITHILDGSPENTRRRREIENLILNDPDFQHEDYNFLTRSQRYEVAVKKSATMVKKMREYGISDPEEIMWFKNSVHRGHPEPLDLHLGMFLPTLLHQATAEQQERFFMPAWNLEITGTYAQTEMGHGTHLRGLETTATYDPKTQEFILNSPTVTSIKWWPGGLGKTSNHAIVLAQLITQGECYGLHAFVVPIREIGTHKPLPGITVGDIGPKFGYEEMDNGYLKMDNYRIPRENMLMKYAQVKPDGTYVKPLSNKLTYGTMVFVRSFLVGNAAQSLSKACTIAIRYSAVRRQSEIKQSEPEPQILDFQTQQYKLFPLLATAYAFHFVGRYMKETYLRINESIGQGDLSELPELHALTAGLKAFTTWTANAGIEECRMACGGHGYSHSSGIPNIYVTFTPACTFEGENTVMMLQTARFLMKIYDQVRSGKLVGGMVSYLNDLPSQRIQPQQVAVWPTMVDINSLEGLTEAYKLRAARLVEIAAKNLQTHVSHRKSKEVAWNLTSVDLVRASEAHCHYVVVKVFSDKLPKIQDKAVQAVLRNLCLLYSLYGISQKGGDFLEGSIITGAQLSQVNARILELLTLIRPNAVALVDAFDFKDMTLGSVLGRYDGNVYENLFEWAKKSPLNKTEVHESYHKHLKPLQSKL

SEQ ID NO: 494 - protein, 660 aa, Bos taurus; identical to SEQ ID NO: 371

SEQ ID NO: 495 - protein, 692 aa, Danio rerio
MDEGIPDFPNGPLDIYRKKASFSWKDMMRFLEGDELIAFKQHVFRTLESDPLFARQPGEDVPVEQKRELTFLRCKQLFKYDFITREELMQNPWKMTVLNDCLGMYDWSLCAKYFLNKGMFGATVVNTGSQRHLKFVKDIERMMTFGCFSLTELSHGSNTRALRTTAKYDPNTQEFVINSPDFEAAKFWVGNLGKTATHSVVFAQLYTPDGKCHGLHSFIVQVRDPKTLLAMPGVMVGDMGKKLGQNGLDNGFAVFHNVRIPRENLLNKTGDVAPDGQYVSPFKDPNKRFGASLGALSGGRVGITRMALVNLKLAVTVAVRFSATRRQFGPKEDEEIPVLEYQLQQWRLIPFLAAVYALEHFTKSFSMNFVEFQMGLLMKDKSDRQAELGREIHALSCASKPLGSWTAQRGIQECREACGGHGYLAMNRLGDMRDDNDPNCTYEGDNNVLLQQTSNYLLSWIQHKQEGKGRIESPLETVNFLDDMSSILQSKFTVGSVEECMNSAVPLAAYKWLVCFLLGESQKKLFEEKSSGLGDFEARNNSQVYYCRSLAIAFIEHTVLQRFHDLIQDEQTPAVLRSVLGRLCALYGLWTLTNHMAILYQGGYFSGGQPVDFIQTAILTLCGQLKDDAVALVDVFAPPDFILNSPIGKSDGELYKNLWSTVMQGKNVLERPSWWAEFCSDKPVVGSLRAKL

SEQ ID NO: 496 - protein, 700 aa, Mus musculus; identical to SEQ ID NO: 352

SEQ ID NO: 497 - protein, 690 aa, Jonesia denitrificans
MTAVSDRPTRVTPDNPTINTTYLSEHLLGRWADLRKIARTLAQDERLIRDPHLAMDEHRERVLAQLKILVTEAQVLRAFPTRLGGKDDAGGGIAGFEELVAADPSLQIKSGVQWGLFCAAIHHLGTEEQQDRLLQDAMELTVPGAFAMTEIGHGSDVASIATTATFDPEHGDFILNTPFRAAWKDYLGNAALHGTAAVVFAQLITRGVNHGVHAFYVPIREVNDDGTAGPCLPGIQSEDDGLKGGLNGIDNGRLAFTNVRVPRDNLLARYGSVDDNGDYTSPIDSPGRRFFTMLGSLVQGRVSLDGAAGVASKIALTTAITYGNQRRQFTGASEHDETVLMDYQTHQRRLLPLLAEVYAGHFAHDRLLDLFHAVFSEEGMDTPETREDLETMAAALKPTSTWRALHTLQTAREACGGAGFMAENRLVGLRQDLDIYVTFEGDNTVLLQLVGKRLLTDYAKQFRDIDGIGMARFVVERAADTVLYKTPLNRTVQSIRDSGLRRRSASELREEETQRELLTDRVNTMVERLAQALRPASKMPQDQAAALFNSHQAELIDAAKAHADLLQWEAFTKALLDIDDEDTRTVLTWVRDLFGLHTIEKNLAWYLIHGRMSAQRAETVTSYIDRLLLRLRPHAQDLIDSFGLDDGLVRATIATGVEQQRQDEARAYYRKQRASGDAPIAEKAMKKSAR

SEQ ID NO: 498 - protein, 690 aa, Jonesia denitrificans; identical to SEQ ID NO: 497

SEQ ID NO: 499 - protein, 694 aa, Beutenbergia cavernae
MTTTLPTNARIDVGALADLLDGRWADIRRRTRNLALEPRYRRTLGLSMAEHRARVREQAQALADSGEVQRAFPSRLGGADNPGGNIAGFEELVVADPSLQIKAGVQWGLFGAAVLHLGTAYHHEEFLPGIMSMAVPGCFAMTETGHGSDVASIGTTATYDADAEEFVIHTPTRSAWKEYIGNAAVDGVAAVVFAQLVTRGVDHGVHAFYVPLRDTAGERDEHGAYPYLPGVGGEDDGLKGGLLGVDNGRLHFDQVRIPRRNLLDKYAEVAADGEYSSPIDSPGRRFFTMLGTLVQGRVSLGGSSVATSKIALSTAIRYGNERRQFTTSDPHTESVILDYGAHQRRLLPLLARTYAAAFLHDTLLERFHGVFSGEHETDADREDLETLAAASKALSTWLALDVVQTSREACGGAGYMAENGLVGLHQDMDVYVTFEGDNTVLLQLVGKRLLTDYGREMATMDVAGAVRYVADRAGDMALHRTPLRRASQSIRDWGSRARSAEELREPATQRELLEDRVEAMVEVIAGKLRAVQKASAAEQAAAFNAHQHELIEAARAHGELMQWEAFTAGIARTSDPTTKQVLTWLRDLFGLATIEKNLAWYLVNGRLSAQRARTVTSYIERLLVRLRPHAEDLVDAFGYSAELIGAPIGTGAEGERQDEAQAYYRELRASGQEPVTEKALRAREKKAARAARAS

SEQ ID NO: 500 - protein, 694 aa, Beutenbergia cavernae; identical to SEQ ID NO: 499

SEQ ID NO: 501 - protein, 700 aa, Bos taurus
MAPLRESSGDPVLPDPPQGPLHVARARASFPWKELALFWEGEDTLRFKKAIFSALENDPLFAHPRGSRLSVEKYQELNFLRCKRVFEYDFLPVGDMLDSLPRVLALIECLGMYDWSLAVKFFLHVLTFGSAIYSSGSERHLKYLPKIFSLEIFGCFALTEVSHGSNTKGIRTTAHYDPSTQEFIIHSPDFEAAKFWVGNMGKTATHAVVFAQLYTPGGQCHGLHPFLVQIRDPKTLLPMPGVMVGDIGKKLGQNGLDNGFAMFHKVRIPRQDLLNRSGDVTPEGAYVTHVKDVGQRFSESLGSLSSGRVAIVGMSVVNLKLAVSIALRFSATRRQFGPTDKEEVPVLQYPMQQWRLLPYLAAAYALDHFFKSLFLDLGELQQGLLGKDRSVRQAELGREIHALSSAGKPLASWTAQRGIQECREACGGHGYLAMNRLGDLRDDNDPNCTYEGDNSVLLQQTSRYLLGLLARRGPGGARIESPLKTVDFLDGYADILGRRFEGSSPEDLLDSSVPLAAYEWLVCYLLRESHQKLSREKRSGKSDFEAINDCQVYHCRPLALAFLELTVVRRFHEHTHQPRVPPPLRAVLRRLSALYALWSLSQHTALLYRGGYFSGERAGKVLESAILALCAQLKDDAVALVDVIAPPDFILDSPIGRADGELYKNLWTAVLQENKVLERASWWAEFAVNKPVIGSLKPKL

SEQ ID NO: 502 - protein, 692 aa, Salmo salar
MEMGLRDFPSGPLDIYRKKASFNWKEMVMFLEGEDMLALKQHVFRMLENDPIFARQPGEDMSTERMREVTFRRCKQLFRYDFLTRDDIMANPWRTVVLNDCLGMYDWSLGAKYFLNKGMFGATVANSGSQRHSQFVQDTEDMMTFGCFALTELSHGSNTRAMRTTAKYDPSTQEFVIHSPDFEAAKFWVGNLGKTATHAVVFAQLYTPDGACHGLHSFIVQVRDPKTLLAMPGVIVGDMGKKLGQNGLDNGFAVFHKVRIPRENMLNKTGDVTPEGHYVTPFKDPNKRFGASLGALSGGRVSISRMAVVNLKLAMTVAIRFSATRHQFGPKDDQEIPVIEYQLQQWRLIPYLAAVYALDYFSKSIFGNFVEFQIGMMMKDNSDRQAELGREIHAISCSSKPLGSWTAQRGIQECREACGGHGYLAMNRLGTIRDDNDPNCTYEGDNNVLLQQTSNYLLSQLHAKQQDGVRIESPLESVNFLEDFDSILETRFTATSVEECMDSAVPLAAYKWLVCFLLRESERRLAKEKASGKADFEARNNSQVFYCRSLSIVYIEHTVVQRFHDQTHDEDTPAGLRPVLKQLCALYSLWTLSNHMATLYQGGYFSGWEPADWIQQAILTLCSQLKDEAIALVDAVAPPDFILNSPIGNADGELYKNLWSTVMQGNKVLERPSWWAEFTSDKPVVGSLRPKL

SEQ ID NO: 503 - protein, 661 aa, Phascolarctos cinereus
MNPDLRRERDAASFDAEKLTYILDGGSERTRRRREIENLILNDPDFKHEDLNFLTRSERYEIAVRKSATMVKKMRDFGIADPEEIMWFKNFVHRGRPEPLDLHLGMFLPTLLHQATQEQQERFFIPAWNLEIIGTYAQTEMGHGTHLRGLETTATYDPKTQEFILNSPTVTSIKWWPGGLGKTSNHAIVLAQLYTKGECYGLHAFIVPIREMGTHKPFPGIIVGDIGPKFGYDEMDNGYLKMDNYRIPRENMLMKYAQVKPDGTYVKPLSNKLTYGTMVFVRSFLVGEAARSLSKACTIAIRYSLIRHQSEIQPGDPEPQILDFQTQQYKLFPLLATAYAFQFVGAYMKETYHRINVDISQGNLNELPELHALTAGLKAFTSWTTNSGIEACRMACGGHGYSHCSGLPNIYVTFTPTCTFEGENTVMMLQTARFLMKSYDQVHSGKLVGGMVSYLNDLPSQRIQPQQVAAWPAMVDINNPDSLTEAYKHRAARLVEAAARNLQAEMKHRKSKEIAWNFTSVDLVRASEAHCHYVVVKLFSGNLSKIDDKPIQAVLTNLCLLYALYGISQNSGDFLQGGILTESQLTQVNQRVKELLTLIRPESAALVDAFDFQDVSLGSVLGRYDGNIYENMFEWAKKSPLNKSEVHESYHKHLKPLQSKL

SEQ ID NO: 504 - protein, 663 aa, Escherichia coli
MFGKLSLDAVPFHEPIVMVTIAGIILGGLALVGLITYFGKWTYLWKEWLTSVDHKRLGIMYIIVAIVMLLRGFADAIMMRSQQALASAGEAGFLPPHHYDQIFTAHGVIMIFFVAMPFVIGLMNLVVPLQIGARDVAFPFLNNLSFWFTVVGVILVNVSLGVGEFAQTGWLAYPPLSGIEYSPGVGVDYWIWSLQLSGIGTTLTGINFFVTILKMRAPGMTMFKMPVFTWASLCANVLIIASFPILTVTVALLTLDRYLGTHFFTNDMGGNMMMYINLIWAWGHPEVYILILPVFGVFSEIAATFSRKRLFGYTSLVWATVCITVLSFIVWLHHFFTMGAGANVNAFFGITTMIIAIPTGVKIFNWLFTMYQGRIVFHSAMLWTIGFIVTFSVGGMTGVLLAVPGADFVLHNSLFLIAHFHNVIIGGVVFGCFAGMTYWWPKAFGFKLNETWGKRAFWFWIIGFFVAFMPLYALGFMGMTRRLSQQIDPQFHTMLMIAASGAVLIALGILCLVIQMYVSIRDRDQNRDLTGDPWGGRTLEWATSSPPPFYNFAVVPHVHERDAFWEMKEKGEAYKKPDHYEEIHMPKNSGAGIVIAAFSTIFGFAMIWHIWWLAIVGFAGMIITWIVKSFDEDVDYYVPVAEIEKLENQHFDEITKAGLKNGN

SEQ ID NO: 505 - protein, 516 aa, Escherichia coli
MQRRDFLKYSVALGVASALPLWSRAVFAAERPTLPIPDLLTTDARNRIQLTIGAGQSTFGGKTATTWGYNGNLLGPAVKLQRGKAVTVDIYNQLTEETTLHWHGLEVPGEVDGGPQGIIPPGGKRSVTLNVDQPAATCWFHPHQHGKTGRQVAMGLAGLVVIEDDEILKLMLPKQWGIDDVPVIVQDKKFSADGQIDYQLDVMTAAVGWFGDTLLTNGAIYPQHAAPRGWLRLRLLNGCNARSLNFATSDNRPLYVIASDGGLLPEPVKVSELPVLMGERFEVLVEVNDNKPFDLVTLPVSQMGMAIAPFDKPHPVMRIQPIAISASGALPDTLSSLPALPSLEGLTVRKLQLSMDPMLDMMGMQMLMEKYGDQAMAGMDHSQMMGHMGHGNMNHMNHGGKFDFHHANKINGQAFDMNKPMFAAAKGQYERWVISGVGDMMLHPFHIHGTQFRILSENGKPPAAHRAGWKDTVKVEGNVSEVLVKFNHDAPKEHAYMAHCHLLEHEDTGMMLGFTV

SEQ ID NO: 506 - protein, 683 aa, Lycopersicon esculentum
MRGSHHHHHHGSACELVREMEGVDYLADERKKAGFDVDEMKIVWAGSRHDFELTDRISKLVASDPGFSKEGRTMLPRKELFKNTLRKAAYAWKRIIELRLSQEEATMLRRYVDEPAFTDLHWGMFIPAIKGQGTDKQQEKWLPLAYKMQIIGCYAQTELGHGSNVQGLETTATFDPQTDEFVIHSPTLTSSKWWPGGLGKVSTHAVVYARLITDGKDYGVNGFIVQLRSLEDHKPLPGVTVGDIGMKFGNGAYNSMDNGVLSFDHVRIPRDQMLMRVSQVTKEGKYVQSDIPRQLLYGTMVYVRQSIVADASLAMSRAVCIATRYSAVRRQFGSQNGGQETQVIDYKTQQNRLFPLLASAYAFRFVGEWLKWLYTDVTQRLAANDFSTLPEAHACTAGLKSLTTSATADGIEECRKLCGGHGYLCSSGLPELFAVYVPACTYEGDNVVLQLQVARFLMKTISQLGTGKKPVGTVSYMGRIEHLMQCRSDVKQAEDWLKPSAVLEAFEARSARMSVACAKNLSKFENQEEGFAELAADLVEAAVAHCQLIVVSKYIEKLQQNIPGKGVKQQLEVLCGIYSLFILHKHQGDFLGTGYITSKQGSLANDQLRALYSQLRPNAVSLVDAFNYTDHYLGSILGRYDGNVYPKLYEAAWKDPLNKSDIADGFHEYIRPLLKQQLRTAKL

SEQ ID NO: 507 - protein, 683 aa, Lycopersicon esculentum; identical to SEQ ID NO: 506

SEQ ID NO: 508 - protein, 683 aa, Lycopersicon esculentum; identical to SEQ ID NO: 506

SEQ ID NO: 509 - protein, 677 aa, Drosophila melanogaster
MSHIKNLIPSTVNPDLQKERAAAEFHVEEFSAWWHGGQDKLKKKREIEKAIFSDLEDGYGLNHEYMSHEEVYNSTVKKVAEAAVKLKALQNKLNPGGTDIWPGGLFNAQSFGLFPANHPIATHITMFVDVIKGQGTAEQVEKWGKAAENCNIIGTYAQTELAHGTNVRGLATRADFDPKTDEFVLNTPNLEAYKWWPGGLGHTANHAMVVAQLYIADVHHGVQMFIVPLRDSETHMPLPGVDIGEIGKKLGMASVNQGFLGLNHVRIPRTNMLMKFAKVERDGTFKASPASRINYLTMVYTRCLIVSQNSTLLLAAATIATRYSAVRRQSPIEPNQPEPQIIDHVTQRLKLFPEIATGIAYHLATEYMWEMYAQTVQEANNGKFERLPDMHILSCALKVLCTTDGCAGIEKLRLSTGGHGYLIAANLSNIYGNAVAAYTYEGENTVLLLQIGRALVKAWASFVDKKPLSASYSYFASSMQLKEFPKWDDSWQCIIKALQYTAAHKTRIAFENLANRMASGQSQGVAANNTGIELTRAAELHGRQFVCQTFLEQITGAKAQKRSPALNKILENVLELFLVQTVLNNLNDILRFIKLSDADLRSLQKRLEDSLAQFRPNAVAICDGFEFHDRVLNSVLGSYDGNVYPRLFDSAKRSTMNQKPVQTSFETYLKPLMKAKL

SEQ ID NO: 510 - protein, 677 aa, Drosophila melanogaster
MASSTSVIPTTVNPDLQKERDAASFNSEEFAAWWAGGEEVLKFNRGVREYMEKDVDLSEMLQLQNKTHEEIIEFSTRGAIEGAKKLRRLQEERNPGGDVYWPNLYDAQVMWGLVPGGNPFGVMYVMLVKALQAQCTPEQYEEFGKRVELFEICGTYAQTELGHGTYLRGLETRADFDRKTDQFVLNTPNISSYKWWPGGLGHSSNHCLVMAQLYIDGDCKGPHMFFIQVRDEDTHEPLPGVHIGDIGKKMGFIGVNNGFLGLKNVRIPRTRMLMRHAQVKADGSYVSSPTNVLTYFAMVRTRCVIAKNNAVMLASAATIATRYSAVRRQSPINPNEREPQIMDHVTQQMKLFPEIATSVAYRKAGDYLWNLYDVTIEDIENGKYERLPELHSLSCALKVTCSMDSASGVEKLRLACGGHGFLTSSNMSSIYVSATAACTYEGENTVLLLQIGRFLMKTWRAALTGAPLPPTVRYLAEVQKNPEFGTWTGSWENMVKAMQYAAANRTQLAFRSLSKRMSRGETEANAANHTGIEFTQAAELHGRAFVFSAFYEAVTGPQSKTRSANFNRVLENLLELYLVKETLNQMGHLLRFINLTDTDLSGLQDRLETVLTKLRPDAVAIVDGFDFSDLQLNSTLGSYDGNAYERIFDAALKNPMNQKAVPKYFHEILRPFMKSNI

SEQ ID NO: 511 - protein, 660 aa, Danio rerio
MNPDISRERENASFNLEILTNVLDGGAEKTNRRREIESLVIGDPDFQHEDLNFLSRSERYDAAVRKSAQMILKLREYGISDPEEIYSYKTVVRGVFQEPLGVHNVMFIPTLKSQCTAEQRKKWIPLAESFHMLGTYAQTELGHGTHIRALETTATYDPSTQEFVLNSSTISSIKWWPGGLGKTSNHAIVLAQLYTQGKCHGLHAFITPIRCMKTHMPLPGVVVGDIGPKFGFDEVDNGYLKLENVRIPRENMLMKYAQVEPDGTYVKPPSDKLTYGTMVFIRSMIVGESARALSKSCTIAIRYSAVRHQSELRPGEPEPQILDYQTQQYKLFPLLATAYAFHFVGQYMNKTYHRISGDISLGDFSELPELHALSAGLKAFTTWAANTGIEVCRMSCGGHGYSRCSSLPDIYVTFTPTCTYEGENTVMMLQTARYLVKSYKQARAGQQLTGIVSYLNESQSRIQPHSVSSRPTVVNINDLVSLVEAYKFRAAKLVEVAAKNLQLELQHSKSNEDAWNNTSIDLVRASDAHCHYVVVKLFAAKLSEIGDKAVHSVLSTLALLYALHGVAQNSGDFLKAGLLSVSQLDQISQRLKGLLLEIRPNAVALVDAFDYRDEMLNSSLGRYDGNVYEHMFEWAKKSPLNHTEVHESHNKYLKPLRSKL

SEQ ID NO: 512 - protein, 483 aa, Coccomyxa subellipsoidea
MSASNSQDACTLPYPDRFHAAVNFIVNSVPGTKPVPDELRLALFALHQQATVGPCTEAKPWGWNVVESAKWESWNQLGNMSSVEAMRLYVKLIEQEQPDWWALAKAHKHKLSLLAAEENGGDSDGGAYFASPALDAAPLGVWSTPFVEGPKRPPPRYEHAAATVGPNLYVLGGNCGGRYLGDVWILALDTMTWSPVSGPAKSAPPTPSQNGDAAAILAPVPQPLPPCAGHAMVAWGSKLLVLGGHMKAKDARKDLQVSAFDTQATTWALLEPSGAPPTSRGGHSATIIGSSVFIFGGEDSSRRPLGELVILDLAAMAWVRADTTGLPPAARSAHTAVAYKNRFLVVFGGGSVAHCYNDVSLLDTKTNEWSSPATDGVPPTPRAGHAAAMLGDRLYVVGGGNNSAGCADLACLDLSGLAAGRPLRWSSVATAEPRSAIASEGLSLVAARGPGALVAYGGYNGRYHSSKKLQTTSELEKELSHYR

SEQ ID NO: 513 - protein, 677 aa, Drosophila melanogaster; identical to SEQ ID NO: 509

SEQ ID NO: 514 - protein, 677 aa, Drosophila melanogaster; identical to SEQ ID NO: 510

SEQ ID NO: 515 - protein, 654 aa, Tsukamurella paurometabola
MSSPASSPELTAALRTILDGRWADTRDVVRGQIQDQGVVPRAGLSLDDYRELVLGQMKQMVPLGFPADGFRTEHGGTGDVGAAVTAIETLGYGDLSLMVKAGVQWGLFGGAVENLGTRYHHDTYVRGLIDLDVLGCFAMTETGHGSNVQELETTATYLPETGEFEIHSPTSSARKDYIGGAGKHARYAAVFAQLITGGPGEEPTGRGVHCFVVPIRDANGDDLPGVTTSDCGYKGGLPGVDNGRIVFDRVRIPRVDLLNRYADVADDGTYSSPIESDNRRFFTMLGTLIRGRVTVGAAAGAAGRLGIALATKYALVRRQFDAPGGDNELLLLDYRTHQRRLLPLVARAYAFALAQNELTAELHELQTADPDSIDPDYSREIEGKAAAIKAGHTRLASDAISAAREACGGAGYLSENRLPLLRGDIDVFTTFEGDNLVLTQLVAKEQLTAYAADVQGLDAVGWVRFVAEMARDVVLEKTAARQVVQTLLDDSNEDTEESDLTHPGTQLRLLRNRENHLLRTAADRMRRAKDPDEDPLEVFTETQDHLIKVGEAHIERIVLESFVDVITDVTDRETRDALKLMRNLYVYSLLERDLGWYLMHRQVSVERAKAIRRGVNELCGKARPIAESLVDAFGIPATALDVPMLDPANSVAVH

SEQ ID NO: 516 - protein, 670 aa, Geodermatophilus obscurus
MTTSLPHAVDPRTLTEVLDGRWGHVRHDARENLHDPDLLPVYGENVQEARERVTRMAEKIAASGRVTLGFPKEYGGEGDAGGSVTAIEMLAFTDLSLMVKAGVQWGLFGGAVQALGTERHHDAYLRDIMGFDLPGCFAMTETGHGSDVQQLRTTCTYDPGTRTFDLHTPHEAARKDYIGNAAKDGRMAVVFAQLVTKGERHGVHAWLVPIRDEQGAPMPGVTIGDDGPKAGLLGVDNGRLSFDHVTVPRDMLLDRYGQVAEDGTYTSSIENETRRFFTMLGTLVRGRVSVGGSAAAATKLALDIAVRYGQTRRQFSAPGADREVLLNDYLVHQRKLLPALAATYAYSFAQEELVGTMHDVQGAEDLDEGAQRELESRAAGLKAAQTWHATRTIQTAREACGGAGYLQENRLPHLKADTDVFTTFEGDNTVLLQLVAKGLLTGYRDAFGSLDGWGKVGFIADMVRETVLERTAARGLIARLVDAVPGREDEVPLLDRGWQLKMLEDREKHLLEGAIRRLRRGAETPGARPFDVFNDVQDHVLRTAQAHTDRIVLEAFVAGIERTTDAGAKALLERVCDLYALTTIEADRAWFLEHGRLTPNRSKALTATVNGVLKELRPHLVTLVDAFAIPEDWKGAAILREEPARQEAMATGDAELRRGTATSVEVPPGQ

SEQ ID NO: 517 - protein, 662 aa, Gallus gallus
MMNADLRRERAAATFQPELLTHILDGGAERTRRRKEIEALVINDPDFQHEDLNFLSRSQRCEQAIRKSSLMVMKLREYGIADPEEIYWFKSFVHRGRPEPLDLHLGMFLPTLLTQATPEQQDRFFMPAWNLEIIGTYAQTEMGHGTHLRGLETTATYDPATQEFILNSPTVTSIKWWPGGLGKTSNHAIVLAQLYTQGQCKGLHAFIVPIRQLGTHEPLPGITVGDIGPKFGYDEMDNGYLKMDNFRIPRENMLMKYAQVEPDGTYVKPVSDKLTYGTMVFIRSLIVGDSARSLSRACTIAIRYSAVRHQSELKPGAPEPQILDYQTQQYKLFPLLATAYAFHFVGAYIKDTYHRISGDIHEGDLSELPELHALTAGLKAFTSWTANAGIEECRMACGGHGYSRCSGIPDIYVTFTPSCTYEGENTVMMLQTARFLVKSYNQVSSGQRVTGMVSYLNDLSRQRVQPQHVAGRTETVRINDPVSLVEAYKARAARLVEAAAKNLQAELNHRKSKEDAWNRTSVDLVRASEAHCHYVIVKLFTAKLSEVINAAVCAVLTELCLLYALYGISKNAGDFLQAGILTDAQITQVNQRVKELLAVIRPNAVALVDSFDFHDVHLGSVLGRYDGNVYENMFEWAKKSPLNKTEVHESFHKHLKPMQSKL

SEQ ID NO: 518 - protein, 670 aa, Geodermatophilus obscurus; identical to SEQ ID NO: 516

SEQ ID NO: 519 - protein, 661 aa, Xenopus laevis
MNPDLSRERAAASFNPETITYILDGSPERTHRRREIEGLVLNDPGFQHEDPNFLSRSERYELAIKKSALMVQKMREHGISDPEEIYWFKSFVHRGRPEPLDLHLGMFLPTLLNQATPEQQERLFMPAWNLEIIGTYAQTEMGHGTHLRGLETTATYDPSTQEFILNSPTVSSIKWWPGGLGKTSNHAVVLAQLYTQGECKGLHAFIVPIRHMGTHEPLPGVMVGDIGPKFGFDETDNGFLKFDKVRIPREYMMMKYAKVEPDGTYVKPLSDKLTYGTMVFIRSMIVGDSARSLSRACTIAVRYSTVRHQSEIRAGEPEPQILDFQTQQYKLFPLLATAYAFQFVGSYMNHTYHRISAEIQDGNLNELPELHALSAGLKAFTTWVANAGIEECRMACGGHGYSRCSGIPDIYVTFTPACTYEGENTVMMLQTARFLVKSYEAVLSGKQLDGMVSYLNDVSQHRVQPHPVAGRFLVKDINDIQNLVEAYKQRAAWLVVAAANSVNADSKRGKRKEDAWNKNSVDLVRASEAHCHYVVVRLFAEKLSEVLDVAAHRILSSLCLFYALHGISKNTGDFLQAGLLTALQVNQVQQRVKDLLAVIRPNAVALVDAFDYSDTQLGSVLGRYDGNVYENMFEWAKKSPLNKTQVHESFHKYLKPLQSKL

SEQ ID NO: 520 - protein, 661 aa, Xenopus tropicalis
MNPDLSRERAAASFNPETITVILDGSPERTRRRREIEGLVLNDPSFQHEDPNFLSRSERYELAIKKSALMVQKMREHGISDPEEIYWFKSFVHRGRPEPLDLHLGMFLPTLLNQATPEQQERLFMPAWNLEIIGTYAQTEMGHGTHLRGLETTATYDPSTQEFILNSPTVSSIKWWPGGLGKTSNHAVVLAQLYTQGECRGLHAFIVPIRHMGTHEPLPGVVVGDIGPKFGFDETDNGFLKFDKLRIPRENMLMKYAKVEPDGTYVKPLSDKLTYGTMVFIRSMIVGDSARSLSRACTIAIRYSAVRHQSEIRAGEPEPQILDFQTQQYKLFPLLATAYAFQFVGSYMSHTYHRISAEIQAGNLNELPELHALSAGLKAFTTWAANTGIEECRMACGGHGYSRCSGIPDIYVTFTPACTYEGENTVMMLQTARFLVKSYKAVLSGKRLDGMVSYLNDVSQHRVQPHPVAGRSLVKDINDIQNLVEAYKQRAAWLVVAAAKNVNTDSKRGKRKEDAWNKNSVDLVRASEAHCHYVVVKLFADKLSEVLDVAAHRILSSLCLFYALHGISKNTGDFLQAGLLTTLQVDLVQQRVKDLLAVIRPNAVALVDAFDYSDTQLGSVLGRYDGNVYENMFEWAKKSPLNKTQVHESFHKYLKPLQSKL

SEQ ID NO: 521 - protein, 655 aa, Streptomyces roseosporus
MTTDRTSPATGGYVQPEIDVRALTEVLDGAYAEVRDLVRANLVTHASVLDEADELGIDAFRERVRDLVVAMAATGQTGMGFPKRYGGGGDVGASIAAFETLAFGDLSVLVKVGVQFGLFGGAILHLGTERHHDTYLPDLVTGELMGCFAMTETGHGSNVQALGTVARYDADAQEFVITTEGDQARKDYIGNAARHGELAVVFAQLEVAGKSEGVHAFVVPIRAGGESAPGVHIEDDGRKMGLNGVDNGRIRFDDVRVPREALLNRFADVTPEGVYESTIDNPHRRFFTMLGTLVQGRVSVGGAGVNTAKVALAIATKYALRRRQFAAGPQGEEQLLLDYGLHQRRLLPLIARTYALHFAQDVVRTQLHDVFSDPEDDAQARRLLEARAAGTKALATWHATRVIQECREACGGAGYLAVNRFAALKADSDIFTTFEGDNHVLLQLVAKGLLTDYASEFEDLDQLGMVRYVTNLAVETVIEKTSAHKLLERVRDLLPGGDEWDQEAGLLDSEYQLAMVRYREEHMLAGVARRLKSGIDRKRDPGAVFSEVQDHVIAVARAHMERLVLEAFVEKTRTLPDGGNKVALGLLCDLYALSTIEADRAWFMEHGRLTVQRSKAITREVNDLCRKIRPLAGELVDAWGIPDAMLRAPDLVGGA

SEQ ID NO: 522 - protein, 692 aa, Salmo salar; identical to SEQ ID NO: 502

SEQ ID NO: 523 - protein, 439 aa, Fusarium oxysporum
  MOD_RES (1)..(1): Any amino acid
  MOD_RES (70)..(70): Any amino acid
  MOD_RES (102)..(102): Any amino acid
  MOD_RES (132)..(132): Any amino acid
  MOD_RES (275)..(275): Any amino acid
  MOD_RES (283)..(283): Any amino acid
  MOD_RES (354)..(354): Any amino acid
  MOD_RES (356)..(356): Any amino acid
  MOD_RES (374)..(374): Any amino acid
  MOD_RES (379)..(379): Any amino acid
  MOD_RES (386)..(386): Any amino acid
  MOD_RES (396)..(396): Any amino acid
  MOD_RES (413)..(413): Any amino acid
  MOD_RES (417)..(417): Any amino acid
XVDFKLSPSQLEARRHAQAFANTVLTKASAEYSTQKDQLSRFQATRPFYREAVRHGLIKAQVPIPLGGTXESLVHESIILEELFAVEPATSITIVATALGLXPVILCDSPSLQEKFLKPFISGEGEPLASLXHSEPNGTANWLQKGGPGLQTTARKVGNEWVISGEKLWPSNSGGWDYKGADLACVVCRVSDDPSKPQDPNVDPATQIAVLLVTRETIANNKKDAYQILGEPELAGHITTSGPHTRFTEFHVPHENLLCTPGLKAQGLVETAFAXSAALVGAXAIGTARAAFEEALVFAKSDTRGGSKHIIEHQSVADKLIDCKIRLETSRLLVWKAVTTLEDEALEWKVKLEXAXQTKIYTTDVAVECVIDAXKAVGXKSYAKDXSFPRLLNEVXCYPLFDGGNIGLRRRQXQRVXALEDYEPWAATYGSSKVDKSRL

SEQ ID NO: 524 - protein, 439 aa, Fusarium oxysporum; identical to SEQ ID NO: 523
  MOD_RES (1)..(1): Any amino acid
  MOD_RES (70)..(70): Any amino acid
  MOD_RES (102)..(102): Any amino acid
  MOD_RES (132)..(132): Any amino acid
  MOD_RES (275)..(275): Any amino acid
  MOD_RES (283)..(283): Any amino acid
  MOD_RES (354)..(354): Any amino acid
  MOD_RES (356)..(356): Any amino acid
  MOD_RES (374)..(374): Any amino acid
  MOD_RES (379)..(379): Any amino acid
  MOD_RES (386)..(386): Any amino acid
  MOD_RES (396)..(396): Any amino acid
  MOD_RES (413)..(413): Any amino acid
  MOD_RES (417)..(417): Any amino acid

SEQ ID NO: 525 - protein, 439 aa, Fusarium oxysporum; identical to SEQ ID NO: 523
  MOD_RES (1)..(1): Any amino acid
  MOD_RES (70)..(70): Any amino acid
  MOD_RES (102)..(102): Any amino acid
  MOD_RES (132)..(132): Any amino acid
  MOD_RES (275)..(275): Any amino acid
  MOD_RES (283)..(283): Any amino acid
  MOD_RES (354)..(354): Any amino acid
  MOD_RES (356)..(356): Any amino acid
  MOD_RES (374)..(374): Any amino acid
  MOD_RES (379)..(379): Any amino acid
  MOD_RES (386)..(386): Any amino acid
  MOD_RES (396)..(396): Any amino acid
  MOD_RES (413)..(413): Any amino acid
  MOD_RES (417)..(417): Any amino acid

SEQ ID NO: 526 - protein, 439 aa, Fusarium oxysporum; identical to SEQ ID NO: 523
  MOD_RES (1)..(1): Any amino acid
  MOD_RES (70)..(70): Any amino acid
  MOD_RES (102)..(102): Any amino acid
  MOD_RES (132)..(132): Any amino acid
  MOD_RES (275)..(275): Any amino acid
  MOD_RES (283)..(283): Any amino acid
  MOD_RES (354)..(354): Any amino acid
  MOD_RES (356)..(356): Any amino acid
  MOD_RES (374)..(374): Any amino acid
  MOD_RES (379)..(379): Any amino acid
  MOD_RES (386)..(386): Any amino acid
  MOD_RES (396)..(396): Any amino acid
  MOD_RES (413)..(413): Any amino acid
  MOD_RES (417)..(417): Any amino acid

SEQ ID NO: 527 - protein, 719 aa, Komagataella pastoris; identical to SEQ ID NO: 58

SEQ ID NO: 528 - protein, 661 aa, Cavia porcellus; identical to SEQ ID NO: 373

SEQ ID NO: 529 - protein, 713 aa, Xylanimonas cellulosilytica
MTTTSDPTTQAAAPAADRPETAAAPAPAPAAATATTGPARPGPRIDVTALHDSLLGRWPQWRSAARAHAAEPRFWKDESLSMAEHRKRVLAQCHQLAEDPRHQVWLGFPERLGGGGSPGANLAGFEELAIGDPSLQIKAGVQWGLFASAIWQLGTPEQQDRWLPGAMDLSVPGAFAMTETGHGSDVAAVGTTATYDPDTQEFVIHTPFRGAWKDYLGNGAEDGLAATVFARLVTGGVDYGVHCFYVPIRSSDGEFLPGVGGEDDGLKGGLRGIDNGRLWFDQVRVPRENLLARYGQVAEDGTYTSPIASPGRRFFTMLGALVQGRVSLDGAAGTASRIGLAIAVRYGSVRRQFAAATPDEEVVLLDYATHRRRLIPRIAETYALHYAHERLLDLFDDVFSGREDTEDKRADLETMAAAMKATSTAFALDTLQECREACGGAGFLTENRITSLRADLDVYATFEGDNTVLLQLVAKRLVGDFGKSLGAQVTTPEGKARFVAGRAVDTLLHRTPLRRAAQTVADVVTRPGAVFDVETQRALLADRVAAKVEAVALALRPARKADPVTAQRIFDRHQVALLDAARSHAEQVRWELFTEAVDATPDAGTRTVLGWLRDVYALTVVERDLGWFVVNGRLAASRARALEAELDALLRRLRPHALDLVAAWGLTDDHLRAAVATGAEKARQDEAREYYAAQRAAGTAPQTEKSARKSAKS

SEQ ID NO: 530 - protein, 682 aa, Bos taurus
MEGNPVHRVSAGDAWSSSMHPDIESERHSQSFNVEELTNILDGGAQNTALRRKVESIIHSEPELSLKDNYFMTQNERYEAAIKKKFHILMLAQRLGWSEGSSELQYASRSVSGDLGFAIHHIFQKTIRSLGSEEQIAKWDPLCSKFQILGTYAQTELGHGTYLQGLETEATYDAATQEFVVHSPTMTAIKWWPGDLGRSATHALVQAQLICSGARQGMHAFIVPIRSLDDHSPLPGITIGDIGPKMDFEHTDNGFLKLDHVRIPRENMLNRFAQVLPDGTYVKLGVPKSNYLSMVVVRVDILLGEVLPLLQKACTIAVRYAVIRRQSRLRPSDPEAKVLDYQTQQQKLFPPLAMAYAFHFVANNLLEFFHHSYSFILDGDFALLPELHALSAGLKAMLSDFCTQGVEQCRRACGGHGYSKLSGLPSLLTRVTASCTYEGENTVLYLQTARFLIKSCLNTQKSPGSASKGSLPQSVAYLTAPDLARCPAQTAADFLQPELYTTAWAHVAVRLIKDSVHHLQTLRQAGADEHDAWNQTTVIHVQATKAHLYYVTVKIFTEALEKLESQPAIHQVLKRLSDLYALHGILTNAGDFLHDGFLSGAQIDMARKAYLDLLPFIRKDAILLTDAFDFTDQCLNSALGCYDGHAYERLFQWAQKSPTNTEGNPAYEKYIRPLLQGRRARL

SEQ ID NO: 531 - protein, 752 aa, Flavobacterium johnsoniae; identical to SEQ ID NO: 323

SEQ ID NO: 532 - protein, 657 aa, Nocardioides sp.
MATDTAAPTPTGYVQPEIDVPALTALLDGRYAGVRDLVRTNLAEHASILVDAEEMSIDDFREQVLKVVVEMAATGQTGMGFPEEYGGGCGLGASIAAFETLAYGDLSVLVKVGVQFGLFGGAILQLGTERHHEAYLADLITGKLMGCFAMTETGHGSNVQALGTVATYDPATEEFVITTTTEDARKDYIGNAAKHAEVAVVFAQLEVGGTTEGVHAFVVPIRVDGESAPGVRIEDDGRKMGLNGVDNGRIWFDQVRVPRTALLNRFADVTPEGSYESSIENPNRRFFTMLGTLVQGRVCVGGGGINAAKVALAIATKYAVRRRQFEATSDEQEELLLDYGLHQRRLLPLIARTYALHFAQEVVAGQLHDVFSGTHAPGAEDDQARRELESRAAGTKALGTWHATRTIQECREACGGAGYLSENRFAALKADTDVFTTFEGDNHVLLQLVAKGLLTDYASEFEDLDQLGMVRFVAGLAVETVIEKTSVHKLLERVRDLLPGGDEWDQEAGLLDPDYQLAMLRFREEHMLAGVARRLKRGIDQDMNPGEVFSRVQDHVIAAASAHVERLVLEAFVDKTAGLPDGDLKVALNLLCDLFALSTIEADRAWFMEHGRLTVPRSKAISREVGDLCRKIRPLAVPLVDAWAIPPEMLRSPGLVG

SEQ ID NO: 533 - protein, 713 aa, Xylanimonas cellulosilytica; identical to SEQ ID NO: 529

SEQ ID NO: 534 - protein, 670 aa, Xenopus laevis
MIWWRTSSADTDVNPDLASERAFPSFCVETLTNLLDGSVDKTRLRRYVVSTILKDPVFSREGHYFKTRQERYEGAVRNILHLKQKIKELGWLEDGPEGEFIYRAMGGEVALNIHGVFVKSISALGTDEQIAKWLPLANNCNILGTYAQTELGHGTYLRGLETTATFDISNQQFIINTPRITATKWWPGDLGKTCTHAMVLAQLIIKQKNYGMHLFIVQVRSLKDHSPMPGITVGDIGPKMSFEHIDNGFLMMRNIRVPKENMLSRFSEVLPDGTYVKRGSDKINYFTMVAVRVSMLRQEVLEALMKACTISIRYAAVRRQSELKPGDREPKILEYQTQQQKLLPLLATCYAIHYTVCHVNKVYDEVCGAIQAGNFDSLPELHALVSGMKAYATETCSNGIEVCRKACGGHGYSLFSGLPSLYTKVTASCTYEGENTVLHLQAARFLIKCYAAAQSGQSLPQSVAYLSSPISGVCQATSHTDFLNPEVYIKAYQHRAHRLIASAAFKMRNLVQFGMEQYDAWNSTSVELVKASIAHSHYIIVKLFADVTGSLSSSPEIKKLLKSLCDLHALHGIFTSSGDFLQDGHLSGHQLEMVTEAYLSLLTLIRRDAVLLVDAFDYADQQLLSALGSYDGNVYHNLLECAQKNPDNKKVNAVFENYLKPHLQSNISKL

SEQ ID NO: 535 - protein, 405 aa, Streptomyces himastatinicus
MTTTVQPSAVGPIADELTADFYHYESLLPDEERKLLLTARSLMRDRVKPLVNESWARGEFPRELIALFRDSGLAGLPYEGYGAHRPAVSNLLSGMLALETARTDASVSTFFGVHNGLAMYSIHAGGDQEQRDRWLPAMAAMDKIGAFAMTEPLGGSDVAGGMRTTARREGGTWVLNGAKKWIGNATFADYVVVWARDVDDNHVKGFVVEKGTPGFSPVKIENKLAFRIVENAEITLTDVRVPEADRLQNIGSFRDVAEILRATRGGVAWQALGVMVGAYELALDYARERHQFGRPIGGFQLVQDLLVKSLGNITASWGMLVQLARMQDAGIFHDEHSALAKAFVTARMREVVAWSREVFGGNGILLDHDIARFFADAEAIYSFEGTREMNTLIVGKSITGRSAFV

SEQ ID NO: 536 - protein, 670 aa, Xenopus tropicalis
MVWWRASSADIDVNPDLASERAAPSFCVESLTNLLDGSVEKTRVRRYVVSTILKDPVFSKENHYFKTRQERYEGAIRNSFHLKQKIKELGWREDGPEGEVIYRAMGGELALNIHGVFIKSILALGTDEQVAKWIPLANNCNILGTYAQTELGHGTYLRGLETTATFDISTQEFIINTPQISATKWWPGDLGKTCTHAVVLAHLIIKEKNYGMHPFIVQVRSLKDHSPMPGITVGDIGPKMCFEQIDNGFLMMRNICVPKENMLSRYSEVLPDGTYVKRGSDKINYFTMVAVRVSMLRAEVLEALMKACTISIRYSAVRRQSELKPGDREPKILEYQTQQQKLLPLLATCYAIHFTTCHVNKVYDEVYGAIQAGNFDSLPELHALVSGIKAYATEICSNGIEVCRKACGGHGYSLFSGLPSLYTKVTASCTYEGENTVLHLQAARFLIKCYAAARSGQSLPHSVAYLSSPISGACQASSHTHFLNPDVYIKAYQHRAYRLIDSAAFKMRNLVQSGMEQYAAWNSTSVELVKASIAHTHYIIVKLFADVLDSLSSFPEIQKVLKSLCDLHALHGIFTNSGDFLQDGHLSGKQLEMLTEAYLGLLSLIRRDAVLLVDAFDYADQQLLSALGSYDGNVYYNLLECAQKNPDNKKVNAVFENYLKPHLQSNISKL

SEQ ID NO: 537 - protein, 405 aa, Streptomyces hygroscopicus; identical to SEQ ID NO: 535

SEQ ID NO: 538 - protein, 661 aa, Homo sapiens [sequence omitted]

SEQ ID NO: 539 - protein, 626 aa, Bos taurus
MNPDLQKERAGASFNPELLTNVLDGSPENTRRRREIENLILNDPDFQHENLNFLSRSQRYEVAVKKSAIMVQKMRKFGIADPAEIMWFKKLHLVNFVEPVGLNYSMFIPTLLNQGTTAQQEKWLHSSKGLEIIGTYAQTEMGHGTHLRGLETTATYDPETQEFILNSPTVTSIKWWPGGLGKTSNHAIVLAQLFTQGKCYGLHAFIVPIRELGTHKPLPGITVGDIGPKFGYDEMDNGYLKMDNYRIPRENMLMKHAQVKPDGTYVKPLNNKLTYGTMVFIRSFLVGESARSLSKACTIAVRYSAVRHQSEINPGEPEPQILDYQTQQYKLFPLLATAYAFQFVGAYMKETYLRINEDIGHGDLSELPELHALTAGLKAFTSWTTNTAIEACRMACGGHGYSHCSGLPNIYVTFTPTCTFEGENTVMMLQTARFLMKSYDQVHSGKLVCGMVSYLNDLPSQRIQPQQVAVWPTMVDINSPDSLTEAYKLRAARLVEIAAKNLQTEVIHRKSKEVAWNLTSIDLVRASEAHCHYVVVKLFTEKVLQIQEKSIQAVLRRLCLLYSLYGISQNAGDFLQGSIMTESQITQVNGRIKELLTAIRPDAVALVDAFDFQDVTLGSVLGRYDG

SEQ ID NO: 540 - protein, 407 aa, Escherichia coli
MQTQLTEEMRQNARALEADSILRACVHCGFCTATCPTYQLLGDELDGPRGRIYLIKQVLEGNEVTLKTQEHLDRCLTCRNCETTCPSGVRYHNLLDIGRDIVEQKVKRPLPERILREGLRQVVPRPAVFRALTQVGLVLRPFLPEQVRAKLPAETVKAKPRPPLRHKRRVLMLEGCAQPTLSPNTNAATARVLDRLGISVMPANEAGCCGAVDYHLNAQEKGLARARNNIDAWWPAIEAGAEAILQTASGCGAFVKEYGQMLKNDALYADKARQVSELAVDLVELLREEPLEKLAIRGDKKLAFHCPCTLQHAQKLNGEVEKVLLRLGFTLTDVPDSHLCCGSAGTYALTHPDLARQLRDNKMNALESGKPEMIVTANIGCQTHLASAGRTSVRHWIEIVEQALEKE

SEQ ID NO: 541 - protein, 956 aa, Escherichia coli
MIIHFTLNGAPQELTVNPGENVQKLLFNMGMHSVRNSDDGFGFAGSDAIIFNGNIVNASLLIAAQLEKADIRTAESLGKWNELSLVQQAMVDVGVVQSGYNDPAAALIITDLLDRIAAPTREEIDDALSGLFSRDAGWQQYYQVIELAVARKNNPQATIDIAPTFRDDLEVIGKHYPKTDAAKMVQAKPCYVEDRVTADACVIKMLRSPHAHALITHLDVSKAEALPGVVHVITHLNCPDIYYTPGGQSAPEPSPLDRRMFGKKMRHVGDRVAAVVAESEEIALEALKLIDVEYEVLKPVMSIDEAMAEDAPVVHDEPVVYVAGAPDTLEDDNSHAAQRGEHMIINFPIGSRPRKNIAASIHGHIGDMDKGFADADVIIERTYNSTQAQQCPTETHICFTRMDGDRLVIHASTQVPWHLRRQVARLVGMKQHKVHVIKERVGGGFGSKQDILLEEVCAWATCVTGRPVLFRYTREEEFIANTSRHVAKVTVKLGAKKDGRLTAVKMDFRANTGPYGNHSLTVPCNGPALSLPLYPCDNVDFQVTTYYSNICPNGAYQGYGAPKGNFAITMALAELAEQLQIDQLEIIERNRVHEGQELKILGAIGEGKAPTSVPSAASCALEEILRQGREMIQWSSPKPQNGDWHIGRGVAIIMQKSGIPDIDQANCMIKLESDGTFIVHSGGADIGTGLDTVVTKLAAEVLHCPPQDVHVISGDTDHALFDKGAYASSGTCFSGNAARLAAENLREKILFHGAQMLGEPVADVQLATPGVVRGKKGEVSFGDIAHKGETGTGFGSLVGTGSYITPDFAFPYGANFAEVAVNTRTGEIRLDKFYALLDCGTPVNPELALGQIYGATLRAIGHSMSEEIIYDAEGHPLTRDLRSYGAPKIGDIPRDFRAVLVPSDDKVGPFGAKSISEIGVNGAAPAIATAIHDACGIWLREWHFTPEKILTALEKI

SEQ ID NO: 542 - protein, 514 aa, Escherichia coli
MWDVIDLSRWQFALTALYHFLFVPLTLGLIFLLAIMETIYVVTGKTIYRDMTRFWGKLFGINFALGVATGLTMEFQFGTNWSFYSNYVGDIFGAPLAMEALMAFFLESTFVGLFFFGWQRLNKYQHLLVTWLVAFGSNLSALWILNANGWMQYPTGAHFDIDTLRMEMTSFSELVFNPVSQVKFVHTVMAGYVTGAMFIMAISAWYLLRGRERNVALRSFAIGSVFGTLAIIGTLQLGDSSAYEVAQVQPVKLAAMEGEWQTEPAPAPFHVVAWPEQDQERNAFALKIPALLGILATHSLDKPVPGLKNLMAETYPRLQRGRMAWLLMQEISQGNREPHVLQAFRGLEGDLGYGMLLSRYAPDMNHVTAAQYQAAMRGAIPQVAPVFWSFRIMVGCGSLLLLVMLIALVQTLRGKIDQHRWVLKMALWSLPLPWIAIEAGWFMTEFGRQPWAIQDILPTYSAHSALTTGQLAFSLIMIVGLYTLFLIAEVYLMQKYARLGPSAMQSEQPTQQQG

SEQ ID NO: 543 - protein, 522 aa, Escherichia coli [sequence omitted]

SEQ ID NO: 544 - protein, 662 aa, Candida tropicalis; identical to SEQ ID NO: 32

SEQ ID NO: 545 - protein, 856 aa, Toxoplasma gondii
MHECCGMLDASLATKFTVQFNLFGGTLLRLGSKENHVQREILNKIDTLEEIGCFALTELGYGNNAVCLETTATYEPARDEFVISSPTTLSQKYWITNGALHASWAIVFAQMIIRGASQGVHAFLVRIRQPSSNLGSSSELRVCPGVTIEDMGHRIGCNGVDNAKITFHNVRIPRSHLLDGITKVEADGRVFSIVDGPESLSVDLETLLKKREEKTSDRSGNGGGKSAVSNVAEEKGVNSQRPSQKRRTTLANSAQWTRAEVNRGGQSWTGDALSSSQNEGQPNAVQVVSPVEKPEAEPPSASIARNRFLLQTEQLLSGRLCIACMMIGGIKVVLNNTLRYSSTRLSTGPSGLSDTPILSFAVQKQTLMPLLAQALILMAWTNEVKALYERFTRVLSRTASVRQAFLRERIALCAAVRKQRQFENAEKSTANRGERSREETTSPLTEEARGGKDGNPTLFNVHTQRNKKTGKLEDPVLIGSLPVRSLLEAHAAAHCEVLLHCCALKPTVAWCAERLATEGRERCGGGGFLSANLFGEFIGSAHAGLTAEGDNRVLYAKVSKEVFALSCQHNSPVWLKALAEFPETSIRDEFAAFSRTLSTSGNDAPSRSQSPSFPPLFSVNLDPHLPVPPPPQEPSFPPPLECGPGAASSSEISSYPPPMYGPEGELLKLIHILLRLRMSRKIQRLRQLLQKKQAEQRVSNRDPRGPLHSQKRESEKSLHDHHQRLGGMTQVVHEQGKNMENTIRMQKKQMVYDLWMADVDTHDFIYSSAPASIAKCFADLAGFEMAEKLIKPEEVHALHQAKNDSVDRVAAISMQLISCFGIPEKLLFAPIARDWQAFNDPSRPTNGELTRYHDSG

SEQ ID NO: 546 - protein, 697 aa, Gordonia terrae
MATPTAPSEKTPAEKSSDEKTPSTTSPTPIATEPTVDDPVTPASVSADDELSADERALLVDNLRFVLDGRWRTTRETVRANSNRADLLPDPARTLDEARAHTLEVMRDLASQGFAAAGFAEDHGGSGDIGVSITAIEMLGYADLSLMVKAGVQWGLFGGAVENLGTARHHEKYVPGIIDLSVLGCFAMTETGHGSNVQAIETTATYDRDAREFVINSPTPSSRKDYIGGAAAHAHYAAVFAQLVTGAPDEEAEGRGVHCFVVPIRDEDGNDLPGVTTSDCGYKGGLAGVDNGRIMFDNVRIPAENLLNRYADVAEDGSYSSPIENTNRRFFTMLGTLIRGRVSVAATAGAAGRKALALSTRYGLIRKQFEAPEGTDEITVMDYLGHQRKLLPLIAKSYAIGFAQNEIVDELHEVQSVAPDDSDAGRQRQLEGQAAGLKAYATWHASHAINVSREACGGAGYLDENQLSIMRGDIDVFTTFEGDNTIMTQLIAKELLSAYSEDVQGLSAGGWVRFIAGMARDVVAEKTAVRQVVQTLLDGSDEDTEKSALTDRSTQIRLFRNREDHLVRTCAQRLRRALDDDNDAFEVFNNAQDHLLKVGHAHIERVVLEAFVEAIENCDSRSAADLLGKVCDLFVYSALEDDLSWFLMHRHISVERAKAIRRGVNELCQELRPHARSLVDAFGVPEELLRAPMLQNG

SEQ ID NO: 547 - protein, 697 aa, Gordonia terrae; identical to SEQ ID NO: 546

SEQ ID NO: 548 - protein, 655 aa, Streptomyces roseosporus; identical to SEQ ID NO: 521

SEQ ID NO: 549 - protein, 684 aa, Gordonia polyisoprenivorans
MSTPTQSPTANPDDTTSSRSTAASTDVDVPGREESTELDQATRELLVDGLRRTLDGRWRATRDSVRERANRSDLLPDPSRTLDEARARVLEEMRELSSQGFAAAGFASDHGGTGDVGASITAIEMLGYADLSLMVKAGVQWGLFGGAVENLGTKRHHDKYVSDIISLDLLGCFAMTETGHGSNVQALETTATYDPQTQEFIIDSPTPSARKDYIGGAARHARVAAVFAQLITAGPGQEPESHGVHCFVVPIRDDNGDDLPGVTTSDCGYKGGLAGVDNGRILFDHVRIPAENLLNRYADVEADGTYRSPIENPNRRFFTMLGTLIRGRVSVAATAGAAGRKALALATKYGTVRKQFEAPGADDEITVLDYLGHQRKLLPLIAKSYAITCTQNELVAELHEVQSAAPDDSDAGRQRQLESSAAGLKAYGTWHASHAINVSREACGGAGYLDENQLSIMRGDIDVFTTFEGDNTVLTQLVAKELLSAYADDVQGLSAGGWVRFIAGMARDVVVEKTAARQVIQTLLESSDEDTEKSTLTDRGTQIRLFRNREDHLVRTCAQRLRRATDDDNDAFEVFNNAQDHLLKVGRVHTERVVLESFIEAINDCDSKAAAELLGKVCDLFVYSALEDDLAWFLMHRHVSVERAKAIRRGVNELCLELRPYADVLVDAFGIPENLLVAPMIENG

SEQ ID NO: 550 - protein, 684 aa, Gordonia polyisoprenivorans; identical to SEQ ID NO: 549

SEQ ID NO: 551 - protein, 667 aa, Pongo abelii
MGSPVHRVSLGDTWSRQMHPDIESERYMQSFDVERLTNILDGGAQNTALRRKVESIIHSYPEFSCKDNYFMTQNERYKAAMRRAFHIRLIARHLGWLEDGRELGYAYRALSGDVALNIHRVFLRALRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIVGDIGPKMDFDQTDNGFLQLNHVLPDGTYVKLGTAQSNYLPMVVVRVELLSGEVLPILQKACVIAMRYSVIRRQSRLRPSDPEAKVLDYQTQQQKLFPQLAISYAFHFLAVSLLEFFQHSYTAILNRDFSFLPELHALSTGMKAMMSEFCTQGAEMCRRACGGHGYSKLSGLPSLVTKLSASCTYEGENTVLYLQVARFLVKSYLQTQMSPGSTPQRSLPPSVAYLTAPDLARCPAQRAADFLCPELYTTAWAHVAARLIKDSVQHLQTLMQSGADQHEAWNQTTVIHLQAAKAHCYYVTVKGFTEALEKLENEPAIQQVLKRLCDLHAIHGILTNSGDFLHDAFLSGDQVDMARTAYLDLLRLIRKDAILLTDAFDFTDQCLNSALGCYDGNVYERLFQWAQKSPTNTQENPAYEEYIRPLLQSWKSKL

SEQ ID NO: 552 - protein, 660 aa, Homo sapiens [sequence omitted]

SEQ ID NO: 553 - protein, 709 aa, Candida tropicalis; identical to SEQ ID NO: 30

SEQ ID NO: 554 - protein, 655 aa, Streptomyces roseosporus; identical to SEQ ID NO: 521

SEQ ID NO: 555 - protein, 661 aa, Phascolarctos cinereus
MNPDLRRERDAASFDAEKLTYILDGGSERTRRRREIENLILNDPDFKHEDLNFLTRSERYEIAVRKSATMVKKMRDFGIADPEEIMWFKKPQLINFVEPVGLTYSMFIPTLLDQGTTAQQQKWLPPTQGLQIIGTYAQTEMGHGTHLRGLETTATYDPKTQEFILNSPTVTSIKWWPGGLGKTSNHAIVLAQLYTKGECYGLHAFIVPIREMGTHKPFPGIIVGDIGPKFGYDEMDNGYLKMDNYRIPRENMLMKYAQVKPDGTYVKPLSNKLTYGTMVFVRSFLVGEAARSLSKACTIAIRYSLIRHQSEIRPGDPEPQILDFQTQQYKLFPLLATAYAFQFVGAYMKETYHRINVDINQGNLNELPELHALAAGLKAFTSWTTNSGIEACRMACGGHGYSHCSGLPNIYVTFTPTCTFEGENTVMMLQTARFLMKSYDQVHSGKLVGGMVSYLNDLPSQRIQPQQVAAWPAMVDINNPDSLTEAYKHRAARLVEAAARNLQAEMKHRKSKEIAWNFTSVDLVRASGAHCHYVVVKLFSGNLSKIDDKPIQAVLTNLCLLYAPYGISQNSGDFLQGGILTESQLTQVNQRVKELLTLIRPESAALVDAFDFQDVSLGSVLGRYDGNIYENMFEWAKKSPLNKSEVHESYHKHLKPLQSKL

SEQ ID NO: 556 - protein, 661 aa, Mus musculus
  MOD_RES (277)..(277): Any amino acid
  MOD_RES (279)..(279): Any amino acid
MNPDLRKERAAATFNPELITHVLDGSPENTRRRREIENLILNDPDFQHEDYNFLTRSQRYEVAVKKSATMVKKMREFGIADPEEIMWFKKLHMVNFVEPVGLNYSMFIPTLLNQGTTAQQEKWMHPSQELQIIGTYAQTEMGHGTHLRGLETTATYDPKTQEFILNSPTVTSIKWWPGGLGKTSNHAIVLAQLITRGECYGLHAFVVPIREIGTHKPLPGITVGDIGPKFGYEEMDNGYLKMDNYRIPRENMLMKYAQVKPDGTYVKPLSNKLTYGXMXFVRSFLVGSAAQSLSKACTIAIRYSAVRRQSEIKRSEPEPQILDFQTQQYKLFPLLATAYAFHFLGRYIKETYMRINESIGQGDLSELPELHALTAGLKAFTTWTANAGIEECRMACGGHGYSHSSGIPNIYVTFTPACTFEGENTVMMLQTARFLMKIYDQVQSGKLVGGMVSYLNDLPSQRIQPQQVAVWPTLVDINSLDSLTEAYKLRAARLVEIAAKNLQAQVSHRKSKEVAWNLTSVDLVRASEAHCHYVTVKVFADKLPKIQDRAVQAVLRNLCLLYSLYGISQKGGDFLEGNIITGAQMSQVNSRILELLTVTRPNAVALVDAFDFKDVTLGSVLGRYDGNVYENLFEWAKKSPLNKTEVHQSYYKHLKPLQSKL

SEQ ID NO: 557 - protein, 856 aa, Toxoplasma gondii; identical to SEQ ID NO: 545

SEQ ID NO: 558 - protein, 673 aa, Streptomyces avermitilis; identical to SEQ ID NO: 152

SEQ ID NO: 559 - protein, 457 aa, Escherichia coli
MSVQQIDWDLALIQKYNYSGPRYTSYPTALEFSEDFGEQAFLQAVARYPERPLSLYVHIPFCHKLCYFCGCNKIVTRQQHKADQYLDALEQEIVHRAPLFAGRHVSQLHWGGGTPTYLNKAQISRLMKLLRENFQFNADAEISIEVDPREIELDVLDHLRAEGFNRLSMGVQDFNKEVQRLVNREQDEEFIFALLNHAREIGFTSTNIDLIYGLPKQTPESFAFTLKRVAELNPDRLSVFNYAHLPTIFAAQRKIKDADLPSPQQKLDILQETIAFLTQSGYQFIGMDHFARPDDELAVAQREGVLHRNFQGYTTQGDTDLLGMGVSAISMIGDCYAQNQKELKQYYQQVDEQGNALWRGIALTRDDCIRRDVIKSLICNFRLDYAPIEKQWDLHFADYFAEDLKLLAPLAKDGLVDVDEKGIQVTAKGRLLIRNICMCFDTYLRQKARMQQFSRVI

SEQ ID NO: 560 - protein, 499 aa, Escherichia coli
MSILYEERLDGALPDVDRTSVLMALREHVPGLEILHTDEEIIPYECDGLSAYRTRPLLVVLPKQMEQVTAILAVCHRLRVPVVTRGAGTGLSGGALPLEKGVLLVMARFKEILDINPVGRRARVQPGVRNLAISQAVAPHNLYYAPDPSSQIACSIGGNVAENAGGVHCLKYGLTVHNLLKIEVQTLDGEALTLGSDALDSPGFDLLALFTGSEGMLGVTTEVTVKLLPKPPVARVLLASFDSVEKAGLAVGDIIANGIIPGGLEMMDNLSIRAAEDFIHAGYPVDAEAILLCELDGVESDVQEDCERVNDILLKAGATDVRLAQDEAERVRFWAGRKNAFPAVGRISPDYYCMDGTIPRRALPGVLEGIARLSQQYDLRVANVFHAGDGNMHPLILFDANEPGEFARAEELGGKILELCVEVGGSISGEHGIGREKINQMCAQFNSDEITTFHAVKAAFDPDGLLNPGKNIPTLHRCAEFGAMHVHHGHLPFPELERF

SEQ ID NO: 561 - protein, 540 aa, Escherichia coli
MNTLPEHSCDVLIIGSGAAGLSLALRLADQHQVIVLSKGPVTEGSTFYAQGGIAAVFDETDSIDSHVEDTLIAGAGICDRHAVEFVASNARSCVQWLIDQGVLFDTHIQPNGEESYHLTREGGHSHRRILHAADATGREVETTLVSKALNHPNIRVLERSNAVDLIVSDKIGLPGTRRVVGAWVWNRNKETVETCHAKAVVLATGGASKVYQYTTNPDISSGDGIAMAWRAGCRVANLEFNQFHPTALYHPQARNFLLTEALRGEGAYLKRPDGTRFMPDFDERGELAPRDIVARAIDHEMKRLGADCMFLDISHKPADFIRQHFPMIYEKLLGLGIDLTQEPVPIVPAAHYTCGGVMVDDHGRTDVEGLYAIGEVSYTGLHGANRMASNSLLECLVYGWSAAEDITRRMPYAHDISTLPPWDESRVENPDERVVIQHNWHELRLFMWDYVGIVRTTKRLERALRRITMLQQEIDEYYAHFRVSNNLLELRNLVQVAELIVRCAMMRKESRGLHFTLDYPELLTHSGPSILSPGNHYINR

SEQ ID NO: 562 - protein, 572 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAQQISHFAADDAIFTCDVGTPTVWAARYLKMNGKRRLLGSFNHGSMANAMPQALGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSLYMLRAIISGRGDEVIELAKTNWLR

SEQ ID NO: 563 - protein, 700 aa, Homo sapiens
MASTVEGGDTALLPEFPRGPLDAYRARASFSWKDVALFTEGEGNVRFKKTIFSALENDPLFARSPGADLSLEKYRELNFLRCKRIFEYDFLSVEAMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYGLDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLKRHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 564 - protein, 653 aa, Streptomyces griseus; identical to SEQ ID NO: 101

SEQ ID NO: 565 - protein, 661 aa, Chelon labrosus
  MOD_RES (15)..(15): Any amino acid
MNPDITKERENATFXVEKLTNILDGGPEKTKRRRQIESLVFSDPDFKEEDPNFLSRSERYDQAVRKSAQMILKLREYGIADPEEIYYYKNMVKGNQQEAMGLHFAMFLPTLYSQCDPEQSKKWLPLAESFQAIGTYAQTELGHGTHLRGLETTATYDPATQEFVLNSPTVSSIKWWPGGLGKTSNHAIVLAQLYSLGNCHGLHAFIVPIRDMNTHEPLPGIVVGDIGPKFGFNEVDNGFLKLENVRIPRENMLMKYAKVDPDGTYMKPPSAKLTYGTMVFIRSMIVGESARALVKSCTIAIRYSAVRHQSEIRPGEPEPQILDYQTQQYKLFPLLATAYAFTFVGQYMQQTYQRITGDINQGDFSELPELHALSAGLKAFTTWETNSAIEVCRMSCGGHGYSRSSALPDIYVEFTPTCTYEGENTVMMLQTARYLVKSYRQAKAGQQLSGIVSYLNEAGDRRLQPQPVAARPTVVDINDLTSLVEVYKLRAAILVDLAAKSIQQELQRRKSQEDAWNNSAIDLVRASDAHCHYVVVKLFTDKLGEVGDTAIHSVLSNLALLYALNGITKNSGDFLLAGLLSVPQVLQSSVRIKELLSKLRPNAVALVDAFDVHDKKLNSVLGRYDGNVYENMFEWARRSPLNKTQVHESYHKYLKPLRSKL

SEQ ID NO: 566 - protein, 660 aa, Homo sapiens [sequence omitted]

SEQ ID NO: 567 - protein, 661 aa, Mus musculus; identical to SEQ ID NO: 363

SEQ ID NO: 568 - protein, 663 aa, Verrucosispora maris
MSSQPSVPVDVARLREVLDGPWAEVREAHRTELDDSFLPVYGETGDQARERITGLLPRLPVTMGMPAAFPAEYGGRSDIGASIVATEMLAQVDLSLMVKAGVQWGLFGGAVLSLGTGRHHDAYLRDIVAGDILGCFAMTETGHGSDVQQLRTTCTYDPATQTFDLHTPHQAARKDYIGNAARDGRMAVVFAQLITNGQRHGVHAWLVPIRDAQGNPMPGVTIGDAGPKAGLLGVDNGRLSFDHVTVPRDMLLDRYGQVAADGTYSSPISNDSRRFFTMLGTLVRGRASVGGAAAAATKVALTVAVRYGDIRRQFSSPDAEREVLLNDYLAHQRKLLPALATTYALHFAQAELVAAIDQVQGGDGPVDEHRQRELESRAAGLKAAQTWHATRTIQMCREACGGAGYLAENRLPGLKADTDVFTTFEGDNTVLLQLVAKGLLTGYRDEFGSLDGWGRASFVAEQVREMVLERTAARSLIERLVSAVPGRDEEVAVTDRGWQLKAFEDRERHLLDGAVRRLRNGASTKKDRPFDIFNDVQDHVLAVAAAHVDRVTLEAFVAGIEATSDPAVKALLSRVCDLYALSVIEAHKGWFLEHGRLTPARAKVITAVVNNLLKELRPQMGTLVDGFGIPQSWLHCAILREEADRQEAMAAHDAAGDPQTVPA

SEQ ID NO: 569 - protein, 664 aa, Solanum lycopersicum
MEGVDYLADERKKAGFDVDEMKIVWAGSRHDFELTDRISKLVASDPGFSKEGRTMLPRKELFKNTLRKAAYAWKRIIELRLSQEEATMLRRYVDEPAFTDLHWGMFIPAIKGQGTDKQQEKWLPLAYKMQIIGCYAQTELGHGSNVQGLETTATFDPQTDEFVIHSPTLTSSKWWPGGLGKVSTHAVVYARLITDGKDYGVNGFIVQLRSLEDHKPLPGVTVGDIGMKFGNGAYNSMDNGVLSFDHVRIPRDQMLMRVSQVTKEGKYVQSDIPRQLLYGTMVYVRQSIVADASLAMSRAVCIATRYSAVRRQFGSQNGGQETQVIDYKTQQNRLFPLLASAYAFRFVGEWLKWLYTDVTQRLAANDFSTLPEAHACTAGLKSLTTSATADGIEECRKLCGGHGYLCSSGLPELFAVYVPACTYEGDNVVLQLQVARFLMKTISQLGTGKKPVGTVSYMGRIEHLMQCRSDVKQAEDWLKPSAVLEAFEARSARMSVACAKNLSKFENQEEGFAELAADLVEAAVAHCQLIVVSKYIEKLQQNIPGKGVKQQLEVLCGIYSLFILHKHQGDFLGTGYITSKQGSLANDQLRALYSQLRPNAVSLVDAFNYTDHYLGSILGRYDGNVYPKLYEAAWKDPLNKSDIADGFHEYIRPLLKQQLRTAKL

SEQ ID NO: 570 - protein, 649 aa, Solanum lycopersicum
MEGIDYLAEERKKAEFNVDEMKIVWAGSRRAFEVSDYISKLVADDPGFSKEERTMLSRKELFKDTLRKSAYSWKHIIDLQLSEEEAEKLGYFVDEPAFIDSHLGVFIPAIKGQGNKEQLKKWLPLAYKMQIIGCYAQTELGHGSNVQGLETTATFDPQTDEFVIHSPTLTSSKWWPGGLGKVSTHAIVYARLITDGKDHGINGFIVQLRSLEDHKPLPGITVGDIGTKFGNGAYNTMDNGVLRFDHLHIPRDQMLMRVAQVTKDGKYVQSDVPRQLLYVSMVHVRQALVTYASGALSRAVCIATRYSAVRRQFGSQNGGQEIQVIDYKTQQSRLFPLLASAYAFRFVGEWLKWFCTDVTQRLKANDFSTLPELHATTAGIKSLTTTATADGIEECRKLCGGHGYLCSSGLPELYAVSVPACTFEGDNVVLLLQVARFLLKTLSQLSSGKKPTGTIAYMGKIEQLMQCHSDVEQAKDWLKPSAILEAFEARAARMSVSCAQSLSKFDYPEEGFQELATDLVEAAVAHCQLIVVSKFIEKLQQDIPGEGVKQQLVVLCSIYALFLLHKHQGDFLATGYITSKQGLFANEQLRALYTQVCLIGFVICVCCSFVYPKLYEAAWKDPLNESDIPDGFHEYIRPLLEQQLQTARL

SEQ ID NO: 571 - protein, 779 aa, Salinisphaera shabanensis
MSHRTDALVENAELQPLLPVIYIAWADGTLAQAESTHIKSIAEQLPAFDDEAQQTLDTWLDPDAPPTATELARLRRRIREQVGRRQPSLTAMSDAMSDASDGSVNEAVADYAREYGVSGMGVSAEIFQDTGEPVDQSVNEPEPSFEAAKLQTILEGDYAKKWQQVRDALAEDIFTYSTGESEESQRATVLRWLKYLATEKQDIAIGAMPESVGGQGDMAGFIHVFQALAMFDLSLVVKFGVQFGLFGGSIIFLGNDDHHQKYLPDIASGKLLGGFAMTESGHGSNVQEVETTATFDADTDEFVINTPTMSARKEWIGNAARDGHAVTLFAQLATGGENYGVHAFIVPIRTDDGEPAPGVRIEDCGSKMGLDGVDNGRLYFDNVRIPRENLLDRYASVAENGDYDSPISGSNKRFFTMLGTLVGGRISVGAASVTAAKKSLAIATRYATVRRQFGGADGSELRIIDYKTHQMRLFPAIAHTYAMHFAAFDLIARFRDRTDETAREVETLAAGIKSMASWHAIDATQTARECCGGLGFLAENQIATIRRDIDVFATFEGDNTVLLNLVSKNRLASFAKGFEQNLALTLVRELTSMARTELIDINPLTARKTDEDHLRSADFHLELLKLRKHNLLVAASRRLYKRVQQEDMEPFMAFSDIQDHMMAFAHADMHHHIAQTFADAVEPLADGPEKDALERMRQLSAIDTLLEHAEWYLTYGYISSGKYKALRNLRGALLGEIRPDALAYVEAFGIPDELLSAPIAFENYVGREPLKQAPRGERP

SEQ ID NO: 572 - protein, 779 aa, Salinisphaera shabanensis; identical to SEQ ID NO: 571

SEQ ID NO: 573 - protein, 779 aa, Salinisphaera shabanensis; identical to SEQ ID NO: 571

SEQ ID NO: 574 - protein, 779 aa, Salinisphaera shabanensis; identical to SEQ ID NO: 571

SEQ ID NO: 575 - protein, 637 aa, Nocardioidaceae bacterium
MTAIDAASLTALLDGRYAGVREDVRKSLIERADFLDEVEELPRPEYRERVREVLLDVSATGLTGLGFPKEYGGGGDVGASIAAFEEMAGGDLSLLVKSGVQFGLFGGAILQLGTARHHDRYLADIVSGRVLGCFAMTEHGHGSNVAAVATVATYDPATQEFVIETTREDAYKDYIGNAAAHGELAVVFAQLVVGGEERGVHAFVVPIRVSGAPAPGVRIEDDGPKMGLNGVDNGRLWFSDVRVPRTSLLNRFADVTEAGEYVSEIESAGRRFFTMLGTLVQGRVSVGGAAIRASEVALTIAVRYALRRRQFEASAEAEESLLIDYGQHQRRLLPLVARTYALRFAQEVVRDDLHDVFSGVTTSEHARRELESRAAGTKALATWHATRTIQECREACGGAGYLAANRFAALKADTDVFTTFEGDNTVLLQLVAKGLLTGYSSEFEEMDQLDLVRFVAGLAVETVLERTAVHKLLERVRDVVPIAGEREPDILDADYHLAMLRFREEHMLAGVARRLQSGVKAGREPGEVFSTVQDHVIGVAHAHVERLIHEAFREKVRVLPSGPVRDLMDTVCDLSALSVIEADRAWFMEHGRLSSERSKAIIGEVNRLCRDLRPHARLLVDGFGVPEELLRAKDLIG

SEQ ID NO: 576 - protein, 4048 aa, Clostridium papyrosolvens
MNKHELVKLLEKVQKREVHYIDAEYMIDEKKSEYNVESEGNEKNKIAVIGYSCRFPQADNADEFWNNILHGRDCITEIPKERWELDGFYDKNSDNNSETSYSKWGGFLGSLSHYDTVFLGMDKEELLTIDPQQLIIMEVVWEALEHAGYGNIRRENSDTGIFIGARANNCTLGMLDKNNTDLMEGSNRNYIIGKAPNMIAARLSDFLNLRGPSMVMDTACSSSLVSIHTACRSILAGDCTMALAGGIDLLVNSDSYVGLSKAKAISPDGKCYTFDKRANGYVPGEGAGIVILKEYSKAVADGDTIYGVIAGSSVNNDGHTMGITTPDLNGQKNLIKKALKNAKVSPENITYIEAHGTGTAIGDPIEVKALTETYRESTGRRGFCAIGSVKTNIGHLHSAAGIAGFIKILLCIKNKTLVPTLNCDIPNPRFNFVDSPFFPITKAVTWDNYGDKRRAAISSFGFGGTNCHIIIEEHNDFQVGEQEQQRYLPFVLSALNREALDGLIKKYINFLKKNKQLRYKDVAFVANAGRQAFSNKLFINASNIQELIAKLEDAEKGITDEKKSIFVGDKSKKAGNKLVLMFTGQGSLYTGAAKEIYDTNSLFKKTLDKCSDILMPYLGKSINELLFNPENTKLLSSTYITQPVTFALDYSLYILWRHLGLTPSVVIGHSLGEYVAACAAGVMDLEAALKLVVTRGKLMSELPENGAMAAVFTYENEVNQLLSELSYQERAVVSIAAVNGETNTVISGDKLVVDKVCRRFKEKSVKSVLLQVSHAFHSPQMESMLDKYREALRYIKPNKAQFKIVSNVTGDFIDGEALTEEYWLSHIMGTVQFNKSIKKLLSEGYKYFIELGPGTTLSQLTSKVAEGYNDITVAATLTRGKSDWLQLFDSMGKLNISGAEFDLTQFFQSVGAKRIALPLYSFTREEVINSNKDLPISCVSDETNIEFFDGILSKTEQYVSFYKILNADRDAVLGDHVVGGNCVVSGVYQIKLAAMGVQKLWNREIKAIEDIRFSEPIIAAKDKNLLIRVRIFKDNSNYFRIDRWDETLTNFIECSGGQYSFEDEPIKSKDDYENYADENQVTSEADKIYEYMDSVGLHYGPLYRGINKIVSGSTTASGEIKLTIEDSTDCSKVFHPGVVDSALQVVSAILFKNNIKDKYVPFCISKISVFGKMLDTNYKSKVKIFSDSNRSEILKADVILTDNNGQVIMKFNGIHFKKIEKNVSCHNLLFKPTWIEKPLLRIETTGIHKNVLIFMDEDNQQHNNIAAEIKSSGYDVYKVYRSNRNLNNDGHSFNVTQGEYSDLVLVLNKLQQKSLQLHNVLYLWSLDDYNRVEQAIGDINLNKHSHALDIIYLLRAIKENKINSKFKLITVTNNCQPALKGKDVLFPEKSEVLGVIKTIPLEFEQVQAVNIDFDCQDFKVQPISRSILTELSAIDKDAFIAYRNAKRFVMVIEKVKELKQDAINEITVRKGGTYIVLGGQGGLGVEIIKHLADKEQANFIVISRSEFPDVNQWGKLQNSQDLMNSRIKDNISAFKEVLAKGSRLAFYKADITDYDSLKAVFDEVRHKFGSINGIIHAAGVLQDALILNMDSEKFYSVLNPKMLGTVFADKLTENDPVDFMILFSGFVSYVGIMGQSNHTSANFFEDSFTYYRNFVKRKRTLTINWGIWGTIGIVAKPMYIQSLKEKGFAPMEVKEALDAFDKVISTDMPQVGIGHMSAEKQAELLYREGKRVDSGYSLSDEASCVGNILKHDIELDRLIKEVNQSYEFNFGRDLDILCAVFVMDYFKANGIFVEQDVYHTADNIRTTCKILPKFDRLVDAMLDILLKMDFIQAKGSKKFKRKGNICYNSINILSQQFKENYKNEDIYAIILDNCYSKYGEVISGQLNAMSVLFPGGNINIMEKLYHLPSPQNHYIGKVVKSIVSSHAPGKKVKILEIGGGTGGSTAKILKEINGLDVEYTFTDISPVLLKHASESFKEYTFVNYTQLDIEKEPYMQRLQKESFDIIIAANVLHATASLSNTFNNVMKVMKSNAVVVMLETTMITGFADLVFGLTEGWWKFEDADLRKNSTLLTPYEWRTCLNKLGFSRISTLPLKDRKSVRYPYSIIIAEGIKEKVDSISSTSQANQMVKPTERVKTIPIAQKTKSLPQKEGISYDSVLEFTKETIILKILEVSGIEKSSVDSDVGFLELGLDSLSLVALSGIIEKEIEISLYPTVFFEYQTIDALAAYLCEKHFNSIAKFINSNKKTAPMDDAEIEAEEVIELSEAAVITEEYRQETPEAVMPYYSEKDIAIVGMAGIFPGADDVYKLWDNLIKGVSSIKDISIERWNDSEVYSSIPGKDKTYCKWAGLVDNFDKFDPQFFNISVREAKRMDPQQRLFLETAWSAIENGGYTAKRLSDLRVGVFAGVSNHNYHNISYDRNDSFCTLSTSNAMVANRLSYFMNFTGPSLTIDTQCSSSMVALNYACQSILSGECEMAIAGGVNVIIPKEYYVLLSQVKAISPDGKCKTFDKTANGFISGEGSTALLLKPLSKALKDNDNIHAVIKSVAVTHDGKSSNTSAPNANSQYMAITEGMMKADINPETLSFIEAHGTGTSLGDPVEVSALTKSFEKFTDKKSFCAIGSLKTNIGHLESTAGIAGIIKAVLAIKNRIIPPTINFNQPNSYINFNETPFYIADRPIAWKSNELMRAGISSFGMGGTNCHTIIEEAPKLSMERIPGHPEVPFNLFTISAKSQHSLKLTMEKICNYIGNNIHLSLEDICHTMSVNRNHFSNRLSIVANSTEKLYKLMKEVLKNDFTVRQQSSAAINYSLVTAETSRYKKAKVVYLISDRTFEVNNIETISKNVMFKETVEYIKALLGLDEINSTSTINKALQEVIALALQVSMAKILMDFNVNAAVVVSAEKTGLPARVLSGRISLKEAISEIAYKHGIDINEAVEIQYMKFTETQIVEFDAIKDLYQSGEEQDTKVVTIELGPDDFYTDSILENVSFDGTSINILPFFQTGATEWYSIISLIGRIYTLGVDVDFEKFSCLFNGKTMDLPTYVFDNKSYWAINTEPKAEVKSFERPYTLKGLTASNRIVKSAIEIGMADKDGLITENYINKYKSWSSIGSGIKIIGNCIVDLKGRKNGNEVVLNSVNNQTYQLKRLSELLKSDGSLLLVQLNHGGVKSIDKLSEEEINELAGRFIEAAVAAKNGGADGIQLHAAHGYLLSNFLSPLLNTRSDNWGGCTKNRTALIISIADGIRKTLGDDFIIGIKIDMPSGKNGIDIEELVNIIKTLEDNRFDIVELSGGILSREEVLKSCYLPEYKKILATIKETAGIPIIITGGIRRLEQIEDLLTNSFADFVGIGRPFINSSDFIKDLKANKEGACTSCSMCFYTITSGELRCVKEVKQKTFAPPQCQRYLFEQQWVKTSENKEPEDKNIFKGTYALIGEDDIKLNILEEYLRHKGSTVVRVKKGLFYNAEAYGYTINYSNSEDYEKLMQDIYLKSGEKFRGVIHIPLHERNELLGSELNTDSGVFVHMYLAKAILAAKIIHSLKLISATFNGLAVPADKSVVPESALLVGLDRNIPYEVKNISSLAIDFNRNISNEDFANKLIYELSTFRSKFKEISYRNNERFIRITREFEGNINETGCSTDGGVYLITGGLSGLGAIFAEYFIRNNAEAVYLTGRRDIKELTDSKAISELEKLNNINRDIKNNTAIEYRKSDVSNPESLDSVVKEITSKYGRITGIVHCAGLVDSVNRTLRTKTYESFAKTISPKFQGTMNIGRAFMNILPDFMILCSSISGLNGKLGATLCDYAAANFYMNEYAKALAQNSGKKVVSVSWPLWEGVGLGAKKAYGGEDFSISSDMGLKIFDAVIKSKNCGNLIVLNTDKSDFSLNGLFKEEETLTFEKAADMKTSDVDKAASRESLKEYLKGLLVEFLQIEVSQISEYTNFSEYGIDSVIVADIVAVIERKYKIFLHPSIILEYPTINALADFLMEEYRVIEVGTEISGENKHERETLSDEVKLSQQTENNETDLVRLLDNIYKGEIAVDEALKIFGGES

SEQ ID NO: 577 - protein, 4048 aa, Clostridium papyrosolvens; identical to SEQ ID NO: 576

SEQ ID NO: 578 - protein, 637 aa, Nocardioidaceae bacterium; identical to SEQ ID NO: 575

SEQ ID NO: 579 - protein, 699 aa, Phalaenopsis sp.
MTKEAQMTSLASEHDTQQALRRIQKLSLHLLQPSPFLDPESSGDKNWIVPSPCTGGRGRPLLSVSRAELVEYMKGRHREIQERVFNFFVSRPELQTPVEISTADHRVLCMRQLTALVREAGIRPFRYAIEDPSVYFAIVEAVGGIDISLGIKLGVQYSLWGGSVMNLGTKKHKEKYFKGIDNIDYPGCFAMTELHHGSNVQGLQTTATFDPLTDEFVINTPNDGAIKWWIGNAAVHGKFATVFARLILPFQGKGGKSIDMGVHAFIVPIRDMETHDTLPMVEIHDCGHKVGLNGVDNGALRFQSVRIPRDNLLNRFGDVSRDGTYTSSLPTINKRFAATLGELVGGRVGLAYSSVGVLKVSVTIAVRYSLLRQQFGPPKQPEISILDYQSQQHKLMPMLASTYAFHFATLYLIDKYSEMKKSHDDDIVGDVHALSAGLKAYVTSYTAKSISVCRESCGGHGYAAVNRFGVLRNDHDIFQTFEGDNTVLLQQVAGDLLKQYKSKFRGGTLTVTWNYLRESMASYTAQPNPVTARWQGEEHLRDPNFQLDAFRYRTSRLLQSLGLRLRKHTKTLGGFGAWNRCLNHLLTLAESHIESVILAKFIEAVQKCPDKNTGNVLKLLCDLYALDRIWNDIGTYRNVDYVAPNKAKAIHKLVDYLSFQVRGIAGELVDAFGLPEIVVRAPIGMSSEAYSQYTEYVGF

SEQ ID NO: 580 - protein, 675 aa, Arabidopsis thaliana
MSDNRALRRAHVLANHILQSNPPSSNPSLSREVCLQYSPPELNESYGFDVKEMRKLLDGHNVVDRDWIYGLMMQSNLFNRKERGGKIFVSPDYNQTMEQQREITMKRIWYLLENGVFKGWLTETGPEAELRKLALLEVCGIYDHSVSIKVGVHFFLWGNAVKFFGTKRHHEKWLKNTEDYVVKGCFAMTELGHGSNVRGIETVTTYDPKTEEFVINTPCESAQKYWIGGAANHATHTIVFSQLHINGTNQGVHAFIAQIRDQDGSICPNIRIADCGHKIGLNGVDNGRIWFDNLRIPRENLLNAVADVSSDGKYVSSIKDPDQRFGAFMAPLTSGRVTIASSAIYSAKVGLSIAIRYSLSRRAFSVTANGPEVLLLDYPSHQRRLLPLLAKTYAMSFAANELKMIYVKRTPETNKAIHVVSSGFKAVLTWHNMHTLQECREAVGGQGVKTENLVGQLKGEFDVQTTFEGDNNVLMQQVSKALFAEYVSCKKRNKPFKGLGLEHMNSPRPVLPTQLTSSTLRCSQFQTNVFCLRERDLLEQFTSEVAQLQGRGESREFSFLLSHQLAEDLGKAFTEKAILQTILDAEAKLPTGSVKDVLGLVRSMYALISLEEDPSLLRYGYLSQDNVGDVRREVSKLCGELRPHALALVTSFGIPDSFLSPIAFNWVEANAWSSV

SEQ ID NO: 581 - protein, 440 aa, Tropaeolum majus
MTLPGSSTKQDNSDNKDRSSYFNLPALDIYAAFPQATPASKLPPTVSDYYKFDDLLTPEEQALRIKVRECMEKEVAPIMTEYWEKAEFPFHIVPKLGALRIAGGTIKGYGCPGLSITGSAIATAEVARVDASCSTFILVHSSLAMLTIALCGSESQKQKYLPSLAQLSDVACWALTEPDYGSDASGLRTIATKVEGGWLLEGQKRWIGTVPLQISWIIFARNTSTNQINGFIVKKDAPGLTATKIQNKIGLRIVQNGDILLKKVFVPDEDRLPGVNSFQDTNKVLAVSRVMVAWQPIGISMGIYDMCHRYLKQRKQFGAPLAAFQINQQKLVTMLGNVQAMVLVGWRLCKLYEKGQMTTGQASLGKAWISSKARETAALGRELLGGNGILSDFLVAKAFCDLEPIYTYEGTFDINTLVTGREVTGLASFKPATSSQRSRL

SEQ ID NO: 582 - protein, 709 aa, Candida tropicalis; identical to SEQ ID NO: 348

SEQ ID NO: 583 - protein, 684 aa, Zea mays
MDLTSPSPAARRAAAIARHLAAAAAPIPASSALEPSCCLSYVPPESTERPAAFAPADLRLLLDGHDLPTRDWLFRAMEESPLFRSRSSRTGSRVFVAPDFNDGKEGQREATMRRIAYLNRRGVFRGWLTEDGAAAELRKLALLDCIAIYDHSLAIKIGVHFFLWGSAIKFLGTKRHHDKWLVATENYDIKGCFAMTELGHGSNVRGIETIATYDSETREFIINTPCESAQKYWIGGAANHATHTIVFCQLHINGRNEGVHAFVAQIRDEDGTVLPNIHIADCGHKIGLNGVDNGRIWFQNIRVPRENLLNLVADVLPDGRYVSMIDNPDQRFAAFLSPLTLGRVNIAVNSVYISKVSLAIAVRYSLSRRAFSIAPDAPEMLLLDYPSHQRRLLPLLAKVCLMSSAGNFMKNMYVKRTPEMSKDIHIYSSALKATLTWQNMITIQECREACGGQGLKTENRIGIFKSEFDVQSTFEGDNNVLMQQVSKALYAEFLGAQKKQQPFKGLGLEHLNGSSPVIPDKLTSSILRSSKFQMDLFCLRERDLLKQFVEEVSLHLAQGESREKALMLSYQVAEDLARAFTERTILQIFLEDEMNVPSGSLKEVLGLLRSLYVMVNIDESTSFLRYGHLSRDNVALVRKEVLKLCSELRPHALAVVSSFGIPDAFLSPLAFDWIEANALSTGSH

SEQ ID NO: 584 - protein, 426 aa, Escherichia coli
MTEHTSSYYAASANKYAPFDTLNESITCDVCVVGGGYTGLSSALHLAEAGFDVVVLEASRIGFGASGRNGGQLVNSYSRDIDVIEKSYGMDTARMLGSMMFEGGEIIRERIKRYQIDCDYRPGGLFVAMNDKQLATLEEQKENWERYGNKQLELLDANAIRREVASDRYTGALLDHSGGHIHPLNLAIGEADAIRLNGGRVYELSAVTQIQHTTPAVVRTAKGQVTAKYVIVAGNAYLGDKVEPELAKRSMPCGTQVITTERLSEDLARSLIPKNYCVEDCNYLLDYYRLTADNRLLYGGGVVYGARDPDDVERLVVPKLLKTFPQLKGVKIDYRWTGNFLLTLSRMPQFGRLDTNIYYMQGYSGHGVTCTHLAGRLIAELLRGDAERFDAFANLPHYPFPGGRTLRVPFTAMGAAYYSLRDRLGV

SEQ ID NO: 585 - protein, 700 aa, Mus musculus
MGSLPEEKDSALWSDTPKGPLSAYRARASFNSGELLLFWDGQDVIHFKKTIFSTLENDPLFARSYGADLPLEKLRELNFLRCKRVFEYGFFKVEELLKNPLKILVLINCLGMYDWSLANKCVLHMLVFGTTVFVSGSEKHFKYLEKIYSLEIFGCFALTELSHGSNTKAMRTTAHYESDTQEFILHSPDFEAAKFWVGNLGKTATHAVVFAQLYMPDGQCHGLHSFLVQIRDTKTLLPMTGVMVGDIGKKLGQNGLDNGFAMFNKVRIPRQNLLDRTGNITSEGTYNSPFKDVRQRLGASLGSLSSGRISIISMSVVNLKLAVSIAIRFSATRCQFGPTDKEEIPVLEYPLQQWRILPYLAAAHALDHFSKTIFMDLIEVQSARLRGDHSDQQAELGREIHALASAGNRLASWTAQRGIQECREACGGHGYLAMNRFGDLRNDNDPNCTYEGDNNVLLQQTSNYLLSLLEPPLQDGAHFTSPLKTVDFLEAYPGILGQKFLGSSKADWMDSAAPLAAYRWLVCYLLQESHRRYCQEKKSRGSDFEARNNSQVYGVRPLALAFMELTVMQRFHEHIHSSGLSPSLRTVLGRLSSVYGLWCLSQHMALSYRGGYISGEQTGRAMEDAILTLCEQLKDDAVALVDVIAPSDFVLNSPIAKADGELYKNLWARVLQQNGVLERARWWPEFSANKSVADRLKSQL

SEQ ID NO: 586 - protein, 681 aa, Mus musculus
MGNPGDRVSLGETWSREVHPDIDSEWHSPSFSVERLTNILDGGIPNTELRRRVESLIQRDPVFNLKHLYFMTRDELYEDAVQKRFHLEKLAWSLGWSEDGPERIYADRVLAGYNNLNLHGIAMNAIRSLGSDEQIAKWGQLGKNFQIITTYAQTELGHGTYLQGLETEATYDATTQEFVIHSPTMTSIKWWPGDLGRTVTHAVVLAHLICLGARHGMHAFIVPIRSLEDHTPLPGITVGDIGPKMGFENIDNGFLRLNHVRVPRENMLSRFAEVLPDGTYQRLGTPQSNYLGMLVTRVQLLYKGFLPTLQKACTIAVRYAVIRHQSRLRPSDPEAKILEYQTQQQKLLPQLAVSYALHFMTTSLLQFFHSSYSDILKRDFSLLPELHALSTGMKAMSSDFCAQGTEICRRACGGHGYSKLSGLPTLVTQAIASCTYEGENTVLYLQVARFLMKSYLQAQVSPGSIPQKPLPQSVMYLATPRPARCPAQTAADFRCPEVYTTAWAYVSARLIRDATQHTQTLMRSGVDQYDAWNQTSVIHLQAAKAHCYFLTVRNFKEAVEKLDNEPEIQRVLQNLCDLYALNGILTNSGDFLHDGFLSGAQVDMARTAFLDLLPLIRKDAILLTDAFDFSDHCLNSALGCYDGHVYQRLFEWAQKSPANTQENPAYKKYIRPLMQSWKPKL

SEQ ID NO: 587 - protein, 661 aa, Cavia porcellus; identical to SEQ ID NO: 373

SEQ ID NO: 588 - protein, 721 aa, Ciona intestinalis
MALSPESQLITNERNKTTFNVTELTNILDGGLEKTALRKSIERKISLDPNMKTIHRGYLNKEQINFQNNRKMMYFFTDLAKRNNWHMDKPHSADMEFLPRTLANASGLLIHAGAFVPSIVSFGTPEQAAKWLPLAKACQIIGAYAQTELGHGTNLRRLETTATFDPRSQEFIMNTPSISSMKWWPGALGEMATHALVMAQLITRGENHGMQAFIVPVRDMTNHKPLPGITVGSIGPTLALDSTDNGYLRMDNVRIPKENMLAKYAYVDSKGKFQKIGNDRLMYASMVNLRVVLAKDEAVTYIQMACTIAARYSCVRKQGSLTPGGPEVQIIDYVTQQNKIIPYIALSYALHFNLAFIRSKYVKFLEDVKRGDLSNMAEMHMMTAGMKAIATERTSAGVEILRRSCGGHGYAVSSGLPYILLRLVASCTYEGENTVLYLQAARYLIKTAAKVSMGQPVDASVMYLTEDAPDKCQAANQMELCDHSILEACFKHRSRQLLLSVATELQSLVADGMKQMEAWNLVSIQLVNAAKAHMEQHIVSTFSSYLRNLKCSSAVREVLDQLCSLNALHQINNFPGDFLKDGYLSSKQLDMARKAEVKLLASLRRNVVGLVDAFDFTDDMLGSCIGSYDGNAYERLYEWAKNFPSNKTDDGYLSSKQLDMARKAEVKLLASLRRNVVGLVDAFDFTDDMLGSCIGSYDGNAYELLYEWAKNFPSNKTDVNF

SEQ ID NO: 589 - protein, 663 aa, Candida albicans
MSTELQKEREQIKFNPKEVNYFLEGSKERSDIVSNLVEQMEKDPVLKVDASYYNLTKEEQREDTAKKIDRISRYFENEFPDQQAQRLSILGVFDPQVFTRIGVNLGLFVSCIRGSGTNSQFFYWTINKGVDKLRGIYGCFGMTELAHGSNVQGIETTATFDKETDEFVINTPHISATKWWIGGAAHSATHCTVYARLKVNGKDYGVKTFVVPLRDSNHDLMPGVTVGDIGAKMGRDGIDNGWIQFSNVRIPRFNMLQKYAKVSREGEVTMPPSEQLGYSALIGGRVTMMMDSYRMTSRFVTIALRYAIFRRQFKSKISGGDQETKLIDYPLHQKRLFPYLAAAYLFSQGALYLEQTMNETNERLDDAVSEGDKKKIDEAIVASKKLFVASGCLKSTCTWLTADAIDQARQACGGHGYSSYNGFGKAYSDWVVQCTWEGDNNMLAINVAKPMVKEILQEPEQKGLVIANVSDLNDPAKLDKAFEHALSGLARDIGAVAKDQGYDVTGPSLVLVSKLNAHKFLIDGFFKRITPEFAPILKPLGFLYADWIIETFSSVFLSYGVIAPEVIKKISSEHFPVLAKQIRPNVAGLTDAFNLSDMLTNAAIGRADGNVYDHYFETVKKLNPPENTKAPYSQALQDMLNRPSVEERQRGERSEEAAEILSS

SEQ ID NO: 590 - protein, 663 aa, Candida albicans; identical to SEQ ID NO: 589

SEQ ID NO: 591 - protein, 670 aa, Mytilus galloprovincialis
  MOD_RES (219)..(219): Any amino acid
  MOD_RES (314)..(314): Any amino acid
MSQGNVTPDLARERSKATFDVENLAEFMIGGRDRLKRKRFLQNIAIQDPFFKKQKSWSFCSVEEQYDMGLSKSIYIQKKLQEMGITDMQEAFYYRECAAAHENSPLGLHYAMFLPTINKQATPEQKKKWLPLAENYKMIGTYAQTELGHGTFIRGLETTATYDPKTKEFILDSPTLTSKKYWPGCLGKTSNHCVVMAQLYTQGKSHGPHMFMVQIRSMXDHSVLPGIEVGVIGNKFGYGTNDNGFLSFDKLRIPRENMLMRYSQVHEDGTYVKPQNAKLAYGSMVLIRSSIVSDAARGLAQACVISIRYSAVRXQTEAYPGGEEPQILDYQTQQYRLFPLLASAYSLQLAGKYVFNTYLEVNDQIEKGNLESMPELHALSAGLKAFSTYEASAGIEVCRICCGGHGYSQASGLPKIYVDVVPGCTYEGENTVMMLKTARYLMKCYSRAKQGQKLPGFVQYIGQNLNKKSCMSEEVALGCLVMAYEHRAARLVEAAAMRMQSLIQGGKKQHEAWNGSSVQLFWAAKAHCHLFCVKNFVDAIQAKSLSLQTTTVMKSVCQLYGVHGILENLGEFMQDGFFSGKQVGYLQRKMLALFEHIRPNAVALVDAFDYPDMVLGSCLGRYDGQVYQALYDYAKSAPMNQTEIHSTYYKHLKPLINPETTSDAMQFAKL

SEQ ID NO: 592 - protein, 895 aa, Arabidopsis thaliana
MALLRRDLLGYTPLYAEKLDPSLSSIVYKVDISLLGDSKESFYFGSLEGVLAQRYPNQWPSEDEDFFEKVGALNDPTAVVRLLRYPELDRNICNQWKLKPHSGSLSQVLISALVMIIGEVISSDVETYGASAHSDYGMVTLLLTDGVPGLQVCRDKSKQPHIWEDVPGIKGAFIVNIGDMMERWTNGLFRSTLHRVMPVGKERYSLLDSELRIMEGIDHLADERNKAEFDVEDMKIVWAGSRHAFEVSDRIARLVASDPVFEKSNRARLSRKELFKSTLRKCAHAFKRIIELRLNGMDCSHTQEEAGRLRHFIDQPAYVDLHWGMFVPAIKGQGTEEQQKKWLSLANKMQIIGCYAQTELGHGSNVQGLETTATFDPKTDEFVIHTPTQTASKWWPGGLGKVSTHAVVYARLITNGKDYGIHGFIVQLRSLEDHSPLPNITVGDIGTKMGNGAYNSMDNGFLMFDHVRIPRDQMLMRLSKVTREGEYVPSDVPKQLVYGTMVYVRQTIVADASNALSRAVCIATRYSAVRRQFGAHNGGIETQVIDYKTQQNRLFPLLASAYAFRFVGEWLKWLYTDVTERLAASDFATLPEAHACTAGLKSLTTTATADGIEECRKLCGGHGYLWCSGLPELFAVYVPACTYEGDNVVLQLQVARFLMKTVAQLGSGKVPVGTTAYMGRAAHLLQCRSGVQKAEDWLNPDVVLEAFEARALRMAVTCAKNLSKFENQEQGFQELLADLVEAAIAHCQLIVVSKFIAKLEQDIGGKGVKKQLNNLCYIYALYLLHKHLGDFLSTNCITPKQASLANDQLRSLYTQVRPNAVALVDAFNYTDHYLNSVLGRYDGNVYPKLFEEALKDPLNDSVVPDGYKNTFDLCFSSNFVPLGSEEFSLLDTRYG

SEQ ID NO: 593 - protein, 681 aa, Homo sapiens; identical to SEQ ID NO: 342

SEQ ID NO: 594 - protein, 895 aa, Arabidopsis thaliana; identical to SEQ ID NO: 592

SEQ ID NO: 595 - protein, 681 aa, Homo sapiens; identical to SEQ ID NO: 342

SEQ ID NO: 596 - protein, 681 aa, Rattus norvegicus; identical to SEQ ID NO: 343

SEQ ID NO: 597 - protein, 700 aa, Rattus norvegicus; identical to SEQ ID NO: 350

SEQ ID NO: 598 - protein, 700 aa, Yarrowia lipolytica; identical to SEQ ID NO: 361

SEQ ID NO: 599 - protein, 643 aa, Hordeum vulgare
MKVAWAGSQHAVEVADRMARLVASDPVFRKDTRTMLSRKELFKDTLKKAAHAWKRIVELRLTEEEANLLRLYVDQPGYVDLHWGMFVPAIKGQGTEEQQKKWLPMAYKFQIIGCYAQTELGHGSNVQGLETTATFDPSTDEFVMHSPTLASCKWWPGGLGKASTSLRLSCSSHNGRKRLWHTWFHCAVAKLDDHSPLPGVTLGDIGGKFGSGAYNSMDNGVLRFDHVRIPRDQMLMRLSQVTREGKYVHSDVPKQLLYGTMVYVRQTIVADASKALSRAVCIAVRYSAIRKQFGSQAGGPETQVINYKTQQRRLFPLLASAYAYRFVGQWLKWLYTDVTQKLEAKDYSTLPEASCLYCWAQVCDNICHTDAIEECRKLCGGHGYLNSSGLPELFAVYVPACTYEGAMRFAVAGCKVFDEDRLSGGHWEPTCRHRSSHGQHTALDAMQKRCKYSRRLVNPAAVKEVFEARALRMAVNCAQNISKAPSQEEGFSELSPDLLEAAVAHVQLIIVTKFIEKIEEDIPGPGVKEQLQKLCSIYALHLLHKHLGDSLSTGCVTARQGALANEQLGKLYAQVRPNAVALVDAFDYTDHYLGSVLGRYDGDVYPALYEEAWKDPLNETVVPDGYQEHLRPLLKQQLKLSRL

SEQ ID NO: 600 - protein, 663 aa, Candida albicans; identical to SEQ ID NO: 589

SEQ ID NO: 601 - protein, 663 aa, Candida albicans; identical to SEQ ID NO: 589

SEQ ID NO: 602 - protein, 700 aa, Homo sapiens; identical to SEQ ID NO: 349

SEQ ID NO: 603 - protein, 731 aa, Homo sapiens [sequence omitted]

SEQ ID NO: 604 - protein, 683 aa, Coccomyxa subellipsoidea
MADAGPLQRLGVLLKHLTLGDTDGHNGIALSPTAARGVSLPRFDTTVMESYLDELSSVKEDVYETFRHRPNLLPATLEGLSKEEHRELARQQLKLLLKAGYSPLRFYLHDIKKYFYLGELLAVVDLSLTVKMGVQYNLWGGSILNLGTEKHKKAYFEDIDKFRLPGCFAMTELYHGSNVAALQTEAVLDIATDEWIISTPDDGALKWWIGNAAEDGRAATVFARLKVPSPDGSGTLVDHGVHAIVVPLRDEAGTVLQGVEIKDCGYKVGLNGVDNGSIRFLGVRVPRENLLDRFASVDRSGQYRSPYSASRRFAATLGELTGGRVGLICSSLGVLKASLTVAVRYGATRQQFGPANAPEIAVLDYSSQQEKLMPMLASAYAIHFTSRYLVDQYAEAKRTKEEDVIADVHALSAGLKAYVTNYTATALSVCRECCGGHGYAAVNRFGMWRSDHDIFQTFEGDNTVLLQQVAGLLLKKYKERFAVAPVTATYRYLRQWAAESLPPNPLVSHETSVRHLRDPAFLVRALRYRTGKLLFTLAQRLSKHTRRMGQFQAWNKCLSHILTLARAHIESVMFERFLDGVNNCPDADCKKSLKVMAEVFALQRIQADVMFRNDDYVAAEKVKAIGRLLERLRAEIRAQAVPLVDAFNIPDHILRSPIGLSHQDPYDHYLEGAGWTATTPLTS

SEQ ID NO: 605 - protein, 649 aa, Mycobacterium abscessus
METRTAPADPEVLTSNLRVALDGRFGPIRDAAREYLNRADLLPDPSLTLEQARARSLRIMRELVPHGLPHAGFRTEHGGTGDVGAAIVGIEMLGYADLSLMVKAGVQWGLFGGAIENLGTATHHEQYVVPLINLDVLGCFGMTETGHGSNVQALQTVATYDRTTGDFVLNSEGSLARKDYIGGAAEHATVSAVFAQLVTGGPGEEATGRGVHCFVVPIRDADGNDLPGITTSDCGYKGGLAGVDNGRIVFDNVRVPRANLLNRYADVAEDGTYSSPIENENKRFFTMLGTLIRGRVSVAATSGAAARKALTIASRYALVRKQFDTPDSDDEVIIADYLVHQRKLLPLIARSYALAFAQNELTEELHQVQTADEVDADRQRQLESAAAGLKAMTSWHAQHAITVCREACGGAGYLDANQLTILRRDIDVFTTFEGDNTVLTQLVAKELLSAYAEDVRGLNAVGWTRFIAGMARDVILERSAARQVIQTILDSSDEDVEESDLSNRGTQLRLLRNREDHLLRTAATRMQRAQSDDEDPFEVFNSAQDHILKVGSAHTERVVLEAFIEAIDSCDSKSAQELLEKLCDLFVYSALEADLSWFLMHRHVSTERAKAIRRGVNQLCEELRPHLGTLVDAFGIPEALLATEMIPDN

SEQ ID NO: 606 - protein, 649 aa, Mycobacterium abscessus
METRTAPADPEVLTSNLRVALDGRFGPIRDAAREYLNRADLLPDPSLTLEQARARSLRIMRELVPHGLPHAGFRTEHGGTGDVGAAIVGIEMLGYADLSLMVKAGVQWGLFGGAIENLGTATHHEQYVVPLINLDVLGCFGMTETGHGSNVQALQTVATYDRTTGDFVLNSEGSLARKDYIGGAAEHATVSAVFAQLVTGGPGEEATGRGVHCFVVPIRDADGNDLPGITTSDCGYKGGLAGVDNGRIVFDNVRVPRANLLNRYADVAEDGTYSSPIENENKRFFTMLGTLIRGRVSVAATSGAAARKALTIASRYALVRKQFDTPDSDDEVIIADYLVHQRKLLPLIARSYALAFAQNELTEELHQVQTADEVDADRQRQLESAAAGLKAMTSWHAQHAITVCREACGGAGYLDANQLTILRRDIDVFTTFEGDNTVLTQLVAKELLSAYAEDVRGLNAVGWTRFIAGMARDVILERSAARQVIQTILDSSDEDVEESDLSNRGTQLRLLRNREDHLLRTAATRMQRAQSDDEDPFEVFNSAQDHILKVGSAHTERVVLEAFIEAIDSCDSKSAQELLEKLCDLFVYSALEADLSWFLMHRHVSTERAKAIRRGVNQLCEELRPHLGTLVDAFGIPEALLTTEMIPDN

SEQ ID NO: 607 - protein, 700 aa, Macaca mulatta
MAPTVEGGDAALLPEFPRGPLDAYRARASFSWKELALFTEGEDMLRFKKTIFSALENDPLFARSPGADLSLDKYRELNFLRCKRIFEYDFLSVEDMFKSPLKVPALIQCLGMYDSSLAAKYLLHTLVFGSAVYSSGSERHLTYIQKIFSMEIFGCFALTELSHGSNTKAIRTTAHYDPATKEFIIHSPDFEAAKFWVGNMGKTATHAVVFAKLHVPGDQCHGLHPFIVQIRDPKTLLPMPGVMVGDMGKKLGQNGLDNGFAMFHKVRVPRQSLLNRMGDVTPEGTYVSPFKDVRQRFGVSLGGLSSGRVSILSLAVVNLKLAIAIALRFSATRRQFGPTQEEEIAVLEYPMQQCRLLPYLAAAYALDHFSKSLFLDLVELQRGRASGDRSARQAELGREIHALASAGKPLASWTAQQGIQECREACGGHGYLAMNRLGVLRDDNDPNCTYEGDNNVLLQQTSNYLLGLLAHRVRDGACFRSPLKSVDFLDAYPSILDQKFEVSSVADCLDSAVALAAYKWLVCYLLRETYQKLNQEKRSGSSDFEARNNCQVSHGRPLALAFLELTVVQRFHEHVHQPCVPPSLRAVLGRLSALYALWSLSHHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 608 - protein, 696 aa, Toxoplasma gondii
MSETATTEFDGSVVHPDLEYERKRCSFRIPDFTYALYGREGFAVLTKLRLALARNPAFDLRYLWSADGTTQQYVRGCWLAEEVVKVIRQLELIDRDDAIGPLQILAGEDMFVMLHLTMFLPTLKNMCDEEQARYWVPLAEDFRIIGTYCQTELAHGSNVSGLETTADFDDKTDEWVLNTPSLQSTKWWPGGLAKSCTHCVCMARLRIHDKDYGVHPFILQVRDLNTHESLPGVKLFHIGKKLGYNSMDNGGVQLHNVRIPRRNLLMKYCHVDRQGTYKPLGSKKLMYGTMTFTRKQIIMAAGPQLAKSVVIAIRYSAVRRQFPMTMKKHETKDSSRDAEVQILDYSTQQITLFPLLAAAVAYTVTGIWMDAFYNSFIEDAKKDDFSKLEEIHAVTSCLKAMMSLSVADGMEKCRKACGGHGFLLASGIPIQFVNFVPVATYEGDRVVLSVQTARVLLKIVQRKMMSRDPKHTLAGTTLEYIHNFDPFGDHQPPAIENTPWFDPDWLMEIHRRRSCGLVYKAAQQYAAETSSGKDMMEALDLVKVEFTRLGTAHAQVLVLHFFLEAVKRVELVEVREVWVDLWLCLALSWCDEHFGEFVITRALGPDHHDGLMTAFKTILRKIRPNAVAIADAFWIPDQLLNSALGRYDGRVYEALMESTKMEPLNRLDVPPGYLEHIQYILHPERKKRSSPAHSKL

SEQ ID NO: 609 - protein, 692 aa, Danio rerio; identical to SEQ ID NO: 495

SEQ ID NO: 610 - protein, 695 aa, Nesterenkonia sp.
MSQTARPTAARDSGTAGTADTADDARGRPEPDGAVLQELLLGRWAETRRTARAVAADPRFHRIEGLSTAEHRERVFAQLAGLVEEGAVQRAFPKEYGGQDAHGANIAAFEELVVADPSLQIKAGVQWGLFGAAVMHLGSEEHHRRLLPPIVDLRVPGAFAMTEIGHGSDVASIGTTAEYDPESEEFVLHTPFTGATKRYLGNAAVHGRDAVVFAQLITNGVNHGVHCFYCRIRDEDGTARDGVTISDDGEKGGLNGVDNGRLSFDRVRVPRADLLDRYGAVAADGAYSSPIESPGRRFFTMLGTLVQGRVSLTGASIAASKIALQGAITYGEQRRQFHASSTTEEEVLMDYQLHQRRLIPKLATTVAAGFAHEKLLTKLDDVFSGADDSDENRQELETLAAALKPTATWHALDTLQEAREACGGAGFMAENRFATLRADLDVYATFEGDNNVLLQLVAKRLLSDYAAEFRQADVGALSRYVVSQAQSTVLHRFGLRRALQNVQDTGDERRSANWFKQTEVQRSLLSDRVRQMVADVASALRSTSKLGPAEKAEAFNEHQHQIISAAAAHADLLLWESFTQALETVEHEDTRTVLTWLRDIHALSTIEHHLDWHLLHGRISAQRARTLTPYLNRLLARVRPYARQIAECFGYTADHLRMEVASGAEAERQAEAAEFHRRRRASGDAPVDEKTLRRR

SEQ ID NO: 611 - protein, 856 aa, Toxoplasma gondii; identical to SEQ ID NO: 545

SEQ ID NO: 612 - protein, 700 aa, Canis lupus
MASPLEGGADALLLDLPRGPLQAYRARASFCWKELVLFLEGEDVLRLKKTIFSTLENDPLFARSHEEDISLDRYRELSFLRCKRIMEYNLLPLEDMVANPLWFQVFTNCLGMYDWSLAIRLLLNMVTFGLAIYNLGSERHLKYLPKIFNMEIFGCFAVTELSHGSNAKAIRTTAHYDPITQEFIIHSPDFEAAKFWVGNMGKTATHAVVFAQLYTPEGQCHGLHPFVVQIRNPKTLLPMPGVMIGDMGKKVGLNGIDNGFAMFHKVRIPRQDLLNRNGEVTLEGTYVTPFKDDRQRFGASLGTLSMGRVAIVGMSTVNLKLAVSIALRFSATRCQFGPSDEEEVPVLEYQMQQWRLLPYLAAVYALDHFSKSLFLDLVDLQQGLMGKDQSARQAELGREIHALVSASKPLASWTAQKGIQECREACGGHGYLAVNRLGDLRNDNDPNCTYEGDNNILLQQTSSYLLSLLASRIERGVRLESPLKTVDFLEAYPEILGQRFSCPSINSCLDSSVPLAAYEWLVCYLLLESYQKLNEEKRSGRNDFEARNNSQVYYCRPLALAFLELTVVRRFHEYTHQPSVPPPLRAILGRLSALYALWTLSQHMALLYQGGYFSGEEAGKMIQNAILTLCSQLKDDAVALVDVIAPPDFVLDSPIGRADGELYKNLWTAVLQESEVLKRPSWWLEFTVNKPRVGSLKSKL

SEQ ID NO: 613 - protein, 700 aa, Macaca fascicularis
MAPTVEGGDAALLPEFPRGPLDAYRARASFSWKELALFTEGEDMLRFKKTIFSALENDPLFARSPGADLSLDKYRELNFLRCKRIFEYDFLSVEDMFKSPLKVPALIQCLGMYDSSLAAKYLLHTLVFGSAVYSSGSERHLTYIQKIFSMEIFGCFALTELSHGSNTKAIRTTAHYDPATKEFIIHSPDFEAAKFWVGNMGKTATHAVVFAKLHVPGDQCHGLHPFIVQIRDPKTLLPMPGVMVGDMGKKLGQNGLDNGFAMFHKVRVPRQSLLNRMGDVTPEGTYVSPFKDVRQRFGVSLGGLSSGRVSILSLAVVNLKLAIAIALRFSATRRQFGPTQEEEIAVLEYPMQQCRLLPYLAAAYALDHFSKSLFLDLVELQRGRASGDRSARQAELGREIHALASAGKPLASWTAQQGIQECREACGGHGYLAMNRLGVLRDDNDPNCTYEGDNNVLLQQTSNYLLGLLAHRVRDGACFRSPLKSVDFLDAYPSILDQKFEVSSVADCLDSAVALAAYKWLVCYLLQETYQKLNQEKRSGSSDFEARNNCQVSHGRPLALAFLELTVVQRFHEHVHQPCVPPSLRAVLGRLSALYALWSLSRHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 614 - protein, 700 aa, Macaca mulatta; identical to SEQ ID NO: 607

SEQ ID NO: 615 - protein, 649 aa, Mycobacterium abscessus
METRTAPADPEVLTSNLRVALDGRFGPIRDAAREYLNRADLLPDPSLTLEQARARSLRIMRELVPHGLPHAGFRTEHGGTGDVGAAIVGIEMLGYADLSLMVKAGVQWGLFGGAIENLGTAAHHEQYVVPLINLDVLGCFGMTETGHGSNVQALQTVATYDRTTGDFVLNSEGSLARKDYIGGAAEHATVSAVFAQLVTGGPGEEATGRGVHCFVVPIRDADGNDLPGITTSDCGYKGGLAGVDNGRIVFDNVRVPRANLLNRYADVAEDGTYSSPIENENKRFFTMLGTLIRGRVSVAATSGAAARKALTIASRYALVRKQFDTPDSDDEVIIADYLVHQRKLLPLIARSYALAFAQNELTEELHEVQTADEVDADRQRQLESAAAGLKAMTSWHAQHAITVCREACGGAGYLDANQLTILRRDIDVFTTFEGDNTVLTQLVAKELLSAYAEDVRGLNAVGWTRFIAGMARDVILERSAARQVIQTILDSSDEDVEESDLSNRGTQLRLLRNREDHLLRTAATRMQRAQSDDEDPFEVFNSAQDHILKVGSAHTERVVLEAFIEAIDSCDSKSAQELLEKLCDLFVYSALEADLSWFLMHRHVSTERAKAIRRGVNQLCEELRPHLGTLVDAFGIPEALLATEMIPDN

SEQ ID NO: 616 - protein, 691 aa, Oreochromis niloticus
MNHNVADLPSGPLDVYRNKASFNWKDMVRFIDGEDIYLFKQHVFKTLENDPLFARQPGEDVPIEKKREVNFLRMKQLLRYNFVTKEEAMANPWKAVYLEDCLGMYDWALVAKLFLSLGMFGATVANSGSSRHKKYVENTEDMRIFGCFALTELSHGSNTRAMRTTAKYDPSTQEFVINSPDFEAAKFWVGNLGKTATHAVVYAQLYTPDQVCHGLHSFVVPVRDPKTLLALPGVLVGDMGKKLGQNGLDNGFAMFHNVRIPRENLLNKTGDVTPDGRYVTPFKDPKKRFGASLGALSGGRVYITRMALINLKLALTVAIRFSAARRQFGPKDTEEIPVLEYQLQQWRLIPYLAAAYALENFTKSIFMNFVEFQIGQMMKDKSDTAEMGREIHAISCSSKPLGSWTAQRGIQECREACGGHGYLAMNRLGDLRDDNDPNCTYEGDNNVLLQQTSSYLLSWLHAKQFDGVRIESPFHTVDFLEESQEILKSRFTALTVDDCVDSAVPLAAYKWLVCFLLEESQKRLEQERALGNDDFEARNNCQVYYCRSLAMAYIEHTCLQRFHELTTNQDTPAGLRPVLRKLCSLYGLWSLSSHMTTLYQGNYWSGRKPAELVQMAILTLCSQLKDDAVALVDVLAPTDFILNSPIGCADGQIYNHLWSTIMQGSKVLERPSWWKEFCSDKPVLGSLRPKL

SEQ ID NO: 617 - protein, 674 aa, Nasonia vitripennis
MKDLVRDTVRGPLDAYRKKASFDWKSLKVHLEGEECVKFQNKLWSFIETHPAFKHPVKNLSLDENRRRTVQQIHAIVENDILPIESQGWFNYMFLYDPSAPIKMGVMYGMVPSVLISLGTEHHHEYLEQMAQGKFAGCFALTEISHGTNVKGMRTQARYDPKTQSFILHTPDFEAAKCWVGGLGKTATHAIVYAQLITPDNVNHGLHPFVVKIREPETMLPAKGVTVGDLGEKIALNGVDNGFVMFDHYYIPRNSLLNKQADVTADGKYVAAVKDQSKRFGASLGALSAGRVTITSMCSMYSSLATTIAIRYCASRKQFGPNPNEEWSVIEYQVQQGRLLPHLATVFAMKIFSANFLLTMKDFQETMFSGESSDLVAAMGMEIHALSSATKPLCAWAGRDAIQDCRESCGGHGYLKVSRLGTIRQEHDANCTYEGESNVLIQQCSNWLLNQYAGLLKGRPILSPLETAKFLENIEYILGLKFNHHSIDETLRPENLLVCLRWITCYYMKKTYQLVQSMKQNGKSDFVARNDSQLFNARTLTLVYGEHALVQGFIRNNNKPEYTDNERAVLNKLCSLYAAWNIEKRLGDFYAGGFAAPNSKLDVLIREGIIQLCKELVREAVSLVDVLAPPDYILNSPLGMSDGNVYKHLEEALRRDPQCFERPEWWREILKSKM

SEQ ID NO: 618 - protein, 732 aa, Bombus terrestris
MRQQWQLCKGALTHNLKHVTKFSSMQEEHVQTLHSRLEYLLMTIRRNAVGIVDGFDFDDHILCSALGAYDGNVYERLFQEAMKSPLNRETVNMSFEKYLKPFLKKQYFLDDLVLKENVAMKYKKSHKEIYEDTLRICCQVLHKIRELQRSGKADIDLLLNIFGGLLGTALFEDGNPLLLHYAMFLPALMGQANSEQQAYWINRAWTGDVIGTYAQTELGHGTFLRGLETTATYDPETKEFVLNSPTLTSYKWWPGGLGHTANHAIVVAQLYTQGECRGIHTFVVQLRDVETHEPLKNIIIGEIGAKLGMNGVNNGFLGFHDFRIPRENMLMKNSKVLEDGTYVKSANDKLTYGTMVFVRVMLLQDVLHYLSKAVTIAVRYSVVRRQGQINAEQPEVQILDYVTQQYKIFPHIATCFAIKVTASWVWDMCNTVQSQLHQANYEKLPELHSLSCCLKAVVSADTAAGIEQLRLSCGGHGYMTASNLPVLYGFATSVCTYEGENTVLLLQTARYLVKSWKQAMDGKPLPESVEYLNEAAKGAKHFRWSNDLECLIDAYDAVAAGSIRLAAEHLDHRIRDGVPTEEAWNQTSIELTQCSEAHARGFIAKTFAKAIKQLNSKSEEFRQVMLQLCELYIVYWALRNVGNFLRFSSMQEEHVQTLHSRLEYLLMTIRRNAVGIVDGFDFDDHILCSALGAYDGNVYERLFQEAMKSPLNRESVNISFEKYLKPFLKSNL

SEQ ID NO: 619 - protein, 665 aa, Amphimedon queenslandica
MASEVVLELKVERERSRLDLEELTNLLDGGAVFTDKRREMVKMVVEDPVFKRDNKYFLSTEESFDSAMRKNVHYIELLKSGKLKENNAEAYFKSAIDDDFPAAVHELMFVPTIEGQGNEEQKEKWLKISRNFDIIGCYAQTELGHGTFIRGLETTATYDPSTEEFVMNSPTLTSMKWWPGSVGHTATHAIVVARLITKGKDEGIHLFIVQLRSLEDHKPLPGIKVGDIGPKFGYFGMDNGFLHMTNVRIPRDHMLMKYAHVSRDGTYSKPPAEADKISYVIMVYARALIVDHSAETLARAITIAIRYSVVRRQTQNRPGEPETQVLDYQTQQFKLFPLLASAYAMKFAGHYMMKLYTEVTKEISEGNLKSLPELHATSAGLKAFCSELCCNGIELCRLSCGGHGYSAASGLPQLYADYSPSPTYEGENTVMLLQTARFLYQFILLEAYHQRAIRLVAVALGRYSKSIATGLDSVTAWNNSSVDWTMAARAHCHYLVLKAFHSSIDAAKVCEANFNILRVLCCLFGLHGIIQYSGEFCLDGYMNSDQIEMAKNQLYSLLKEVRYEAVPLVDAFDIHDDILNSSLGRYDGDVYGHLYEWALRAPRNKKEDGYMNSEQIEMAKNQLYSLLKEVRYEAVPLVDAFDIHDDILDSSLGRYDGDVYRHLYE

SEQ ID NO: 620 - protein, 427 aa, Cryptococcus gattii; identical to SEQ ID NO: 135

SEQ ID NO: 621 - protein, 700 aa, Equus caballus
MASSSEGSGDALLPDFPRGPLQAYRARASFSWKELALFLEGEDMLRLKKTIFSALEDDPLFARPGGGDLPMEKYRELNFLRCRRVFEHDLLRVEDMLQSPLKVWALVNCLGMYDWSLAAKFFLNVLVFGSAIYNSGSERHFKYIPKIFSMEIFGCFALTELSHGTNTKAIRTTAHYDPTTEEFIIHSPDFEAAKFWVGNMGKTATHAVVFAQLHTPGGGCHGLHAFVVQIRDPKTLLPMPGVMVGDIGKKLGQNGLDNGFAMFHQVRIPRQDLLNRAGDVTPEGTYVTPFKDDRQRFRMSLASLSSSRVSIVGMSVVNLKLAVSIAIRFSATRRQFGPTDKEEIPVLEYQMQQWRLLPYLAAAYALDHFSKSLFLDMVELQQGRLGKDASAGQAELGREIHALASASKPLASWTAQRGIQECREACGGHGYLAMNRLGHLRDDNDPNCTYEGDNNVLLQQTSNYLLSLLARRAQGGAHCKSRLKTVDFLEAYPDILGQRFEVASCGHCLESPVPLAAYEWLVCYLLRESDQKLNQEKRSGSNDFEARNNCQVYYCRSLALAFLELTVVRRFHEHTHQPSVPPPLRAVLRRLSALYGLWSLSQHTALLYRGGYFSGEQAGKMIETAILDLCSQLKDDAVALVDVIAPPDFVLDSPIGRADGELYKNLWGTVLQEGKALERASWWPQFSANKPVIGSSKSKL

SEQ ID NO: 622 - protein, 706 aa, Monodelphis domestica
MAPASKGNGHNQSSQDDLLPDLPKGPLCMYRAKSSFNWKELLLFLEGEDMLIFKKRIFSAFENDPLFAHHPGEELPIQKYRELNFLRCKRLFEYDFLNMQEMVKNPLKISMLINCLGMYDWSLSAKYFLNTYVFASTIQNSGSQRHMHFIQKTLNMEIFGCFALTEVSHGSNTKAIRTTAQYDPTTQEFIINSPDFEASKFWIGNMGKNATHAVVYAQLYTQGGQCHGLHSFVVQIRDPKTLLPMPGVMVGDIGRKLGQNGLDNGFTMFHNVRIPRENLLNRTGDVTPEGVYSTSFKDVRQRFGASLGTLSTGRVSIIGMSVVNLKLALSIAIRFSATRHQFGPNDDEEIPVLEYQMQQWRLIPYLAATYVLDHFSKTLFMDLVELQLGLLQNDKSIRQAELGREIHILASAGKPLASWTAQQGAQECREACGGHGYLAMNRLGDIRNDNDPNCTYEGDNNVLLQQTSNYLLNCITDRHQDKVRIESPLESVNFLEDFKDILGQKFVISRVEDCMDSSVSLAAYKWLVCYLLRESYQKLNQERKSGSDDFEARNNCQAYYCHSLALVFIEHTVLQRYHKYTHHASMPTSLQPVLKRLGALYGLWSLSRHMAVLYQGGYFSGEQAGKMIKNAILDLCAKLKDDAVALVDVIAPPDFILNSPIGKANGELYKNLWATVLQGSKVLERPSWWREFSTYKPTIGSLKSKL

SEQ ID NO: 623 - protein, 706 aa, Xenopus tropicalis
MNTAKGTTSQRPNIPNELLPDLPHGPLSEYRRRASFNWKEMVFFLDDEELIQFKKEIFSALENDPLFHRHPGQDLCMEKYRELTFRRCKRIFEYNFLTLQQTLEKPQKVLALINCLGMYDWSLGAKYFLNTQVFSGAVGNAGSERHSQFLNQVQTMEIFGCFALTELSHGSNTKAVRTTATFDASTKGFILNSPDFEAAKFWVGNMGKTATHAVVYAQLYTSDGKCHGLHSFVVQIRDPQTLLPMPGVMVGDIGKKLGQNGLDNGFAMFHNVRIPQENLLNRTGEITSSGTYTSAYKDPKQRLGASLGTLSSGRVSIMSMAVVNLKLAISIAIRFSATRRQFGPTEDEEIPVLEYQLQQWRLIPYLAAAYALDYFSKTFFMNLVELQIGIFMKDKSQRQAELGKEIHALSCAGKPLASWTAQHGAQECREACGGHGYLAMNRLGDIRSDNDPNCTYEGDNNVLLQQTSNYLLSLVHLVHEDKAHIESPLGSINFLIDFKDILGHKFTASSVEECLDPKVSLAAYKWLVCYLLRESYLKLQQEKKNRNNDFNARNNCQVYYCRSLALAFIEHAVLERFHDYTHDFSTPSSLQPVLKKLCALYGLWSLSKHLTVLYQGGYCLGQLPARIVQDAILELCAQLKDEAVALVDVIAPPDFILNSPIAKADGELYKNLWSAVLQGEKVLERASWWEEFCSNKPVIGPLKSQL

SEQ ID NO: 624 - protein, 688 aa, Brevibacterium linens
MKLSLDPQAINNALDGRWAEARRQGRTLALEEITHEDPADDLETTRAKTLAGVELMADTGLPMVALPPALGGRNEHATNIASFEETVTASPSLQVKAGVQFGLFGGAILHLGNAEQHDAWLVAAQTGKLLGSFAMTEIGHGSDVAAVGTTATYEVEKDEFVIDTPFRAATKEYIGNAARDARAAVVFAQLITNGVNHGVHAFFVPIRDEDGTILPGISIEDDGYKGGLKGVDNGRIVFEQVRIPRFNLLDRYGAVDADGKYTSPIDSPGRRFFTMLGTLVQGRVSLDGAAIVASKLALDIAVRYGLERKQFTTVDDINETTLLDYQQHQRRLMPAIASVYASAFAHEKLLNSFEEVFSGADESEENRALLETRAAAFKADTTWMALDVIQECREACGGAGYMAENRLVGLRADLDIYATFEGDNTVLLQLAAKRLLGDYAKEFANIDVGGAARYIGTQAAEHTLYRTGLANAGLAISDVFTPNLGEKRIRSGRLQRSLLETRLEVMVSGLAQALRPAMKMSAADAADLFNSNQHEFIEMARAYVELEKWKALDEAMREQQDPVQNKLFRRLRDTYGLSLIEKHVGWHLMYGRLPMLRARQLNETLNRLCAKLSANALDLVDAFGYGDDHRRATISTGVEAERQDEAADYYRHSRAQEDYAVPEKQLRKAEKAAKKAAEKDARKAKAGK

SEQ ID NO: 625 - protein, 736 aa, Nomascus leucogenys
MASTVEGGDTALLPEFPRGPLDTYRARASFSWKELALFTEGEDTLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLHVPGDQCHGLHPFIVQIRDPKTLLPMPGVMVGDIGKKLGQNGLDNGVPERRLAGTVPVWRVWRVAVQALRPQGSGKPPAIWRTWAGAWQSSRELFPRQVAAQPGLRLASASLPQDVRQRFGASLGSLSSGRVSIVSLAVLNLKLAVAIALRFSATRRQFGPTEEEEIPVLEYPMQQWRLLPYLAAIYALDHFSKSLFLDLVELQRGLASGDRSARQAELGHEIHALASAGKPLASWTTQQGIQECREACGGHGYLAMNRLGVLRDDNDPNCTYEGDNNILLQQTSNYLLGLLAHRVQDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPCVPPLLRAVLGRLSALYALWSLSRHAALLYRGGYFSGEQAGEVLESAVLALCSQLKDDAVALVDVIAPPDFVLDSPIGRADGELYKNLWGAVLQESKVLERASWWPEFSVNKPVIGGLKSKL

SEQ ID NO: 626 - protein, 701 aa, Anolis carolinensis
MKSISNLEKANSLLPDLPKGPLCAYRKKASFNWKEMALFIEGEDLISFKNEIFSTLENDPLFARLAGEELSLEKYRELTFLRCRRLFEYDFLRLEEFVEKPLKLVALITSLGMYDWSLGAKYLLNTQVFKGAVESGGFDRHADVINQNGTMENFGCFALTELSHGSNTKNMRTTARYDSSTQEFIIHSPDFEAAKFWVGNMGKNATHAVVFAQLYTPDGQCHGLHSFIVQIRDPKTLLAMPGVLVGDIGRKLGQNGLDNGFAMFHQVRIPKENLLNKTGDITAAGTYTSTFKDRKQRLGASLGSLSNGRVMIISMSLVNLKLAVSIAIRFSATRRQFGLTDDEEIPVLEYQMQQWRLLPYLAAAYVLDHFSKTLFINSMEFTIGLLMGDKSPQQAELGREIHALSTSGKPLASWLAQQGTQECREACGGHGYLAVNRLGDIRNDNDPNCTYEGDNNVILQQTSNYLLGWMNGRQQDKGPIASPLGSVNFLEDYDRILCQKFIVSDVQDCMDPSVPLRAFKWLVCYLLRESIQKLRNLEKAGYSEFEARNQSQVFHCRSLAIAFIEHVVLQRYYDYVHSSKTPASLQPVLKQICSLYGLWSLNKHMAVLYQGGYVSGENAGRFVQDAILELCSKLKQEAVALVDVIAPPDFILNSPIGKVDGELYKNLWSSVLQGKKVLERPSWWLEFCNNKPVVGQLRSRM

SEQ ID NO: 627 - protein, 429 aa, Cryptococcus neoformans; identical to SEQ ID NO: 140

SEQ ID NO: 628 - protein, 402 aa, Corynebacterium ammoniagenes
MPPIIKSDDATQSLLEGIPFPHTDILGVADQLEPEESKRLHALHEFLQTKIRPEVGEYWDREEFPFHLLPELAKYGLGEIAVSGTSRLYRGLAYAEVTRADVSLSALVGIHNELIVALIDALASDAQREKWLDGLRSFEKIGCFALTEPEHGSDIAGGLATTAEKTADGWVINGTKRWIGGGTFADFAICFARDTADNEVKGFIVEMGREGVSAEKISRKMGLRIMQNADITFDSVLIPHENIIPGAQSFANTNDYLCSSRAWVAWQGAGLQLGIFDMAREYAVSREQFGRPIAKFQLVQEALTRILGNATVSLSMMAQVAHLQEAGKLEMPHAALAKATTTRLARESAAAGRNIGGGNGILTDYDLSKMMSDAEIIYTYEGTYEINSLIVGRAITGVSAFV

SEQ ID NO: 629 - protein, 653 aa, Streptomyces sp.
MAPENASAPATGYVQPDVDVPSLTSVLDGEYAGIRDLVRTNLATYASVLEEADELGIDAFRDRVRDVVVKMAATGQTGMGFPAEYGGGGDVGASIAAFETLAFGDLSVLVKVGVQFGLFGGAILHLGTGRHHAAYLPDLITGELMGCFAMTETGHGSNVQALGTVARYDTASREFVITTPGDHARKDYIGNAARHAELAVVFAQLEVDGRSQGVHAFVVPIRVGGETAPGVRIEDDGRKMGLNGVDNGRIWFDGVRVPREALLNRFADVSPEGVYESAIDNPNRRFFTMLGTLVQGRVSVAGAGISVAKVALSIATKYAVRRRQFEAAPDTEEQLLLDYGLHQRRLLPLIARTYALHFAQDEVRAQLHEVFSGIEDDAQARRRLESRAAGIKALGTWHATGVVQECREACGGAGYLAVNRFAALKGDSDVFTTFEGDNHVLLQLVGKGLLTDHASEFEDLDQLGMVRYVTGLAVETVIERTSAHKLLERVRDLLPGGDEWDREAGLLDSEYQLAMVRFREEHMLAGLARRIKRGIDQKRDPGAVFSQVQDHVIAVARAHVERLVTEAFVDKVRGLPEGGEKTALALLCDLFALSTIEADRAWFMEHGRLTVQRSKAISREVNDLCRKVRPLAVDLVDAWGIPAAMLRAPDLVG

SEQ ID NO: 630 - protein, 648 aa, Coccidioides posadasii
MADKPDWSAALRPAPPDGATIIAQERARSSIPVDQLAGYLLTPDFLERQDRVLKVLLKEPVFKKTNQANLSRPDRYKLGLARGKKIRQLKEKLGWDEEDYHMAAYLCDDVLPYHLHTAMFITTVSQQGSDAQRARWVPRIERWEIIGAYAQTELGHGSNVRGIELEARWDPETREFILHSPHLTASKWWNGTMGRTATHAIAVAQLMLPVSGKGAETKYKSYGPHPFIVQIRDSRTHQPPESIIIGDIGPKYGYASMDNGYMLFNNHRLALARAVTVAVRYLSIRRQFRDKDSDNPSDPEMPVLDYSTVQVRIFPLLATAFALHYSGKAMGELYARTRKNIEEDGDFETLAELHSTSSGLKSLATDLTAGGIEICRRAMGGHGFGASGLVQLNANYLSKPTVEGDNWMITQQVARYLIKKAKALSASAKSRAGARTEESLKRYLYARQKTLNLKVYEDDNAILEAFEWRTAHLVFKAYEQREIQKKSWNSLLIDFHKLSRAYSQSILILNFHQALQPNNPETARLDSTTRAVLRDLFLLFAFTTMDAEAREFCSSGAVSNDALDALSARILELMGRIRPHAVRLVDAWKIPDFLLDSALGRYDGKVYEDLFDRAHRQNPLNAETFNPDYRSDEIVLGSGDAGQILSKL

SEQ ID NO: 631 - protein, 700 aa, Ailuropoda melanoleuca
MAPPSEGGTNALLPDLPKGPLQAYRARASFCWQELALFLEGEDVLRLKKAIFSALENDPLFAHPHGEGLSLEKYRELNFLRCKRVMEYNLLPVESIVANPLLVQTLVTCLGMYDWSLAIKLLLHMLTFASVIYSSGSERHLKYLPKIFNMEIFGCFAVTELSHGSNAKAIRTTAHYDPTTEEFIIHSPDFEAAKFWIGNMGKTATHAVVFAQLYTPGGRCHGLHAFMVQIRNPKTLLPMPGVMVGDMGKKLGLNGVDNGFAMFHKVRIPRQDLLNRTGDVTPEGTYVTPFKDDRQRFGATLGTLSIGRVTIMGMSTANLKLAISIALRFSATRCQFGPSDAEEVPVLEYQMQQWRLLPYLAAVYALDHFSKSLFLDLVELQQGLMGTDQSTRQAELGREIHALASAGKPLASWTTQRGIQECREACGGHGYLAVNRLGHLRNDNDPNCTYEGDNNVLLQQTSTYLLSLLARRVHGGARFESPLRTVDFLEAYPDILGQRFTCPSVDSCLDSSVPLAAYEWLVCYLLRESYQKFNQEKRSGSNDFEARNNSQVYCCRPLALAFLELTVVRKFHEYTHQHSVPPPLRAVLGRLSALYALWSLSQHTALLYQGGYFAGEQAGKMIQSAILDLCSQLKDDAVALVDVIAPPDFVLDSPIGRADGELYKNLWTAVLLESKVLERPSWWSEFSVNKPRVGSLKSKL

SEQ ID NO: 632 - protein, 748 aa, Saccharomyces cerevisiae
MTRRTTINPDSVVLNPQKFIQKERADSKIKVDQVNTFLESSPERRTLTHALIDQIVNDPILKTDTDYYDAKKMQEREITAKKIARLASYMEHDIKTVRKHFRDTDLMKELQANDPDKASPLTNKDLFIFDKRLSLVANIDPQLGTRVGVHLGLFGNCIKGNGTDEQIRYWLQERGATLMKGIYGCFAMTELGHGSNVAQLQTRAVYDKQNDTFVIDTPDLTATKWWIGGAAHSATHAAVYARLIVEGKDYGVKTFVVPLRDPSTFQLLAGVSIGDIGAKMGRDGIDNGWIQFRNVVIPREFMLSRFTKVVRSPDGSVTVKTEPQLDQISGYSALLSGRVNMVMDSFRFGSKFATIAVRYAVGRQQFAPRKGLSETQLIDYPLHQYRVLPQLCVPYLVSPVAFKLMDNYYSTLDELYNASSSAYKAALVTVSKKLKNLFIDSATLKATNTWLIATLIDELRQTCGGHGYSQYNGFGKGYDDWVVQCTWEGDNNVLSLTSAKSILKKFIDSATKGRFDNTLDVDSFSYLKPQYIGSVVSGEIKSGLKELGDYTEIWSITLIKLLAHIGTLVEKSRSIDSVSKLLVLVSKFHALRCMLKTYYDKLNSRDSHISDEITKESMWNVYKLFSLYFIDKHSGEFQQFKIFTPDQISKVVQPQLLALLPIVRKDCIGLTDSFELPDAMLNSPIGYFDGDIYHNYFNEVCRNNPVEADGAGKPSYHALLSSMLGRGFEFDQKLGGAANAEILSKINK

SEQ ID NO: 633 - protein, 682 aa, Bos taurus
MEGNPVHRVSAGDAWSSSMHPDIESERHSQSFNVEELTNILDGGAQNTALRRKVESIIHSEPELSLKDNYFMTQNERYEAAIKKKFHILMLAQRLGWSEGSSELQYASRSVSGDLGFAIHHIFQKTIRSLGSEEQIAKWDPLCSKFQILGTYAQTELGHGTYLQGLETEATYDAATQEFVVHSPTMTAIKWWPGDLGRSATHALVQAQLICSGARQGMHAFIVPIRSLDDHSPLPGITIGDIGPKMDFEHTDNGFLKLDHVRIPRENMLNRFAQVLPDGTYVKLGVPKSNYLSMVVVRVDILLGEVLPLLQKACTIAVRYAVIRRQSRLRPSDPEAKVLDYQTQQQKLFPPLAMAYAFHFVANNLLEFFHHSYSFILDGDFALLPELHALSAGLKAMLSDFCTQGVEQCRRACGGHGYSKLSGLPSLLTRVTASCTYEGENTVLYLQTARFLIKSYLNTQKSPGSASKGSLPQSVAYLTAPDLARCPAQTAADFLQPELYTTAWAHVAVRLIKDSVHHLQTLRQAGADEHDAWNQTTVIHVQATKAHLYYVTVKIFTEALEKLESQPAIHQVLKRLSDLYALHGILTNAGDFLHDGFLSGAQIDMARKAYLDLLPFIRKDAILLTDAFDFTDQCLNSALGCYDGHAYERLFQWAQKSPTNTEGNPAYEKYIRPLLQGRRARL

SEQ ID NO: 634 - protein, 402 aa, Corynebacterium ammoniagenes; identical to SEQ ID NO: 628

SEQ ID NO: 635 - protein, 662 aa, Candida dubliniensis; identical to SEQ ID NO: 384

SEQ ID NO: 636 - protein, 774 aa, Candida dubliniensis; identical to SEQ ID NO: 385

SEQ ID NO: 637 - protein, 648 aa, Coccidioides posadasii; identical to SEQ ID NO: 630

SEQ ID NO: 638 - protein, 696 aa, Toxoplasma gondii; identical to SEQ ID NO: 608

SEQ ID NO: 639 - protein, 653 aa, Streptomyces sp.; identical to SEQ ID NO: 629

SEQ ID NO: 640 - protein, 724 aa, Candida albicans
MAMLTKSIHDEDHVEKKDPDTNPKTVQNVVSSRSPPNPAKDITEERNRTNWDLKEMHEFLEGGEAKSEQVLRLYQSIERDPILQTRPEQFDITQKEERELVATRINQMTKYMEIESAAKFRRRLQLMTIIDPSMGIRMLVNIGLFINCIKGNGTQKQYDFWAKSKEGAIIKQIHGSFGMTELGHGSNVAGCETTATFDEKTDTFIIDTPHIGATKWWIGGAAHSATHTVCYARLIVKDVDYGVKTFVVPLRDSNHNLLPGVAIGDIGAKMGRHGVDNGWIQFTEVRIPRFFMLQRWCKVDRQGNVTLPPLEQLSYISLLEGRVGMATDSYRIGARYITIALRFAVGRRQFASAKGKEETKLIDYTLHQRRLLPFLAMTYAAALGTDRLERQHEELLANLDKALATKDKLLLKNTINGTKSMFVDSGSLKSTLTWFAADLINETRQACGGHGYSSYNGFGKSYDDWVVQCTYEGDNNVLAMSAGKTIIKTVQQVLNGKPLQDSTLEFLNDAPTLSKAKKAVIRIKEHVDDVDRVLKAVAGLISKFSSDLIAVSHQSWDSIGPQRVILSKLRCHYYLLETFNERLNDNIKAKSPARPHLENIVKLYYVTNILGPFIDEFLRFGVISPKVAKYITGEYPQRLCAITRPYVIGLTDSFQQPDNIINSLIGQYDGNIYTNYLDSVKEVNNPLNDKAPYSEDLEAMLNRQSISQRERFERSKEAAAKLSR

SEQ ID NO: 641 - protein, 709 aa, Candida albicans
MSFTKKNVSLAEGPDPRSSIQTERANSKFNPEQMNYFLEGSKERSELFKGLAQQMERDPVLFTDGSYYDLTKDQQRELTALKINRLARYRETDSIDTFNKRLSLVGVFDPQVGTRIGVNLGLFLSCIRGNGTAEQLKYWAFDKETSNIKGIYGCFGMTELAHGSNVAGLETTATFDKETDEFVINTPHIGATKWWIGGAAHSATHCSVYARLIVDGEDYGVKTFVVPLRDSNHDLMPGVTVGDIGAKMGRDGIDNGWIQFSNVRIPRFFMLQKFCKVSADGDVVLPPLEQLSYSALLGGRVMMVLDSYRMLARMSTIALRYAIGRRQFKGDNVDQNDPNALETQLIDYPLHQKRLFPYLAAAYVISASALKIEHTIETTLEELDQAVAKEDQRAIFKSIDDMKSLFVDSGSLKSTATWLAAEAIDQCRQACGGHGYSSYNGFGKAYNDWVVQCTWEGDNNVLGMSVGKPIVREIINLEDKDKKVRGSTAFLNQLKEYTGSNSSKVVLDNVADLDDINKVIKAIEVAIIRLGQEAASTVRKESLDFVGAELVQLSKLKAHHYSLSEYVRRVNEFDQKELVPYLLTIAKLYGATVVLDKFAGIFLTFNVASTKAITDLASIQIPKLCAEVRPNVVAYTDSFQQSDMIVNAAIGKYDGDIYENYFDLVKAQNPPSKTKAPYSAALEAMLNRPSLEARERFEKTDETAEILSK

SEQ ID NO: 642 - protein, 724 aa, Candida albicans; identical to SEQ ID NO: 640

SEQ ID NO: 643 - protein, 709 aa, Candida albicans; identical to SEQ ID NO: 641

SEQ ID NO: 644 - protein, 748 aa, Saccharomyces cerevisiae
MTRRTTINPDSVVLNPQKFIQKERADSKIKVDQVNTFLESSPERRTLTHALIDQIVNDPILKTDTDYYDATKLQEREITAKKIARLASYMEHDIKTVRKHFRNTDLMKELQANDPDKASPLTNKDLFIFDKRLSLVANIDPQLGTRVGVHLGLFGNCIKGNGTDEQIRYWLQERGATLMKGIYGCFAMTELGHGSNVAQLQTRAVYDKQNDTFIIDTPDLTATKWWIGGAAHSATHAAVYARLIVEGKDYGVKTFVVPLRDPSTFQLLAGVSIGDIGAKMGRDGIDNGWIQFRNVVIPREFMLSRFTKVVRSPDGSVTVKTEPQLDQISGYSALLSGRVNMVMDSFRFGSKFATIAVRYGVGRQQFAPRKGLSETQLIDYPLHQYRVLPQLCVPYLVSPVAFKLMDNYYSTLDELYNASSSADKAALVTVSKKLKNLFIDSASLKATNTWLIATLIDELRQTCGGHGYSQYNGFGKGYDDWVVQCTWEGDNNVLSLTSAKSILKKFIDSATKGRFDNTLDVDSFSYLKPQYIGSVVSGETKSSLKELGDYTEIWSITLIKLLAHIGTLVEKSRSIDSVSKLLVLVSKFHALRCMLKTYYDKLNSRDSHISDEITKESMWNVYKLFSLYFIDKHSGEFQQFKIFTPDQISKVVQPQLLALLPIVRKDCIGLTDSFELPDAMLNSPIGYFDGDIYHNYFNEVCRNNPVEADGAGKPSYHALLSSMLGRGFEFDQKLGGAANAEILSKINK

SEQ ID NO: 645 - protein, 681 aa, Oryctolagus cuniculus; identical to SEQ ID NO: 344

SEQ ID NO: 646 - protein, 724 aa, Candida albicans; identical to SEQ ID NO: 640

SEQ ID NO: 647 - protein, 709 aa, Candida albicans; identical to SEQ ID NO: 641

SEQ ID NO: 648 - protein, 724 aa, Candida albicans; identical to SEQ ID NO: 640

SEQ ID NO: 649 - protein, 709 aa, Candida albicans; identical to SEQ ID NO: 641

SEQ ID NO: 650 - protein, 660 aa, Macaca mulatta
MNPDLRRERDSASFNPELLTHILDGSPENTRRRREIENMILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNYRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIEAVLRNLCLLYSLYGISQNAGDFLQGNIMTESQIMQVNPRVKELLTLIRSDAVALVDAFDFQDVTLGSVLGRYDGNVYENLFEWAKNSPLNKTEVHESYKHLKSLQSKL

SEQ ID NO: 651 - protein, 662 aa, Anolis carolinensis
MNPDLRKERSAVSFNTELLTNVLDGGVERTRRRKEIEALVINDPDFAHEDVNFLSRSQRYEEAIKKSALMVMKLREYGIADPDEIYWFKRYLHAVQAVLPVDLHYSMFTNTLQNLCSETQREKWLSLASRFQIIGTYAQTELGHGTHLRGLETTATYDPATQEFILNSPTVTSIKWWPGGLGKTSNHAIVLAQLYTQGKCHGLHAFIVPIRQLGTHEPLPGITVGDIGPKFGYDEMDNGYLKMDNFRIPRENMLMKHAKVEPDGTYVKPLNAKLTYGTMVFIRSIIVGDAARSLARACTIAIRYSAVRHQSELKPGEPEPQILDYQTQQYKLFPLLATAYAFHFVGAYMKDTYRRITGNISEGDLSELPELHALSAGLKAFSSWVANAGIEDCRMACGGHGYSRCSGLPDIYVNFTPSCTYEGENTVMMLQTARFLIKSYTQASSGQLLSGMVSYLNDLPGQHILPHQVAGRPTALHINNPSSLVEAYKLRASRLVEFAAKNLQAELNRRRSKEDAWNRTSIDLVRASEAHCHYVVVKLFTAKLSEIGDPAVRAVMNNLCLLYALHGISKNTGDFLQGGILTDAQITQVNQRVKELLALIRPNAIALVDSFDFHDSVLGSVLGRYDGNVYENMFEWSKKSPLNKTQVHPSFHKHLKPMQAKL

SEQ ID NO: 652 - protein, 663 aa, Anolis carolinensis
MNPDLRKERSAVSFNTELLTNVLDGGVERTRRRKEIEALVINDPDFAHEDVNFLSRSQRYEEAIKKSALMVMKLREYGIADPDEIYWFKSVCTGMPKPVLPVDLHYSMFTNTLQNLCSETQREKWLSLASRFQIIGTYAQTELGHGTHLRGLETTATYDPATQEFILNSPTVTSIKWWPGGLGKTSNHAIVLAQLYTQGKCHGLHAFIVPIRQLGTHEPLPGITVGDIGPKFGYDEMDNGYLKMDNFRIPRENMLMKHAKVEPDGTYVKPLNAKLTYGTMVFIRSIIVGDAARSLARACTIAIRYSAVRHQSELKPGEPEPQILDYQTQQYKLFPLLATAYAFHFVGAYMKDTYRRITGNISEGDLSELPELHALSAGLKAFSSWVANAGIEDCRMACGGHGYSRCSGLPDIYVNFTPSCTYEGENTVMMLQTARFLIKSYTQASSGQLLSGMVSYLNDLPGQHILPHQVAGRPTALHINNPSSLVEAYKLRASRLVEFAAKNLQAELNRRRSKEDAWNRTSIDLVRASEAHCHYVVVKLFTAKLSEIGDPAVRAVMNNLCLLYALHGISKNTGDFLQGGILTDAQITQVNQRVKELLALIRPNAIALVDSFDFHDSVLGSVLGRYDGNVYENMFEWSKKSPLNKTQVHPSFHKHLKPMQAKL

SEQ ID NO: 653 - protein, 661 aa, Anolis carolinensis
MNPDLRKERSAVSFNTELLTNVLDGGVERTRRRKEIEALVINDPDFAHEDVNFLSRSQRYEEAIKKSALMVMKLREYGIADPDEIYWFKSAAHHGRPEPLDLHLGMFLPTLLTQATQEQQDRFFMPAWNLEIIGTYAQTEMGHGTHLRGLETTATYDPATQEFILNSPTVTSIKWWPGGLGKTSNHAIVLAQLYTQGKCHGLHAFIVPIRQLGTHEPLPGITVGDIGPKFGYDEMDNGYLKMDNFRIPRENMLMKHAKVEPDGTYVKPLNAKLTYGTMVFIRSIIVGDAARSLARACTIAIRYSAVRHQSELKPGEPEPQILDYQTQQYKLFPLLATAYAFHFVGAYMKDTYRRITGNISEGDLSELPELHALSAGLKAFSSWVANAGIEDCRMACGGHGYSRCSGLPDIYVNFTPSCTYEGENTVMMLQTARFLIKSYTQASSGQLLSGMVSYLNDLPGQHILPHQVAGRPTALHINNPSSLVEAYKLRASRLVEFAAKNLQAELNRRRSKEDAWNRTSIDLVRASEAHCHYVVVKLFTAKLSEIGDPAVRAVMNNLCLLYALHGISKNTGDFLQGGILTDAQITQVNQRVKELLALIRPNAIALVDSFDFHDSVLGSVLGRYDGNVYENMFEWSKKSPLNKTQVHPSFHKHLKPMQAKL

SEQ ID NO: 654 - protein, 663 aa, Taeniopygia guttata
MSVNADLRRERAAATFQPELLTHILDGGPERTRRRKEIEALVLNDPDFQHEDLNFLSRSQRYEQAIRKSSLMVMKLREYGIADPEEIYWFKRTCLGNFPEPLGLHFSMFHKTIETQTSAAQKEKWLPLVRGVEIIGTYAQTEMGHGTHLRGLETTATYDPSTQEFILNSPTVTSIKWWPGGLGKTSNHAIVLAQLYTQGQCKGLHAFIVPIRQLGTHEPLPGITVGDIGPKFGYDEMDNGYLKMDNFRIPRENMLMKYAQVEPDGTYVKPVSDKLTYGTMVFIRSLIVGDSARSLSRACTIAIRYSAVRHQSELKPGEPEPQILDYQTQQYKLFPLLATAYAFHFVGDYIKYTYQRINGDISKGDLSELPELHALTAGLKAFTSWTASAGIEECRMACGGHGYSRCSGIPDIYVTFTPTCTYEGENTVMMLQTARFLMKSYTQVTSGQQVSGMVSYLNDLSRQRIQPQHVAARTVTLRINDPTSLVEAYKSRAAWLVESAAKNLQAELNHRKSKENAWNKTSVDLVRASEAHCHYVVVKLFTAKLAEVGDAAVRAVLTNLCLLYALFGISRNAGDFLQAGILSSAQITQVNQHVKELLAVIRPNAVALVDSFDFHDTHLGSVLGRYDGNVYENMFEWAKKSPLNKTQVHESFHKHLKPMQAKL

SEQ ID NO: 655 - protein, 763 aa, Taeniopygia guttata
MPAVNSVPRTRTEALRALPLPCPGCPALGRCQQQIAQKCRAARKLNKIKHWLCHLLAIRLTMNQKEMTGNQNSWDNLLADFPKGPLSRYRKKASFNWKEMAVFIDGEDIIQLKNRVFSALENDPLFAHHPGEDLCREKYQELTFLRCKRLFEYEFLTPQEIMEQPFRVFNMMSFLGMYDCSLCLQFFLHCTIFAGPIMSAYEKFAHILEQTYRMEIFGCFALTELSHGTNTKGLRTTATFDPSTQEFVINTPDFEAAKFWIGNMGKHATHAVVYAQLYTPDGQCQGLHPFIVQIRDTKTLLPMPGVMVGDIGEKLGLNGYDNGFAMFHNVRIPKENILSITGDVTAEGKYSSSIKEVKERFSAALGSLSTGRITITGLSTAILKLALTIAIRFSAARCQFGPTEDEEIPVLEYQTQQWRLLPYLAAAYALDYLSKSLFGNFVEFYAGLLTKQRSQRQADLGREIHALSAASKPLASWTAQQAAQECREACGGHGYLAMNRLGEIRNDNDPNCTYEGDNNVLLQQTSNYLMSWMNCIRDKAPFESPLGTINFLQDYHHILGWKFTATSIEDCMDSSVPLAAYKWLVCYLLRESYLKMNKEKQAGRSDFEAKNNSQVYYCRSLALAFIEQTALQRYHDYTHDPSVPAALQPVLRYLSALYGLWSLSKHLAVLYQGGYASGEQPGKFIQDAILELCYRLKDDAVALVDVFAPSDFILNSPIGKASGEIYKNIWGEILQGNKALNRPSWWAEFCSNKPVIGRLRSRL

SEQ ID NO: 656 - protein, 674 aa, Megachile rotundata
MRDKIVDWPSGPLDSYRKCATFDWKLLKLTLEGEDFVEFQNNIWDFIKKSSVFKRQACHTLDDERRLCNARIRVIRDNEIMNPIIHREWFNILFYYDADIPIKMGVMDGMVPSALFALGTKHHYEMAIKIQQGLYSCSFALTEISHGTNAKGMRTTATYDMKSKGFIFHTPDFEAAKCWIGGLGKTATHSIVFAQLITPDKHNHGLHAFIVPIRDPKTHMPFPGIKIGDMGKKIAVNGVDNGLMMFDNYYVSRTCLLNRTADVTEDGKYIISVKDESKRFGASLGALSSGRVTITSICATLASIAIVIAVRYCAVRRQFGPSEFEEWPVIEYQAQQWRLFPNLAATYAIKIFSAAFISKMSEFHFKLMSGQYQDTIDIEGMEIHALSSATKPLCSWTSRDIIQDCRESCGGHGYLKTSRLGDLRAENDATCTFEGENNVLIQQASNWLLNQWSNVLNGKRINSPLGTANFVQDANHILAQKLSDSTVDDILNPENLLFSLKWLTCYYLKKTYECTQDLKSKGCDDFEIRNNTQVFFAQTLSLLYGQHAVMKYFVESVQDSAWQSKERNVLMKLCSLYGAVILEKRLADIYAGGYALPTSEIDKVVRKGIIVLCKELVKDAVSLVDVLAPPDFILNSPLGMADGQVYKHIEEEIFKDKENFERPPWWKEIIRSKL

SEQ ID NO: 657 - protein, 660 aa, Macaca mulatta; identical to SEQ ID NO: 650

SEQ ID NO: 658 - protein, 661 aa, Sus scrofa
MNQDLQKERAAASFNPELLTHVLDGSPENTRRRREIENMILSDPDLQHEDLNFLSRSQRYEVAVKKSATTVKKIREFGLADPDEILWFKKLHLVNFVEPVGLNYSMFIPTLLSQGTTAQREKWLPPSKRLEIIGTYAQTELGHGTHLRGLETTATYDPATEEFILNSPTVTSIKWWPGGLGKTSNHAIVLAQLITQGKCYGLHAFIVPIREQGTHKPLPGITVGDIGPKFGYDEMDNGYLKMDNYRIPRENMLMKYAQVKPDGTYVKPLSNKLTYGTMVFIRSFLVGEAARCLSKACTIAIRYSAVRHQSELRPDEPEPQILDYQTQQYKLFPFLATAYAFQFVGAYIKETYHRINENIRQGDLSGLPELRALTAGLKAFTSWTANAAIEACRMACGGHGYSHCSGLPNIYVNFTPTCTFEGENTVMMLQTARFLMKSYNQVHSGKLVCGMVSYLNDLPSQRIQPQQVAAWPTVADINSPDSLIEAYRLRASSLVEIAAKNLQTEMSHRKSKEAAWNLTSIDLVRASEAHCHYVVVKLFAEKLHQIQERSIHAVLRNLCLLYALYGISQNSGDFLQGSIMTESQVTHVNERVKELLMAIRPEAVALVDAFDFQDVTLGSVLGRYDGNVYENMFEWAKKSPLNKTEVHESYHKHLKSLQSKL

SEQ ID NO: 659 - protein, 661 aa, Sus scrofa
MNQDLQKERAAASFNPELLTHVLDGSPENTRRRREIENMILSDPDLQHEDLNFLSRSQRYEVAVKKSATTVKKIREFGLADPDEILWFKNFVQRGHPGPLDLHVGMFLPTLLHQATEEQQERFFMPAWNFKIIGTYAQTEMGHGTHLRGLETTATYDPATEEFILNSPTVTSIKWWPGGLGKTSNHAIVLAQLITQGKCYGLHAFIVPIREQGTHKPLPGITVGDIGPKFGYDEMDNGYLKMDNYRIPRENMLMKYAQVKPDGTYVKPLSNKLTYGTMVFIRSFLVGEAARCLSKACTIAIRYSAVRHQSELRPDEPEPQILDYQTQQYKLFPFLATAYAFQFVGAYIKETYHRINENIRQGDLSGLPELRALTAGLKAFTSWTANAAIEACRMACGGHGYSHCSGLPNIYVNFTPTCTFEGENTVMMLQTARFLMKSYNQVHSGKLVCGMVSYLNDLPSQRIQPQQVAAWPTVADINSPDSLIEAYRLRASSLVEIAAKNLQTEMSHRKSKEAAWNLTSIDLVRASEAHCHYVVVKLFAEKLHQIQERSIHAVLRNLCLLYALYGISQNSGDFLQGSIMTESQVTHVNERVKELLMAIRPEAVALVDAFDFQDVTLGSVLGRYDGNVYENMFEWAKKSPLNKTEVHESYHKHLKSLQSKL

SEQ ID NO: 660 - protein, 676 aa, Apis florea
MKDTIADLPKGPLDSYRKCATFDWKLLKYNLEGEDFVKFQKTLWDFIKTSPVFQNHVCDTLDEQRKLCNARVRALKDNDIANPLTHKHWFTVMYQYEASVPIKMGVMDGMVPITILALGTEDHYDTVTKIQNGQYTCCFALTEISHGTNAKGIRTTATYDVKSKSFVLNTPDFEAAKCWVGGLGKTATHAIVFAQLITPDKQNHGLHTFIVPIRDPNTHIPYPNINVGDMGEKIALNGVDNGFMMFHNYYISRTCLLNKTANVTEDGKYTTSVKDKSKRFGASLGALSSGRITITTLCSNFTSVAITIAIRYCAVRKQFGPSEFEEWPVIEYQAQQWRLFPHLAATYAIKIFSVAFVNQMFEFNLKLITINAKNQDNIDSEGMEIHALSSATKPVCSWTSRDIIQDCRESCGGHGYLKISRLGDLRAENDVTCTFEGENNVLIQQASNWLLNQWSNVLSGKSINSPLKTADFMKDANNILIQKFSYTTVDDILKPENLFLSFTWLLCYYLKKTYEQTQNLKRKGCDDFDIRNNTQVFFAQTLSILYGQHVIMKYFIECIQNPLWRSEERNILTKLCSLYGAVILEKRLGDFYAGGYASTKSNMDRLLREGIIILCKQLVREAVALVDVLAPPDFILKSPLGMADGQVYKHIKEEIFKHKENFERPSWWREIVRSKL

SEQ ID NO: 661 - protein, 660 aa, Bos taurus; identical to SEQ ID NO: 371

SEQ ID NO: 662 - protein, 661 aa, Rattus norvegicus; identical to SEQ ID NO: 341

SEQ ID NO: 663 - protein, 660 aa, Danio rerio; identical to SEQ ID NO: 511

SEQ ID NO: 664 - protein, 661 aa, Mus musculus; identical to SEQ ID NO: 72

SEQ ID NO: 665 - protein, 700 aa, Mus musculus; identical to SEQ ID NO: 352

SEQ ID NO: 666 - protein, 660 aa, Homo sapiens [sequence omitted]

SEQ ID NO: 667 - protein, 660 aa, Homo sapiens [sequence omitted]

SEQ ID NO: 668 - protein, 681 aa, Gordonia otitidis
MSTTEHPSPPSTDSTIDDPQTDSQSSTTPDDASELFGADRELLVDNLRYVLDGRWRATRDDVRTRSNRADLLPDPSRTLEQARTRILDEMRELSAQGFASAGFGADHGGTGDIGASITAIEMLGYADLSLMVKAGVQWGLWGGAVENLGTARHHEKYVADTINLDLLGCFAMTETGHGSNVQALETTATYDAATKEFVIHSPTPSARKDYIGGAAEHARYAAVFAQLITAGPGQEPESYGVHCFVVPIRDADGNDLPGVTTSDCGYKGGLAGVDNGRILFDSVRIPRENLLNRYADVEDDGTYSSPIDNPNRRFFTMLGTLIRGRISVAATAGAASRKALAIATRYGLVRRQFDAPGDEDEIVVLDYLGHQRKLLPLIAKSYAVAMAQNELTEELHEVQSASPDDSDAGRQRELEASAAGLKAYATWHASHSINVAREACGGAGYLDENQISIIRGDIDVFTTFEGDNTVLTQLVAKEVLSAYADDVQGLSAGGWVRFIASMARDVVVEKTAVRQVVQTLLESSDEDTEKSALTNRGTQIRLFRNREDHLVRTCAQRLRRATDDDNDAFEVFNNAQDHLLKVGQARTERVVLEAFVQAINDCDSRAAAELLGKVCDLFVYSALEADLGWFMMHRHISVERAKAIRRGVNELCRDLRPYAATLVDAFGIPEELMGAPMIENH

SEQ ID NO: 669 - protein, 681 aa, Gordonia otitidis; identical to SEQ ID NO: 668

SEQ ID NO: 670 - protein, 688 aa, Gordonia alkanivorans
MATPTESPTPSSPTSSGRTPIAKEPTVDDPVTPAGVSADDDLSADERALLVDNLRFVLDGRWRATRETVRENSNRADLLPDPSCTLEEARAHTLEVMRELASQGFAAAGFAADHGGTGDIGASITAIEMLGYADLSLMVKAGVQWGLFGGAVENLGTKRHHDKYVPGIIDLDVLGCFAMTETGHGSNVQAIETTATYDRDAREFVIHSPTPSSRKDYIGGAAEHARFAAVFAQLITGGPGEEPEGRGVHCFVVPIRDEDGNDLPGVTTSDCGYKGGLDGVDNGRIMFDNVRIPAENLLNRYADVAEDGSYSSPIENINRRFFTMLGTLIRGRVSVAATAGAAGRKALTLATRYGLIRKQFEAPEATDEITVLDYLGHQRKLLPLIAKSYAIAFAQNEIVAELHDVQSVAPDDSDAGRQRQLEGQAAGLKAYATWHASHSINVSREACGGAGYLDENQLSIIRGDIDVFTTFEGDNTIMMQLIAKELLSSYSDDVQGLSAGGWVRFIAGMARDVVAEKTAVRQVVQTLLDSSDEDTEKSALTDRSTQIRLFRNREDHLVRTCAQRLRRALDDDNDAFDVFNNAQDHLLKVGHAHIERVVLEAFVEAIENCDSRSAAELLGKVCDLFVYSALEADLSWFMMHRHISVERAKAVRRGVNELCQELRPHARSLVDAFGVPEELLRAPMLVNG

SEQ ID NO: 671 - protein, 674 aa, Malus x
MDRVTWRTRVLSNHLNQPSWSSNPLSPNPCLGFSPPELSEPFEFDTKEMRKLLDAHNLEDRDWLFGLMKQSKLLNPREAGGRVFIAPDYNQSMEQQRQMTMKRIAYLLDRGVFKGWLTDKGVDAELRKFAFFEVIGIFDHSLAVKLGVHFFLWGGAIQFFGTKRHHDKWLSDTENYTIKGCFAMSELGHGSNVRGIETVTTYDSSTGEFVINTPCESAQKYWIGGAANHATHTIVFSQLSISGNNQGVHALIAQIRDENGNVCPGVRIADCGHKIGLNGVDNGRIWFDNVRIPRENLLNSVADVSPDGKYLSAINDPDQRFAAFMAPLTSGRVTIAVSSIYSSQISLAIAIRYSLTRRAFSVTPNGPEVLLLDYPSHQQRLLPLLAKTYAMTFASNYLKMIYVKRTPESSKAIHVVSSAFKALHTWHNMRTLQECREACGGQGIKTENRVGHFKGEFDVQSTFEGDNNVLMQQVSKALLAEYIATQKRGKPFKALGLEHMNKPCPVIPSQLTSSTLQCSQFQMDAFCLRERDLLNRFAMEVSQRQKQGESKEYSIILSYQLAGDLGRAFADRSILQTFIDAEAALPAGSLKNVLALLRSMYALICLEEDAAFLRYGYLSTDNVAAVRKEVSRLCGELRPHALALVSSFGIPDAFLSPIAFNWIDSNSWSSVEQH

SEQ ID NO: 672 - protein, 707 aa, Gallus gallus
MAPTLNVKEDSGNRSSWNTLLPDFPKGPLSKYRKKASFNWKEMAVFLDGEDIIQLKNRIFSALESDPFFAHHPGEELSREKYQELTFLRCKRLFEYDFLTQQEIMENPLKILNMVICIGMYDWSPCLQFFLHCGVFGGTILSASKRFADFMKKIYNMEIFGCFALTELSHGTNTKGIRTTATFDRNTQEFIINSPDFEAAKFWVGNMGKHATHAVVYAQLYTPDGQCQGLHSFIVQIRDTKTLLPMPGVMVGDIGKKIGQNGLDNGFAMFHNVRIPKENILNITGDVSPEGKYSSSFKDVKERFSAALGSLSSGRILITAVSATNLKLALSIAIRFSATRHQFGPTDEEEIPVIEYQTQQWRLLPYLAAAYALDYFSKSLFENFVEFYAGLLTKQRSQRQADLGREIHALSAASKPLSSWTAQQAAQECREACGGHGYLAMNRLGEIRNDNDPNCTYEGDNNVLLQQTSSYLMSWMNCIRKDKVPFESPLGTVNFLQDYHHIIGWRFKANSIDDCMDSSVPLAAYKWLVCYLLRESDLKLRKEKQSGHSDFEAKNNCQVYYCRSLAIVFIEQTVLQRYHDYTHDPNVPSTLQPVLKNLSALYGLWSLSKHLAVLYQGGYVSGEQAGRFVQNAILELCSRLKDDAVALVDVFAPPDFILNSPIGKASGELYKNLWAEILQGNKVLNRPSWWAEFCINKPVKGRLSSRL

SEQ ID NO: 673 - protein, 688 aa, Gordonia alkanivorans; identical to SEQ ID NO: 670

SEQ ID NO: 674 - protein, 691 aa, Vitis vinifera
MGSPSPADQVSRRAQALAGHLRGLHTSMEPSLSPSPCLQYSPPELASPPSDFNLSDMRKLMDGHNLQDRDWLFGLMIQSKLFNPRVAGGRVFVSPDYNQSMEQQREMTMKRIHYLLDCGVFQEWLTGRGPEVEMRKFALHEVIGMYDHSLAVKLGVHYFLWGGAIQFFGTKRHHDKWLRDSENYVIKGCFAMTELGHGSNVRGIETVTTYDSKTGEFVINSPCESAQKYWIGGAANHATHTIVFSQLNINGKSEGVHAFIAQIRDTDGNICPNVRVADCGHKIGLNGVDNGRIWFDNVRIPRENLLNSVADVSPDGQYLSAIKDPDQRFAAFLAPLTSGRVTIATSAVYSSKMSLAIAIRYSLTRRAFSITPNQPEVLLLDYPSHQRRLLPLLAKTYAMSFAANYLKMIYVKRTPESNKTIHVVSSAFKAILTWHNMRTLQECREACGGQGLKTENRIGQMKGEYDVQSTFEGDNNVLMQQVSKALLAEYIAVQKRNRPFKGLGLEHMNKSCPVVPSQLTSSTLRSSQFQTDIFCLRERDLLIRFAAEMSQLQAQGLSREYALLQSYQLAEDLGRAFSDRAILQTFLDAEAAVSSGPLKSMLSLLRSMHVLIILEEDASFLRYGYLSPDNAAGIRKEVTILCSELRPHALALVSSFGIPDAFLSPIAFNWIDANSWSSVQPQQGATVPLQI

SEQ ID NO: 675 - protein, 661 aa, Canis lupus
MNQDLRREREAASFNPELLTHVLDGSPENTRRRREIENLILNDPDFQHEDLNFLTRSQRYEVAVRKSANMVKKMRDFGIADPEEIMWFKKVHLVNFVEPVGLNYSMFIPTLLNQGTTAQQEKWLLSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEMDNGYLKMDNYRIPRENMLMKYAQVKPDGTYVKPVSNKLTYGTMVFVRSFLVGEAARSLSKACTIAIRYSAVRHQSEIKPGEPEPQILDFQTQQYKLFPLLATAYAFQFVGAYMKETYHRINEDIGHGDLSELPELHALTAGLKAFTSWTTNAAIEACRMACGGHGYSHCSGLPNIYVTFTPTCTFEGENTVMMLQTARFLMKSYDQVHSGKLVCGMVSYLNDLPTQRIQPQQVAVWPTVVDIDSPDSLTEAYKLRAARLVEIAAKNLQNEVIRRESKEVAWNLTSVDLVRASEAHCHYVVVKLFSEKLLKIQDKSIHTVLRNLCLLYCLYGISQKAGDFLQGSIMTESQITQVNQRIKELLTAVRPDAVALVDAFDFKDVTLGSVLGRYDGNVYEHLFEWAKKSPLNKAEVHESYYKHLKPLQSKL

SEQ ID NO: 676 - protein, 661 aa, Canis lupus
MNQDLRREREAASFNPELLTHVLDGSPENTRRRREIENLILNDPDFQHEDLNFLTRSQRYEVAVRKSANMVKKMRDFGIADPEEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEMDNGYLKMDNYRIPRENMLMKYAQVKPDGTYVKPVSNKLTYGTMVFVRSFLVGEAARSLSKACTIAIRYSAVRHQSEIKPGEPEPQILDFQTQQYKLFPLLATAYAFQFVGAYMKETYHRINEDIGHGDLSELPELHALTAGLKAFTSWTTNAAIEACRMACGGHGYSHCSGLPNIYVTFTPTCTFEGENTVMMLQTARFLMKSYDQVHSGKLVCGMVSYLNDLPTQRIQPQQVAVWPTVVDIDSPDSLTEAYKLRAARLVEIAAKNLQNEVIRRESKEVAWNLTSVDLVRASEAHCHYVVVKLFSEKLLKIQDKSIHTVLRNLCLLYCLYGISQKAGDFLQGSIMTESQITQVNQRIKELLTAVRPDAVALVDAFDFKDVTLGSVLGRYDGNVYEHLFEWAKKSPLNKAEVHESYYKHLKPLQSKL

SEQ ID NO: 677 - protein, 678 aa, Medicago truncatula
MDNHRITRRTTILTNHLRHDPPTAPTILHNHACLSHSPPELSESNPTTFDTFEMRKLLDGHNLEDRDWLFGLMIQSGLFNRREVDGRVFVNPDYNQSMEQQREMTMKRIAYLLDRGVFRGWLTGDGPQEELRKLALHEVIGMYDHSLAVKLGVHIFLWGGAVKFLGTKRHHDKWLRATENYDIKGCFAMSELGHGSNVRGIETVTTYDPISGEFVINTPCESAQKYWIGGAANHATHTIVFSQLNINGSNQGVHAFIAQIRDSDGNICPNIRIAECGHKIGLNGVDNGRIWFDNVRIPRENLLNSMADVSPSGEYLSAIKNTDQRFAAFLAPLTSGRVTIAVSSVYISKISLAIAIRYALTRRAFSITPNGPEVLLLDYPSHQQRLLPLLAKIYAMSFSAIELKKLYVNRTPESNKAIHIVSSAYKATFTWNNMRTLQECREACGGQGVKTENRIGQFKGEYDVHSTFEGDNNVLMQQISKALLAEYIACQTKNKPFKGLGLEHMNGSCPVIPSQLTSSTIKSSEFQIDLFHLRERDLLKRFAAEVSEHQSQGNSKESAFILSYQLAEDLGRAFSERAILKTFMEAESALPAGSLKDVLGLLRSLYALISVDEDAAFLRYGYLSTENASAVRKEVPKLCAELRPHALALVNSFGIPDAFLSPIAYNWVESNSWSTAQH

SEQ ID NO: 678 - protein, 678 aa, Medicago truncatula; identical to SEQ ID NO: 677

SEQ ID NO: 679 - protein, 686 aa, Brachypodium distachyon
MDPSPAAAARRAAAICRHLDGLSTGAAAVAALQSSPCLSYAPPESTENPPAFSPIELRALLDGHHLRERDWLFGAMEESPLFCPRRVGGGGGGGKVFVSPDYNEGKEGQREATMRRIAYLTGRGVFRGWLTEPGPDAELRKLAMLDCLGVYDHSLAIKVGVHFFLWGSAIKFLGTKRHHDKWLVETENYVIKGCFAMTELGHGSNVRGIETIATYDSKSREFVINTPCESAQKYWIGGAANHATHTIVFAQLHINGRNEGVHAFVAQIRDQDESVLPNIHIADCGHKIGLNGVDNGRIWFQNVRVPRENLLNLVADVLPDGEYVSMIDNPDQRFAAFLSPLTLGRVNIAVNSVYISKVGLAIAVRYALSRRAFSITPDGPEMLLLDYPSHQRRLLPLLAKVCLMSSAGNFMKKMYVKRTPEASKAIHIYSSALKATLTWQNMTTLQECREACGGQGLKTENRVGIFKAEFDVQSTFEGDNNVLLQQVSKALYAEFIATQRKKKPFKGLGLEHLNGPCPIIPDSLTSGILRSSKFQMDLFCLRERNLLKQFTEDVSHHLAQGESREKALMLSYQIAEDLARAFTERTILQIFLEDEMNATAGSLKDVLGLLRSMYVMTCIDESASFLRYGYLSRDNVATVRKEVMTLCSNLRPHVLAIVSSFGIPDAFLSPLAFDWIEANALSSSSQ

SEQ ID NO: 680 - protein, 675 aa, Glycine max
MTDNDRVSRRTEVLTNHLLRRTPPPSLLRPLPCLSYSPPELSNTISFDTREMRKLMDCHNLEDRDWLFSLILQSPLFNPRHRAGRFFVCPDYNQPMEHQRQATMKRIAYLLDKGVFRGWLTGNGPEQELRKLALHEVIGMYDHSLAVKLGVHFFLWGGAVKFLGTKRHHDKWLNSTENYDIKGCFAMSELGHGSNVRGIETVTTYDSNTGEFVINTPCESGQKYWIGGAANHATHTIVFSQLYINGSNQGVHAFIAQIRDSDGNICPNIRIADCGHKIGLNGVDNGRIWFDNVRIPRENLLNSVADVSPSGEYLSAIKNADQRFAAFLAPLTSGRVTIAVSAVYISKISLAIAIRYALTRRAFSITPNGPEVLLLDYPSHQRRLLPLLAKVYAMSFAANELKMMYVNRTPKSNKAIHIVSSAYKATLTWNNMRTLQECREACGGQGVKSENRVGNFMGEFDVHSTFEGDNNVLMQQISKALFAEYVASQKKKKPFSGLGLEHMNKPLPVIPSQLTSSYIRNSEFQIDLFHLRERDLLRRFAEEVSEYQSRGESKESAFILSYQLAEELGRAFSERAILKTFMEAESTVPAGSLKNVLGLLRSLYAVICVDEDSAFLRYGYLSTENASAVRKEVPKLCAELRPHALALVSSFGIPDAFLSPIAYNWVDSNSWSSQL

SEQ ID NO: 681 - protein, 675 aa, Glycine max
MDNDRVSRRTEVLTNHLLRRTPPPSALLHPHPCLSYSPPELSNTISFDTREMRKLMDCHNLEERDWIFSLILQSPLFNPRHRAGRVFVSPDYNQPMEHQRQATMKRIGYLLQKGVFRGWLTGNGPEQELRKLALHEVIGMYDHSLAVKLGVHFFLWGGAVKFLGTKRHHDKWLNSTENYDIKGCFAMSELGHGSNVRGIETVTTYDSNTGEFVINTPCESGQKYWIGGAANHATHTIVFSQLYINGSNQGVHAFIAQIRDSDGNICPNIRIADCGHKIGLNGVDNGRIWFDNVRIPRENLLNSVADVSPSGEYLSAIKNADQRFAAFLAPLTSGRVTIAVSAVYISKISLAIAIRYALTRQAFSITPNGPEVFLLDYPSHQRRLLPLLAKVYAMSFAANELKIMYVNRTPKSNKAIHIVSSAYKATLTWNNMRTLQECREACGGQGVKSENRVGNFMGEFDVHSTFEGDNNVLMQQISKALFAEYIACQKKNKPFSGLGLEHMNKPLPVIPSQLTSSTVRSSEFQIDLFHLRERDLLRRFAEEVSEYQSRGESKESAFILSYQLAGDLGRAFSERAILKTFMEAESTLPAGTLKNVLGLLRSLYAVICVDEDAAFLRYGYLSTENASAVRKEVPKLCAEIRPHALALVSSFGIPDAFLSPIAYNWVDSNSWSSQL

SEQ ID NO: 682 - protein, 676 aa, Glycine max
MQTPNCEAERRIQRLTLHLNPTALVAAKQLEMATCARGKLSVDTPSLSSYMRGKHVDIQEKVFDYFNANPRLQTPVEISKDEHRDLCMKQLTGLVREAGIRPLRYVVDDPAKYFAILEAVGSVDMSLGIKMGVQYSLWGGSVLNLGTKKHKDKYFDGIDNLDYPGCFAMTELHHGSNVQGLQTVATFDIITDEFIINTPNDGAIKWWIGNAAVHGKFATVFARLKLPTYDKKGLSDMGVHAFIVPIRDMKTHQPLPGIEIHDCGHKVGLNGVDNGALRFRSVRIPRDNLLNRFGDVSRDGKYTSSLPTVNKRFAATLGELVGGRVGLAYSSVSVLKVAATIAIRYSLLRQQFGPPNQPEVSILDYQSQQHKLMPMLASTYAFHFATTNLVEKYSQMKKTHDDELVADVHALSAGLKAYVTSYTAKSLSICREACGGHGYAAVNRFGILRNDHDIFQTFEGDNTVLLQQVAGDLLKQYKGKFKGGTFAVTWNYLRESMNTYLSQPNPVTARWEGEDHLRDPKFQLDAFRYRTSRLLQSVAVRLRKHSKSLGDFGAWNRCLNHLLTLAESHIESVILAKFIEAVQSCPDPSSQAALKLVCDLYALDRIWNDIGTYRNVDYVAPNKAKAIHKLAEYLSFQVRNIARELVDAFDLPDHVTRAPIAKRSGAYSQYTQYVGF

SEQ ID NO: 683 - protein, 681 aa, Cricetulus griseus
MGSPVHRVSLGDTWSRQVHPDIDSERGTPPFSVERLTNILDGGIQNTVLRRKVESILQGDPVFNLKDHYFMTQDEQYEAAIQKKFHLEILARHLGWSEGSPERSYAERALSGYVNLGLHGIAMNALRSLGSDEQIAKWGQLGKNFQIIATYAQTELGHGTNLRGLETEATYDAATQEFVIHSPTMTATKWWPGDLGRSVTHAIVLAQLICSGVQHGMHAFIVPIRSLEDHTPLPGITVGDIGPKMGLEHIDNGFLRLNHVRVPRENMLSRFAEVLPDGSYRRLGTTQSNYLAMLVTRVWLLLTGILPYLKKSCVIAVRYSVIRHQSHLRPSDPEAKILDYQTQQQKLLPQLAMSYAFHFLATKLLEFFHSSYNAILNRDFSLLPELHALSAGMKAMISDFCTQGAEICRRACGGHGYSKLSGLPTLVTQVTASCTYEGENTVLYLQMARFLMKSYLQVQVSPGSTPQKPLPWSVMYLATPGPSRCTAQTAAHFLCPDLYTTAWAHVSARLIKDAVHHTQTLMRSGVDQHDAWNQTAVIHLQAAKAHCYYITVRSFKEAVEKLDNEPAIQQVLQRLCDLYALHGILTNSGDFLHDGFLSGAQVDMARTAFLDLLPLIRKDAILLTDAFDFTDHCLNSALGCYDGHVYERLFEWAKKSPANTKENPAYEKYIRPLLQSWRPKL

SEQ ID NO: 684 - protein, 671 aa, Cricetulus griseus
MDNSKAVERNVDSIILTERAAATFNPELVTHILDGSPENTRRRREIENIILNDPDFQHEDYNFLTRSQRYEVAVKKSATMVKKMREFGISDPEEIMWFKKLHLVNFVEPVGLNYSMFIPTLLNQGTDAQREKWIRPSQELQIIGTYAQTEMGHGTHLRGLETTATYDPKTQEFILNSPTVTSIKWWPGGLGKTSNHAIVLAQLITQGQCYGLHAFVVPIREIGTHKPLPGITVGDIGPKFGYEEMDNGYLKMDNYRIPRENMLMKYAQVKPDGTYVKPLNDKLTYGTMVFVRSFLVGDAARCLSKACTIAIRYSAVRHQSEIKPGEPEPQILDFQTQQYKLFPLLATAYAFHFVGRYMKETYLRINESIGKGDLSELPELHALTAGLKAFTTWTANAGIEECRMACGGHGYSHSSGIPNIYVTFTPACTFEGENTVMMLQTARFLMKTYDQVHSGKLVGGMVSYLNDLPSQRIQPQQVAVWPTLVDINSLDSLTEAYKLRAARLVEIAAKNLHTHMSHRKSKEVAWNLTSVYLVRASEAHCHYVAVKLFSDKLPKIQDKAVQAVLRNLCFLYSLYGISQKGGDFLEGNIITAAQMSQVNSRILELLTLIRPNAVALVDAFDFKDMALGSVLGRYDGNVYENLFEWAKKSPLNKTEVHESYYKHLKPLQSKL

SEQ ID NO: 685 - protein, 700 aa, Heterocephalus glaber
MAPTLEGCDDVLWPDPPRGPLDAYRARASFSRRELQLFWEGEDMLRFKKTVFSALEKDPLFSSSRGPELPLEKYRELSFLRCKRVLEYGFFSLDSLLQNPLQLLALINCLGAYDWSVSTKFALHLMVFGSTLYSLGSERHLKYVEKVLNMEIFGCFALTELSHGSNTQAIRTTAHYDPATEEFVIHSPDFEAAKFWVGNMGKTATHGVVFAQLYTPDGQCHGLHSFVVQIRDPETLLPMPGVMVGDMGRKLGQNGLDNGFAMFHKVRIPRQDLLNRAGDVTPQGTYVTTVKDAKQRTGVSLGSLTSGRIFITGMCVVNLQQALCITNRFSATRRQFGPTEEEEIPVLEYQMQQWRLLPYLAAAYALDHFSKSLLLDLEGLYQGLLSGDHGVWQAELSREIHALGAAAKPLVSWTAQQGIQECREACGGHGYLAVNRLGDLRNDNDPNCTYEGDNNVLLGQTSSYLLSFLERQVQDGARFQSPLRTVDFLEAYPGMVGQRFKGTSVADWLDPTAPLAAYKWLVCYLLQRSHQKVMQEKRSGRSSFEAKNNSQVYHMRTLALAFVELTAAQRFHTRTHGPDTPPALRAVLGRLSTLYALWSLSRHLALLYQGGYLSGEQAGEALEGAILDLCAQLKDDAVALVDVIAPPDFVLNSPIGRADGELYKNLWSAVLQGSGVLERPTWWQEFCVHRPVGAGLKSKL

SEQ ID NO: 686 - protein, 662 aa, Heterocephalus glaber
MNPDLRRERAAATFDPELITYLLDCGPEKTRRRREIENMILNDPDFQHEDYNFLTRSERYEVAVKKSAIMVKKMREFGIADPDEIMWFKKLRLVNFVEPVGLNYSMFIPTLVNQGTTAQQEKWLHPSKGLQIIGTYAQTEMGHGTHLRGLETTATYDPKTQEFIMNSPTVTSIKWWPGGLGKTSNHAVVLAQLITQGKCYGLHAFIVPIREMGTHRPFPGITVGDIGPKFGYEEMDNGYLKMDNYRIPRENMLMKYAQVKPDGTYVKPVSNKLTYGTMVFVRSYLVGEAARSLSKACTIAIRYSAVRRQSEIKPGEPEPQVLDFQTQQYKLFPILATAYAFQFVGSYMKETYYRINESIGQGDLSELPELHALTAGLKAFTTWTANTGIEECRLACGGHGYSHCSGIPNIYVTFTPACTFEGENTVMMLQTARFLMKSYDQVRSGKLVCGLVSYLNDLPSQRIQPQQVAVWPTKMDINSPDSLTEIYKLRAARRLIDVAAKNLQTEVSHRKSREEAWNLTSVDLVRASEAHCHYVVVKLFADKLLKIQEKSIQIVLRNLFFLYSLYGISQKAGDFLQGNIVTESQITQANQRVLELLTVIRPNAVALVDAFDFKDETLGSVLGRYDGNVYENLFEWAKKSPLNKTEVHESYYKHLKPLQSKL

SEQ ID NO: 687 - protein, 817 aa, Cavia porcellus
MAGWSARERAQESANQITMLEIPVQRSPRRTSFRLMRRNWSKIPNQWRAEGQRSGEGTTISTCCFRDSWETGAERDVTSRSHASEAGPGAAVRSDAMTFAPGHAPLRTTMAPAPEGSGDVLWSDPSRGPLDAYRMRASFSPRELQLFWEGEDTLRFKKAVFLALEKDPLFAGSRGMDLSLEKYRELSFLRCKRIFEYGLFGLGSLDQSLGSLDQSLLRFPVLFSCLGAYDWSLGAKLALHLMVFGSALYSLGSERHLRYIEKLLNMEIFGCFALTELSHGSNTQAIRTTAHYDPATEEFIIHSPDFEAAKFWVGNLGKTATHGVVFAQLYTPDGQCHGLHPFMVQIRDPKTLLPMPGVMVGDMGWKLGQNGLDNGFAMFHKVRIPRQDLLNRAGDVTPQGTYVTAFKDARQRFGASLGSLSSGRICITSVCVTNLQQAVCIAVRFSATRRQFGPTEEAEEIPVLEYRLQQWRLLPYLAAAYALDHFSKSLLLDLKGLYQGLLSGDRSAQQAELGREIHALAAAAKPLVSWTAQRGIQECREACGGHGYLAVNRLGDLRNDNDPNSTYEGDNNVLLRQTSRYLLSFLEHQGQDGACFQSPLQTMDFLQAYPGMLSQKFQGTRVADWLEPAAPLAAYTWLVCYLLRRSHQKVTQEKRSGHSDFEVVNSSQVYHLRTLALAFIELTVVQRFHKHTHGPDVPPALQAVLGRLSALYALWSLSQHTALLYQGGYLSGEQAGQALEDAILELCAQLKDDAVALVDVIAPPDFILNSPIGRADGELYKNLWGAVLQGRGVLERASWWQEFSVHRPVVGSLKSKL

SEQ ID NO: 688 - protein, 661 aa, Oreochromis niloticus
MNPDIVKERKNATFDVEKLTFILDGGPEKTRRRREIESLVFSDPDFKEEDPNFLSRSERYDQAVRKSAQMILKLREYGIADPEEIYHYKSMVKGNNQESLGLHFAMFIPFLHSQCDHHQKKKWLPLAESYRVVGTYAQTEMGHGTHLRGLETTATYDPATQEFVLNSPTVSSIKWWPGGLGKTSNHAIVLAQLYTLGNCHGLHAFIVPIRDMNTHLPLPGIVVGDIGPKFGFNEVDNGFLKLENVRIPRENMLMKYAKVEPDGAYVQPPSTKLTYGTMVFIRSMIVAESARALAKSSTIAIRYSAVRHQSEIRPGEPEPQILDYQTQQYKLFPLLATAYAFTFVGQYMRQTYHRITEDINQGDFSEMPELHALSAGLKAFTSWEATSAIEVCRMSCGGHGYSRSSALPDIYVEFTPTCTYEGENTVMMLQTARYLVKSYKQAKAGQQLSGIVSYLNEADVRRVQPQPVAARPTVVDINDLTSLTEVYKLRAAILVELAAKSIQQELQRRKSQEDAWNNSAIDLVRASDAHCHYVVVKLFTDKLGEVADTAVHSVLSTLALLYTLYGITKNSGDFLQAGLLSVPQVMQISIRIKELLAQLRPNAVALVDAFDIHDKKLNSVLGRYDGNVYEHMFEWARKSPLNATEVHESFHKYLKPLRSKL

SEQ ID NO: 689 - protein, 661 aa, Oreochromis niloticus
MNPDIVKERKNATFDVEKLTFILDGGPEKTRRRREIESLVFSDPDFKEEDPNFLSRSERYDQAVRKSAQMILKLREYGIADPEEIYHYKRCVHPDRPEPLDLHLGMFLPTLLNQATPEQMDRFFMPAWTLKIIGTYAQTEMGHGTHLRGLETTATYDPATQEFVLNSPTVSSIKWWPGGLGKTSNHAIVLAQLYTLGNCHGLHAFIVPIRDMNTHLPLPGIVVGDIGPKFGFNEVDNGFLKLENVRIPRENMLMKYAKVEPDGAYVQPPSTKLTYGTMVFIRSMIVAESARALAKSSTIAIRYSAVRHQSEIRPGEPEPQILDYQTQQYKLFPLLATAYAFTFVGQYMRQTYHRITEDINQGDFSEMPELHALSAGLKAFTSWEATSAIEVCRMSCGGHGYSRSSALPDIYVEFTPTCTYEGENTVMMLQTARYLVKSYKQAKAGQQLSGIVSYLNEADVRRVQPQPVAARPTVVDINDLTSLTEVYKLRAAILVELAAKSIQQELQRRKSQEDAWNNSAIDLVRASDAHCHYVVVKLFTDKLGEVADTAVHSVLSTLALLYTLYGITKNSGDFLQAGLLSVPQVMQISIRIKELLAQLRPNAVALVDAFDIHDKKLNSVLGRYDGNVYEHMFEWARKSPLNATEVHESFHKYLKPLRSKL

SEQ ID NO: 690 - protein, 651 aa, Ornithorhynchus anatinus
MQLKEMKALKGLTSLVFDPIREEKDKEKLILNDPDFQHEDMNFLDRTNRYELAVKKSADMVKKMRDFGIGDPEEIMWFKSFVHRGRPEPLDLHLGMFLPTLLHQATQEQQERFFMPAWNLEIVGTYAQTEMGHGSHLRGLETTATFDPQTQEFVLNSPTVTSIKWWPGGLGKTSNHAIVLAQLYTKGQCYGLHAFLVPLREMGTHKPLPGITVGDIGPKFGYHEMDNGYLKMDRVRIPRENMLMRYAQVKPDGTYVKPVSNKLTYGTMVFIRSILVGEAARALSKACTIAIRYSAVRHQSEIRPGAAEPQILDYQTQQYRLFPLLATAYAFQFVGAFMKETYHRINVDISQGDLSELPELHALTAGIKAFTTWTSSAGIESCRMACGGHGYSQCSGLPNIYVNFTPSCTYEGENTVMMLQTARFLMKSYNHVQSGKLVGGMVAYLNDLPSQRIQPQQVAAWPAAGNLSSPLGLVEAYKLRAARLVETAARNLQAEVKHRKSKEEAWNLTSVDLVRASEAHCHYVVVKLFAEKLTQVTDKPLQAVLNNLCLLYALHGINEKAGDFLQGGILTEAQVSQANQHVKELLTALRPEAVALVDAFDFQDAILGSVLGRHDGRVYENMFEWAKNSPLNKTEVHPSFHKHLKPLQSKL

SEQ ID NO: 691 - protein, 661 aa, Loxodonta africana
MNPDLRRERAAASFDPELLTNILDGSAENTRRRREIENLILNDPDFQHEDPNFLTRSQRYEVAVRKSAIMVQKMREFAIADPEEIMWFKKLHLGSFVEPVGLNYSMFIPTLLNQGTTAQQEKWLPSSKGLQIIGTYAQTEMGHGTHLRGLETTATYDPETQEFILNSPTVTSIKWWPGGLGKTSNHAIVLAQLFTQGKCYGLHAFIVPIREIGTHKPLPGITVGDIGPKFGYDEIDNGYLKMDNYRIPRENMLMKHAQVKPDGTYVKPLSNKLTYGTMVFVRSFLVGEAARCLSKACTIAIRYSAVRHQSEIKPDEPEPQILDFQTQQYKLFPLLANAYAFQFVGAYMRETYHRINGDIDQGDLRELPELHALTAGLKAFTSWTANAGIEECRMACGGHGYSHCSGLPNIYVNFTPTCTFEGENTVMMLQTARFLMKSYDQVHSGKLVYGTVSYLNDLPSQRIQPQQVAVWPTVVDINNPDSLTEAYKLRAARLVEIAAKNLQAEVIHRKSKEVAWNLTSVDLVRASEAHCHYVIVKLFSEKLHKIQDKSIHAVLRSLCLLYSLYGINQKSGDFLQGNIMTESQISQVNQRIKELLTTIRPDAVALVDAFDFQDVTLGSVLGRYDGNVYENLFEWAKKSPLNKTEVHESYYKHLKPLQSKL

SEQ ID NO: 692 - protein, 661 aa, Loxodonta africana
MNPDLRRERAAASFDPELLTNILDGSAENTRRRREIENLILNDPDFQHEDPNFLTRSQRYEVAVRKSAIMVQKMREFAIADPEEIMWFKNFVHRGQPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLFTQGKCYGLHAFIVPIREIGTHKPLPGITVGDIGPKFGYDEIDNGYLKMDNYRIPRENMLMKHAQVKPDGTYVKPLSNKLTYGTMVFVRSFLVGEAARCLSKACTIAIRYSAVRHQSEIKPDEPEPQILDFQTQQYKLFPLLANAYAFQFVGAYMRETYHRINGDIDQGDLRELPELHALTAGLKAFTSWTANAGIEECRMACGGHGYSHCSGLPNIYVNFTPTCTFEGENTVMMLQTARFLMKSYDQVHSGKLVYGTVSYLNDLPSQRIQPQQVAVWPTVVDINNPDSLTEAYKLRAARLVEIAAKNLQAEVIHRKSKEVAWNLTSVDLVRASEAHCHYVIVKLFSEKLHKIQDKSIHAVLRSLCLLYSLYGINQKSGDFLQGNIMTESQISQVNQRIKELLTTIRPDAVALVDAFDFQDVTLGSVLGRYDGNVYENLFEWAKKSPLNKTEVHESYYKHLKPLQSKL

SEQ ID NO: 693 - protein, 668 aa, Cricetulus griseus
MGSPVHRVSLGDTWSRQVHPDIDSERGTPPFSVERLTNILDGGIQNTVLRRKVESILQGDPVFNLKDHYFMTQDEQYEAAIQKKFHLEILARHLGWSEGSPERSYAERALSGYVNLGLHGIAMNALRSLGSDEQIAKWGQLGKNFQIIATYAQTELGHGTNLRGLETEATYDAATQEFVIHSPTMTATKWWPGDLGRSVTHAIVLAQLICSGVQHGMHAFIVPIRSLEDHTPLPGITVGDIGPKMGLEHIDNGFLRLNHVRVPRENMLSRFAEVLPDGSYRRLGTTQSNYLAMLVTRVWLLLTGILPYLKKSCVIAVRYSVIRHQSHLRPSDPEAKILDYQTQQQKLLPQLAMSYAFHFLATKLLEFFHSSYNAILNRDFSLLPELHALSAGMKAMISDFCTQGAEICRRACGGHGYSKLSGLPTLVTQVTASCTYEGENTVLYLQMARFLMKSYLQVQVSPGSTPQKPLPWSVMYLATPGPSRCTAQTAAHFLCPDLYTTAWAHVSARLIKDAVHHTQTLMRSGVDQHDAWNQTAVIHLQAAKAHCYYITVRSFKEAVEKLDNEPAIQQVLQRLCDLYALHGILTNSGDFLHDGFLSGAQVDMARTAFLDLLPLIRKDAILLTDAFDFTDHCLNSALGCYDGHVYERLFEWAKKSPANTKVVECNSL

SEQ ID NO: 694 - protein, 674 aa, Bombus terrestris
MKDTIADLPKGPLDPYRKSATFDWKLLKLNIEGKDFVEFQKTLWDFMKKTSVFQRHSCTTLDEQRRLCNARVRALRDNNIASPLTHAHWFNIVFQYEASIPIKMGVMDGMVPSTILALGNDDHFQTVAKIQEGEYTCCFALTEISHGTNAKGIRTTATYDAKSKAFILNTPDFEAAKCWIGGLGKTATHAIVFAQLITPDQQNHGLHTFIVPIRDPNTHIPYPNIDVGDMGEKIGLNGVDNGFIMFNNYLISRTCLLNKTADVTEDGNYTASVKDKSKRFGASLGALSSGRITITSICANFASVAITIAVRYCTVRKQFGPSELEEWPVIKYQAQQWRLFPHLAATYALKIFSAEFVNQMCEFNFKLITAKNQDNIDNEGMEIHALSSATKPVCSWTSRDIIQDCRESCGGHGYLKISRLGDLRAENDVTCTFEGENNVLIQQASNWLLNQWSNVLNGKPINSPLRTADFMKDANNILMQTFPYTTVDETLKPENLFLSFTWLLCYYLKRTYEQTQNLKRKGCDDFEIRNNTQVFFAQTLSLLYGQHVIMKYFIECIQNPSWRSEERNVLIKLCSLYGAAILEKRLGDFYAGGYASPKSNMDTLLRKGIIILCKELVQEAVALVDVLAPPDFVLNSPLGMSDGQVYKHIKEEIFKVKENFERPSWWREIVRSKL

SEQ ID NO: 695 - protein, 661 aa, Equus caballus
MNPDLLRERAAASFNPELLTQILDGSPENTRRRREIENLILKDPDFQHEDLNFLTRSQRYEVAVRKSANMVKKMREFGISDPDEIMWFKKLHLVNFVEPVGLNYSMFIPTLLNQGTTAQQEKWLHSSKGLQIIGTYAQTEMGHGTHLRGLETTATYDPETQEFILNSPTVTSIKWWPGGLGKTSNHAIVLAQLITKGKCYGLHAFMVPIREIGTHKPLPGITVGDIGPKFGYDEMDNGYLKMDNYRIPRENMLMKYAQVKPDGTYVKPVSNKLTYGTMVFVRSFLVGEAARSLSKACTIAIRYSAVRHQSEIKPGEPEPQILDFQTQQYKLFPLLATAYAFQFVGAYMKETYLRINEGIGQGDLSELPELHALTAGLKAFTSWTSNAAIEACRMACGGHGYSHCSGLPNIYVTFTATCTFEGENTVMMLQTARFLMKSYDQVHSGKLVCGMVSYLNDLPSQRIQPQQVAVWPSVVDINSPDSLTEAYKLRAARLVEIAAKNLQTEVFHRKSKEVAWNLTSVDLVRASEAHCHYVVVKLFAEKLLKIQDKSVQAVLRNLCLLYSLYGISQNAGDFLQGSIMTESQITQVHQRVKELLTAIRPDAVALVDAFDFQDVTLGSVLGRYDGNVYENLFEWAKKSPLNKTEVHDSYYKHLKPLQSKL

SEQ ID NO: 696 - protein, 661 aa, Equus caballus
MNPDLLRERAAASFNPELLTQILDGSPENTRRRREIENLILKDPDFQHEDLNFLTRSQRYEVAVRKSANMVKKMREFGISDPDEIMWFKNFVHRGRPEPLDLHLGMFLPTLLHQATKEQQERFFIPAWNLEMIGTYAQTEMGHGTHLRGLETTATYDPETQEFILNSPTVTSIKWWPGGLGKTSNHAIVLAQLITKGKCYGLHAFMVPIREIGTHKPLPGITVGDIGPKFGYDEMDNGYLKMDNYRIPRENMLMKYAQVKPDGTYVKPVSNKLTYGTMVFVRSFLVGEAARSLSKACTIAIRYSAVRHQSEIKPGEPEPQILDFQTQQYKLFPLLATAYAFQFVGAYMKETYLRINEGIGQGDLSELPELHALTAGLKAFTSWTSNAAIEACRMACGGHGYSHCSGLPNIYVTFTATCTFEGENTVMMLQTARFLMKSYDQVHSGKLVCGMVSYLNDLPSQRIQPQQVAVWPSVVDINSPDSLTEAYKLRAARLVEIAAKNLQTEVFHRKSKEVAWNLTSVDLVRASEAHCHYVVVKLFAEKLLKIQDKSVQAVLRNLCLLYSLYGISQNAGDFLQGSIMTESQITQVHQRVKELLTAIRPDAVALVDAFDFQDVTLGSVLGRYDGNVYENLFEWAKKSPLNKTEVHDSYYKHLKPLQSKL

SEQ ID NO: 697 - protein, 622 aa, Pan troglodytes
MILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNYRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQHVKELLTLIRSDAVALVDAFDFQDVTLGSVLGRYDGNVYENLFEWAKNSPLNKAEVHESYKHLKSLQSKL

SEQ ID NO: 698 - protein, 660 aa, Pan troglodytes
MNPDLRRERDSASFNPELLTHILDGSPEKTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNYRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQHVKELLTLIRSDAVALVDAFDFQDVTLGSVLGRYDGNVYENLFEWAKNSPLNKAEVHESYKHLKSLQSKL

SEQ ID NO: 699 - protein, 660 aa, Pan troglodytes
MNPDLRRERDSASFNPELLTHILDGSPEKTRRRREIENMILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNYRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQHVKELLTLIRSDAVALVDAFDFQDVTLGSVLGRYDGNVYENLFEWAKNSPLNKAEVHESYKHLKSLQSKL

SEQ ID NO: 700 - protein, 622 aa, Nomascus leucogenys
MILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNYRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKTQDKAIQAVLRNLCLLYSLYGISQNAGDFLQGSIMTESQITQVNQRVKELLTLIRSDAVALVDAFDFQDVTLGSVLGRYDGNVYENLFEWAKNSPLNKTEVHESYKHLKSLQSKL

SEQ ID NO: 701 - protein, 663 aa, Nomascus leucogenys
MNPDLRRERDSASFNPELLTHILDGSPEKTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMDPMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNYRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKTQDKAIQAVLRNLCLLYSLYGISQNAGDFLQGSIMTESQITQVNQRVKELLTLIRSDAVALVDAFDFQDVTLGSVLGRYDGNVYENLFEWAKNSPLNKTEVHESYKHLKSLQSKL

SEQ ID NO: 702 - protein, 660 aa, Nomascus leucogenys
MNPDLRRERDSASFNPELLTHILDGSPEKTRRRREIENMILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNYRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKTQDKAIQAVLRNLCLLYSLYGISQNAGDFLQGSIMTESQITQVNQRVKELLTLIRSDAVALVDAFDFQDVTLGSVLGRYDGNVYENLFEWAKNSPLNKTEVHESYKHLKSLQSKL

SEQ ID NO: 703 - protein, 657 aa, Dictyostelium fasciculatum
MESYDRIHTIVSHILPSVDDIWLESNDVSASTAATSNGSEPLNITPDKPSKPISKWDKEELREFLESNPAYKQHKQAILEALRDPLFAPRYNMNKEEWRELTVKRAVKLIQQGLISITDLNRDPNKYLMTLELASLADNSLSVKMGVHFSLFGNAVLNLGTEKHHLKYLKDIDTWKLPGCFGMTELGHGSNVQGIETTATYDKDTEEFVINTPSESAQKSWIGNAAVHGQACSVFAQLITGGVNHGVHVFVVPIRNPDGSIVENVRIMDNGHKLGLQGVDNGRIWFNNKRIPRDNLLNKYGDVQKDGTYSSPIQGKGKRFGTMVSPLVGGRVLISMSALNISKAALIICVRYGYQRRQFGSKGKEAPIMEYLSHQRRLFPLVASAVAFTFTVRQLKQVYCEPNKTPQNVKDLHILASGAKAVVTWFKTHTLQQTRESCGGQGFSSLNQIANWKSDSDVDLTYEGDNHVLLQQVARFLLVELQKGRYTPTLPNHGTKIFDASFQIQTLKWRESHLVQTLSQKIMGFIDQGKNLQVAWNSCLDTVTFLGKAYIERITLEFFQEGINKAAPSLQPVLELCRNLFFVYRVTEDLGYFMCYDGLTHESGIRIKESLSKLCQDMLPVGLDLVNSFDIAEQFIHAPIAQADYVQEFRYGVERNY

SEQ ID NO: 704 - protein, 676 aa, Apis mellifera
MKDIIADLPKGPLDPYRKCATFDWKLLKLNLEGEDFVKFQKTLWDFIKTSPVFQNHVCDTLDEQRKLCNSRVRALKDNDIANPLIHRHWFTIIYQYEASLPIKMGVMDGMVPITILALGTEDHYDTVTKIQNGQYICCFALTEISHGTNAKGIRTTATYDVKSKSFVLNTPDFEAAKCWVGGLGKTATHAIVFAQLITPDRQNHGLHTFIVPIRDPDTHIPYPNINVGDMGEKIALNGVDNGFMMFHNYHISRTCLLNKTANVTEDGNYTASVKDKSKRFGASLGALSSGRITITSLCSNFTSVAITIAIRYCAVRKQFGPSEFEEWPVIEYQAQQWRLFPHLAATYAIKIFSVAFVNQMFEFNLKLITMNAKNQDNIDSEGMEIHALSSATKPVCSWTSRDIIQDCRESCGGHGYLKISRLGDLRAENDVTCTFEGENNVLIQQASNWLLNQWSNVLSGKPINSPLKTADFMKDANNILIQKFSYTTVDDILKPENLFLSFTWLLCYYLKRTYEQTQNLKRKGCDDFDIRNNTQVFFAQTLSILYGQHVIMKYFIECIQNPLWRSEERNILTKLCSLYGAVILEKRLGDFYAGGYASTKSNMDSLLREGIIILCKQLVREAVALVDVLAPPDFILKSPLGMADGQVYKHIKEEIFKHKENFERPSWWREIVRSKL

SEQ ID NO: 705 - protein, 705 aa, Capsaspora owczarzaki
MQRLNELAVHLSLHPEAAAGAAPSTTAHGTYHSAPSATSNSSTVSIDLLNKFVDKHNFATRKAMWELLKEPLFELDYNMSIKQLRDLTLRRLQRLSDLGYPYQMLDPNSTPESQMEVYARTDCMYMYDCNLTVRVGAHVNLWGGSVRNLGTEYHHEKYLKDIAYNRLPGCFAMTELGHGSNVKGLETTATFDKATQEFIINTPTESAQKFWIGNALTAHAATVFAQLHIGGVNRGIHAFIVPLRDANGKIPHNIRIADCGMKMGLNGVDNGRFWFNNVRIPRMNMLNRMANVTEDGEYLSMIEDNDMRFGAMVAELVAGRVSMIGGSTNLAKVGLTIAVLYSIARRQFGPDDSPERPIMDYLLHQRRLVPEIAGVYAMNATSHYVRNLWVNRSADFDERIRQMKEIHILASGLKALSGWQMRQALSTCREACGGQGYASWNRIPVLMADSDVFMTFEGDNNVLLVQVARQLVKEYARAMEKGQAGIPQFAKPTDRLAHMAGTARGVPLSAAKPVVWDASAQRFVEVNLSAFDNGSKHRNAEFQMRIFEIREYDAIKRLIAALSAKKAAGHNDDSAWNLCGELAAVCGQAYIERFVLTRFIEDIQTESSAPERLVLEKLRALHAMWRITTQPSFLAYQFIPRQDIEIMADEVNVILAELRPHLANLVKAFGVPQHLLPAITSDYVAAHSWAETLKASEFKGNVFHL

SEQ ID NO: 706 - protein, 665 aa, Ailuropoda melanoleuca
MNQDLRREREAASFNPELLTHVLDGSPESTRRRREIGRRAKNLILNDPDFQHEDLNFLTRSQRYEVAVRKSANMVKKMREFDIADPEEIMWFKKVHLVNFVEPVGLNFSMFIPTLLNQGTTAQQEKWLLSSKGLQIIGTYAQTEMGHGTHLRGLETTATYDPETQEFILNSPTVTSIKWWPGGLGKTSNHAIVLAQLITKGKCYGLHAFIVPIRELGTHKPLPGITVGDIGPKFGYDEMDNGYLKMDNYRIPRENMLMKYAQVKPDGTYVKPVSNKLTYGTMVFVRSFLVGEAARCLSKACTIAIRYSAVRHQSEIKLGEPEPQILDFQTQQYKLFPLLATAYAFQFVGAYMKETYHRINEDIGQGDLSELPELHALAAGLKAFTSWTTNAAIEACRMACGGHGYSHCSGLPNIYVNFTPTCTFEGENTVMMLQTARFLMKSYDQVHSGKLVCGMVSYLNDLPTQRIQPQQVAVWPTVVDIDSPDSLTEAYKLRAARLVEIAAKNLQNEVIHRESKEVAWNLTSVDLVRASEAHCHYVVVKLFSEKLLKIQDKSVHAVLRNLCLLYCLYGISQKAGDFLQGSIMTESQITQVNQRMKELLTAIRPDAVALVDAFDFQDVTLGSVLGRYDGNVYENLFEWAKKSPLNKSEVHESYCKYLKPLQSKL

SEQ ID NO: 707 - protein, 665 aa, Ailuropoda melanoleuca
MNQDLRREREAASFNPELLTHVLDGSPESTRRRREIGRRAKNLILNDPDFQHEDLNFLTRSQRYEVAVRKSANMVKKMREFDIADPEEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIRELGTHKPLPGITVGDIGPKFGYDEMDNGYLKMDNYRIPRENMLMKYAQVKPDGTYVKPVSNKLTYGTMVFVRSFLVGEAARCLSKACTIAIRYSAVRHQSEIKLGEPEPQILDFQTQQYKLFPLLATAYAFQFVGAYMKETYHRINEDIGQGDLSELPELHALAAGLKAFTSWTTNAAIEACRMACGGHGYSHCSGLPNIYVNFTPTCTFEGENTVMMLQTARFLMKSYDQVHSGKLVCGMVSYLNDLPTQRIQPQQVAVWPTVVDIDSPDSLTEAYKLRAARLVEIAAKNLQNEVIHRESKEVAWNLTSVDLVRASEAHCHYVVVKLFSEKLLKIQDKSVHAVLRNLCLLYCLYGISQKAGDFLQGSIMTESQITQVNQRMKELLTAIRPDAVALVDAFDFQDVTLGSVLGRYDGNVYENLFEWAKKSPLNKSEVHESYCKYLKPLQSKL

SEQ ID NO: 708 - protein, 675 aa, Arabidopsis lyrata
MSEYRGLRRAHILANHILRSPSPSSNLSLTPEVCLQYSPPELNERYGFDVKEMRKLLDGHNLEDRDWFYGLMMQSNLFNRKERGGKGFVSPDYNQTMEQQRHISMKRILYLLENGVFQGWLTETGPEAELNKFALYEVCGIYDYSLSAKLGVHFLLWGNAVKFFGTKRHHEKWLKDTEDYLVKGCFAMTELGHGTNVRGIETVTTYDARTEEFVINTPCESAQKYWIGEAANHANHAIVISQLSINGTNQGVHVFIAQIRDQDGNICPNVRIADCGHKIGLNGVDNGRIWFDNLRIPRENLLNSVADVLSDGKYVSSIKDPDQRFGAFLAPLTSGRVTIASSAIYSAKLGLAVAIRYSLSRRAFSVAANGPEVLLLDYPSHQRRLLPLLAKTYAMSLAVNDLKMIYVKRTPESNKAIHVVSSGFKAVLTWHNMRTLQECREAVGGQGLKTENRVGHLKGEYDVQTTFEGDNNVLMQLVSKALFAEYVSCKKRNKPFKGLGLEHMNSPRPVLPTQLTSSTLRCSQFQKNVFCLRERDLLERFTCEIAELQGRGESREFSILLNHQLSEDLSKAFTEKAILQTVLDAEAKLPPGSVKEVLGLVRSMYALISLEEDPSLLRYGHLSRDNVGDVRREVCKLCGELRPHALALVASFGIPDAFLSPIAFNWVKANAWSSL

SEQ ID NO: 709 - protein, 675 aa, Arabidopsis lyrata
MSDNRALRRSHVLANHILQSTPLASNLSLTREVCLQYSPPELNENYGFDVKEMRKLLDGHNVVDRDWIYGLMMQSNLFNRKERGGKIFVSPDYNQTMEQQREITMKRIWYLLENGVFKGWLTETGPEAELRKLALLEVCGIYDHSVSIKVGVHFFLWGNAVKFFGTKRHHEKWLKNTEDYVVKGCFAMTELGHGSNVRGIETLTTYDPTTEEFVITTPCESAQKYWIGGAANHATHTIVFSQLHINGTNQGVHAFIAQIRDQDGNICPNIRIADCGHKIGLNGVDNGRIWFDNLRIPRENLLNAVADVSSDGKYVSSIKDPDQRFGAFMAPLTSGRVTIASSAIYSAKVGLAIAIRYSLSRRAFSVTANGPEVLLLDYPSHQRRLLPLLAKTYAMSFAANELKMIYVKRTPETNKAIHVVSSGFKAVLTWHNMHTLQECREAVGGQGVKTENLVGQLKGEFDVQTTFEGDNNVLMQQVSKALFAEYVSCKKRNKPFKGLGLEHLNSPRPVLPTQLTSSTLRCSQFQTNVFCLRERDLLERFTSEVAQLQGRGESREFSFLLSHQLAEDLGKAFTEKAILQTILDAEAKLPAGSVKDVLGLVRSMYALISLEEDPSLLRYGYLSQDNVGDVRREVSKLCGELRPHALALVTSFGIPDSFLSPIAFNWVEANAWSSV

SEQ ID NO: 710 - protein, 675 aa, Arabidopsis lyrata; identical to SEQ ID NO: 708

SEQ ID NO: 711 - protein, 675 aa, Arabidopsis lyrata; identical to SEQ ID NO: 709

SEQ ID NO: 712 - protein, 622 aa, Macaca mulatta
MILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNYRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIEAVLRNLCLLYSLYGISQNAGDFLQGNIMTESQIMQVNPRVKELLTLIRSDAVALVDAFDFQDVTLGSVLGRYDGNVYENLFEWAKNSPLNKTEVHESYKHLKSLQSKL

SEQ ID NO: 713 - protein, 660 aa, Macaca mulatta; identical to SEQ ID NO: 650

SEQ ID NO: 714 - protein, 660 aa, Macaca mulatta
MNPDLRRERDSASFNPELLTHILDGSPENTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLPSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNYRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIEAVLRNLCLLYSLYGISQNAGDFLQGNIMTESQIMQVNPRVKELLTLIRSDAVALVDAFDFQDVTLGSVLGRYDGNVYENLFEWAKNSPLNKTEVHESYKHLKSLQSKL

SEQ ID NO: 715 - protein, 662 aa, Callithrix jacchus
  MOD_RES (554)..(561): Any amino acid
MNPDLRRERDSASFNPELLTHILDGSPENTRRRREIENMILNDPDFQHEDLNFLSRSQRYEVAVRKSAIMVKKMREFGIADPDEIMWFKRLHLVNFVEPVSLNYSMFIPTLLNQGTTAQQEKWLPSSKGLQIIGTYAQTEMGHGTHLRGLETTATYDPKTQEFILNSPTVTSIKWWPGGLGKTSNHAIVLAQLITKGKCYGLHAFIVPIREIGTHKPLPGITVGDIGPKFGYDEMDNGYLKMDNYRIPRENMLMKYAQVCEADGTYVKPLSNKLTYGTMVFVRSVLVGEAARALSKACTIAIRYSTVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVSFTPTCTFEGENTVMMLQTARFLMKSYDQVHSGKLVCGMVSYLNDLPSQRIQPQQVAVWPTMVDINSPDSLTEAYKLRAARLVEIAAKNLQTEVIHRKSKEVAWNLTSVDLVRASEAHCHYVVVKLFSEKLLKIQDKVIQXXXXXXXXLYSLYGISQNTGDFLQGSIMTESQITQVNQRVKELLTLIRSDAVALVDAFDFQDVTLGSVLGRYDGNVYENLFEWAKNSPLNKAEVHESYYKHLKSLQSKL

SEQ ID NO: 716 - protein, 662 aa, Callithrix jacchus
  MOD_RES (554)..(561): Any amino acid
MNPDLRRERDSASFNPELLTHILDGSPENTRRRREIENMILNDPDFQHEDLNFLSRSQRYEVAVRKSAIMVKKMREFGIADPDEIMWFKSFVHRGRPEPLDLHLGMFLPTLLHQATAEQQERFFMPAWNLEIIGTYAQTEMGHGTHLRGLETTATYDPKTQEFILNSPTVTSIKWWPGGLGKTSNHAIVLAQLITKGKCYGLHAFIVPIREIGTHKPLPGITVGDIGPKFGYDEMDNGYLKMDNYRIPRENMLMKYAQVCEADGTYVKPLSNKLTYGTMVFVRSVLVGEAARALSKACTIAIRYSTVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVSFTPTCTFEGENTVMMLQTARFLMKSYDQVHSGKLVCGMVSYLNDLPSQRIQPQQVAVWPTMVDINSPDSLTEAYKLRAARLVEIAAKNLQTEVIHRKSKEVAWNLTSVDLVRASEAHCHYVVVKLFSEKLLKIQDKVIQXXXXXXXXLYSLYGISQNTGDFLQGSIMTESQITQVNQRVKELLTLIRSDAVALVDAFDFQDVTLGSVLGRYDGNVYENLFEWAKNSPLNKAEVHESYYKHLKSLQSKL

SEQ ID NO: 717 - protein, 644 aa, Oryctolagus cuniculus
MQTTEEVVRDFHYRGMKSQESLILNDPDFQHEDFNFLTRSQRYEVAVRKSATMVRKMREFGIADPEEIMWFKNFVHRGRPEPLDLHLGMFLPTLLHQATAEQQERFFMPAWNLEITGTYAQTEMGHGTHLRGLETTATYDPQTQEFIMNSPTVTSIKWWPGGLGKTSNHAIVLAQLITKGKCYGLHAFIVPIREIGTHKPLPGITVGDIGPKFGYEEMDNGYLKMDNYRIPRENMLMKYAQVKPDGTYVKPLSNKLTYGTMVFVRSFLVGEAARSLSKACTIAIRYSAVRHQSEIKPGEPEPQILDFQTQQYKLFPLLATAYAFQFVGAYMKETYHRINEGIGQGDLSELPELHALTAGLKAFTTWVTNAAIEECRMACGGHGYSHSSGLPNIYVTFTPSCTFEGENTVMMLQTARFLMKSYDQVHSGKLVGGMVSYLNDLPSQRIQPQQVAAWPTTVDINSPDSLTDAYKHRAARLVEIAAKNLQTEVSHRKSKEVAWNLTSVDLVRASEAHCHYVVVKLFSEKLLKIQDKSIQPVLKNLCLLYSLYGISQKAGDFLQGKIMTESQITQVNQRVKELLTLIRPNAVALVDAFDFQDVTLGSVLGRYDGNVYENLFEWAKKSPLNKAEVHESYYKHLKPLQSKL

SEQ ID NO: 718 - protein, 661 aa, Sus scrofa; identical to SEQ ID NO: 487

SEQ ID NO: 719 - protein, 675 aa, Arabidopsis thaliana; identical to SEQ ID NO: 103

SEQ ID NO: 720 - protein, 660 aa, Homo sapiens [sequence omitted]

SEQ ID NO: 721 - protein, 660 aa, Homo sapiens [sequence omitted]

SEQ ID NO: 722 - protein, 660 aa, Homo sapiens [sequence omitted]

SEQ ID NO: 723 - protein, 660 aa, Homo sapiens [sequence omitted]

SEQ ID NO: 724 - protein, 625 aa, Ricinus communis
MRKLLDMHNIEDRDWLFGLMRQSKVFNPVEKGGRVYAVPDYNQSTEQQREMTMKRIGYMLERGVFNGWLTGKGLESEMKKFAFLEVTGIFDHSLSVKLGVHFFLWGGAIQFFGTKRHHDKWLRNTETYALKGCFAMSELGHGSNVRGIETVATYDSNTGEFVINTPCESAQKYWIGGAANHATHTIVFSQLNINGTNQGVHAFIAQIRDTEGNICPNIRIADCGHKIGLNGVDNGRIWFDNMRIPRENLLNSVADVSPDGQYLSAIKDPDQRFAAFLAPLTSGRVTIAVSAIYSSKISLAIAIRYSLTRRAFSIRPNEPEVLLLDYPSHQRRLLPLLAKTYAMSFAGNSLKMIYWKRAPETNKTLHVISSAFKATMTWHNMRTLQECREACGGQGLKTENRVGNLKSEFDVQTTFEGDNNVLMQQVSKALFAEFIAAQKKKKPFKGLGLEHMNGPCLIIPSQLTSTILRSSQFQIGAFCLRERDLLNRFATEVSQHQAKGESKENAFMLGYQLAEDLGRAFSDRAILQTFIEAETSVSDGALKNVLGLLRSMYAMICLEEDAAFLRYGYLSTENAAAVRKEVMKLCNELRPHALALVSSFGIPDAFLSPIAFNWIDANSWSSVKL

SEQ ID NO: 725 - protein, 625 aa, Ricinus communis; identical to SEQ ID NO: 724

SEQ ID NO: 726 - protein, 661 aa, Mus musculus; identical to SEQ ID NO: 363

SEQ ID NO: 727 - protein, 661 aa, Mus musculus; identical to SEQ ID NO: 72

SEQ ID NO: 728 - protein, 661 aa, Mus musculus; identical to SEQ ID NO: 363

SEQ ID NO: 729 - protein, 661 aa, Mus musculus; identical to SEQ ID NO: 72

SEQ ID NO: 730 - protein, 684 aa, Zea mays; identical to SEQ ID NO: 583

SEQ ID NO: 731 - protein, 676 aa, Laccaria bicolor
MSAHDVNEQTGVDMLKARRSTTLALDTIRSFLHNGEDQWETRRKVTQILERDAVFDKARREFMSRTERYTRGMALTNRVYELQELHSWTQHETSIAIATLDEQLPISLHNVAFQPVFMLQASPPLLAKYSDLIATKGILGCYLQTELGHGTNVSRLETTATFIPETQEFEIHSPTTTSSKWWIGGLGKTATHGVVQAKLILPGGKDFGPHLFFVQLRSMHDHKVLPGIKIGDIGPKALGGFSPTDNGFAVFDHVRIPKEHMLSKFAQVTRDGEYVKPPHAKLSYGGMLYIRANMVTSGGWLMAKAATVAIRYATVRRQGEIGPDGLERQIITYPSVYYRILPILSHAYVFIRLGKTLTKAFDTLAGNLSRGDTSLLAEMHAITSGLKVVVSSTGVQDLEIARRSMGGHGYSAFAGLGRLYADYLPSVTYEGDNFVLDQQVVRAALKSYRSLFSESKESTTQSLLPSSRYLRLLIPPTRSLPSFTEDDFRSPTTSILLLEWRAALIVEKNARTVDDPDASINQRVAKAVTEAFIAAQIGEIINTLGSTGMTESEQIIVGKVYLLYLVTTVEAGLVDLLSFNILNSSGGSRDPTRSVRMTIKKLCTELLPEAIGLSDAFGFTDWELDSALGVYDGKVYEALWKCVQSEPLNQTEVPTAYEESIKPMLLRGQRQARPKL

SEQ ID NO: 732 - protein, 676 aa, Laccaria bicolor; identical to SEQ ID NO: 731

SEQ ID NO: 733 - protein, 685 aa, Oryza sativa
MDPSYPPSATARRAAAIARHLAGLSPRDAAAVAAALEPSACLSYAPPESSEPAPAFSPLELRSLLDGHHLRERDWAFRAMEESPLFCQRRSGGKVFVSPDYNEGKEGQREATMRRVGYLARRGVFRGWLTEPGPDAELRKLALLECLGMYDHSLAIKIGVHFFLWGSAIKFLGTKRHHDKWLSDTENYVIKGCFSMTELGHGSNVRGIETVATYDIKTREFVINTPCESAQKYWIGGAANHATHTIVFAQLHINGRNEGVHAFVAQIRDEHENVMPNIQIADCGHKIGLNGVDNGRIWFNNIRVPRENLLNLVADVLPDGQYVSTIDDPDQRFAAFLSPLTLGRVNIAVNAVYISKVGVAIAVRYALSRRAFSVTPDGPEMLLLDYPSHQRRLLPLLAKACLMSSAGNFMKRMYVKRTPELNKSIHIYSSALKATLTWQNMTTLQECREACGGQGLKTENRIGIFKAEFDVQSTFEGDNNVLMQQVSKALYAEFLTAKRKNQPFKGLGLEHLNGPCPVIPDYLTSGTLRSSSFQMDLLCLRERDLLKRFTTEVSNYLAQGENREKALMLSYQLAEDLARAFTERTILQIFLEDEKNIPTGSLKDILGLLRSLYVMVCIDESASFLRYGCLSRENVAAARKEVMTLCSELRPHALAIVSSFGIPDAFLSPLAFDWIEANARSSGNE

SEQ ID NO: 734 - protein, 661 aa, Rattus norvegicus; identical to SEQ ID NO: 341

SEQ ID NO: 735 - protein, 700 aa, Rattus norvegicus
MGSSSERRDSVLWSDIPKGPLSAYRARASFNSKELMLFWDGQDVLDFKKTIFSTLENDPLFARPFGADLPLEKERELNFLRCKRVFEYGFFNAEDMLKNPLKILVLMNCLGMYDWSLANKCVLHMLVFGSTIIGSGSEHHFKYLEKIYNLEIFGCFALTELSHGSNTKAMRTTAHYDPATQEFILHSPDFEAAKFWVGNLGKTATHAVVFAQLYTPDGQCRGLHSFLVQIRDPKTLLPMPGVMVGDMGKKLGQNGLDNGFAMFHKVRIPRQNLLDRTGNVTSEGTYNTPFKDVRQRLGASLGSLSSGRISIISISVVNLKLAVIIAIRFSATRRQFGPTDKEEIPVLEYPLQQWRLLPYLAAAYALDHFSKTIFLDLIELQRGRQSGDHSDRQAELGREIHALASAGKPLASWTAQRGIQECREACGGHGYLAMNRFGELRNDNDPNCTYEGDNNVLLQQTSNYLLSLLEHPLQDGAHFTSPLKTVNFLEAYPGILGQKFMASSKADWLDSEAPLAAYRWLVCYLLRESHQRYCQEKKSRGSDFEARNNSQVYGCRPLALAFMELTVMQRFHEHTHSSSVPPSLRTVLGRLSMLYGLWCLSQHTALLYRGGYISGEQTGKAMEDAILMLCVQLKDDAVALVDAIAPSDFVLGSPIGRADGELYKNLWAAVLQQSGVLERAAWWPEFTANKSVANRLKSQL

SEQ ID NO: 736 - protein, 700 aa, Rattus norvegicus; identical to SEQ ID NO: 735

SEQ ID NO: 737 - protein, 686 aa, Rattus norvegicus
MSRSRMGSPMHRVSLGDTWSWQVHPDIDSERHSPSFSVERLTNILDGGLPNTVLRRKVESIIQSDPVFNLKKLYFMTREELYEDAIQKRFHLEKLAWSLGWSEDGPERIYANRVLDGNVNLSLHGVAMNAIRSLGSDEQIAKWGQLCKNFQIITTYAQTELGHGTYLQGLETEATYDEARQEFVIHSPTMTSTKWWPGDLGWSVTHAVVLAQLTCLGVRHGMHAFIVPIRSLEDHTPLPGITVGDIGPKMGLEHIDNGFLQLNHVRVPRENMLSRFAEVLPDGTYQRLGTPQSNYLGMLVTRVQLLCKGILPSLQKACIIATRYSVIRHQSRLRPSDPEAKILEYQTQQQKLLPQLAVSYAFHFTATSLSEFFHSSYSAILKRDFSLLPELHALSTGMKATFADFCAQGAEICRRACGGHGYSKLSGLPTLVARATASCTYEGENTVLYLQVARFLMKSYLQAQASPGATPQKPLPQSVMYIATQRPARCSAQTAADFRCPDVYTTAWAYVSTRLIRDAAHRTQTLMKSGVDQHDAWNQTTVIHLQAAKAYCYFITVKNFKEAVEKLDKEPEIQRVLQRLCDLYALHGVLTNSGDFLHDGFLSGAQVDMAREAFLDLLPLIRKDAILLTDAFDFSDHCLNSALGCYDGHVYERLFEWAQKSPANTQENPAYKKYIRPLMLGWRHKM

SEQ ID NO: 738 - protein, 738 aa, Rattus norvegicus
MRYFGGAPRGGGGAWPIVWIGPIGKGQPRLWSCPRTELVLGTSQCSEQTLKEMSRSRMGSPMHRVSLGDTWSWQVHPDIDSERHSPSFSVERLTNILDGGLPNTVLRRKVESIIQSDPVFNLKKLYFMTREELYEDAIQKRFHLEKLAWSLGWSEDGPERIYANRVLDGNVNLSLHGVAMNAIRSLGSDEQIAKWGQLCKNFQIITTYAQTELGHGTYLQGLETEATYDEARQEFVIHSPTMTSTKWWPGDLGWSVTHAVVLAQLTCLGVRHGMHAFIVPIRSLEDHTPLPGITVGDIGPKMGLEHIDNGFLQLNHVRVPRENMLSRFAEVLPDGTYQRLGTPQSNYLGMLVTRVQLLCKGILPSLQKACIIATRYSVIRHQSRLRPSDPEAKILEYQTQQQKLLPQLAVSYAFHFTATSLSEFFHSSYSAILKRDFSLLPELHALSTGMKATFADFCAQGAEICRRACGGHGYSKLSGLPTLVARATASCTYEGENTVLYLQVARFLMKSYLQAQASPGATPQKPLPQSVMYIATQRPARCSAQTAADFRCPDVYTTAWAYVSTRLIRDAAHRTQTLMKSGVDQHDAWNQTTVIHLQAAKAYCYFITVKNFKEAVEKLDKEPEIQRVLQRLCDLYALHGVLTNSGDFLHDGFLSGAQVDMAREAFLDLLPLIRKDAILLTDAFDFSDHCLNSALGCYDGHVYERLFEWAQKSPANTQENPAYKKYIRPLMLGWRHKM

SEQ ID NO: 739 - protein, 711 aa, Mus musculus
ETGTKQVGDSTMGSLPEEKDSALWSDTPKGPLSAYRARASFNSGELLLFWDGQDVIHFKKTIFSTLENDPLFARSYGADLPLEKLRELNFLRCKRVFEYGFFKVEELLKNPLKILVLINCLGMYDWSLANKCVLHMLVFGTTVFVSGSEKHFKYLEKIYSLEIFGCFALTELSHGSNTKAMRTTAHYDPDTQEFILHSPDFEAAKFWVGNLGKTATHAVVFAQLYMPDGQCHGLHSFLVQIRDTKTLLPMTGVMVGDIGKKLGQNGLDNGFAMFNKVRIPRQNLLDRTGNITSEGTYNSPFKDVRQRLGASLGSLSSGRISIISMSVVNLKLAVSIAIRFSATRCQFGPTDKEEIPVLEYPLQQWRILPYLAAAYALDHFSKTIFMDLIEVQSARLRGDHSDQQAELGREIHALASAGKPLASWTAQRGIQECREACGGHGYLAMNRFGDLRNDNDPNCTYEGDNNVLLQQTSNYLLSLLEPPLQDGAHFTSPLKTVDFLEAYPGILGQKFLGSSKADWMDSAAPLAAYRWLVCYLLQESHRRYCQEKKSRGSDFEARNNSQVYGCRPLALAFMELTVMQRFHEHIHSSGLSPSLRTVLGRLSTLYGLWCLSQHMALLYRGGYISGEQTGRAMEDAILTLCEQLKDDAVALVDVIAPSDFVLNSPIAKADGELYKNLWAAVLQQNGVLERAAWWPEFSANKSVADRLKSQL

SEQ ID NO: 740 - protein, 708 aa, Mus musculus
ETGTKQVGDSTMGSLPEEKDSALWSDTPKGPLSAYRARASFNSGELLLFWDGQDVIHFKKTIFSTLENDPLFARSYGADLPLEKLRELNFLRCKRVFEYGFFKVEELLKNPLKILVLINCLGMYDWSLANKCVLHMLVFGTTVFVSGSEKHFKYLEKIYSLEIFGCFALTELSHGSNTKAMRTTAHYDPDTQEFILHSPDFEAAKFWVGNLGKTATHAVVFAQLYMPDGQCHGLHSFLVQIRDTKTLLPMTGVMVGDIGKKLGQNGLDNGFAMFNKVRIPRQNLLDRTGNITSEGTYNSPFKDVRQRLGASLGSLSSGRISIISMSVVNLKLAVSIAIRFSATRCQFGPTDKEEIPVLEYPLQQWRILPYLAAAYALDHFSKTIFMDLIEVQSARLRGDHSDQQAELGREIHALASAGKPLASWTAQRGIQECREACGGHGYLAMNRFGDLRNDNDPNCTYEGDNNVLLQQTSNYLLSLLEPPLQDGAHFTSPLKTVDFLEAYPGILGQKFLGSSKADWMDSAAPLAAYRWLVCYLLQESHRRYCQEKKSRGSDFEARNNSQVYGCRPLALAFMELTVMQRFHEHIHSSGLSPSLRTVLGRLSTLYGLWCLSQHMALLYRGGYISGEQTGRAMEDAILTLCEQLKDDAVALVDVIAPSDFVLNSPIAKADGEVDFSGICRQDLLGRTTTCRACCLQKELSTCSLVKNC

SEQ ID NO: 741 - protein, 700 aa, Mus musculus; identical to SEQ ID NO: 352

SEQ ID NO: 742 - protein, 661 aa, Mus musculus; identical to SEQ ID NO: 72

SEQ ID NO: 743 - protein, 661 aa, Mus musculus; identical to SEQ ID NO: 363

SEQ ID NO: 744 - protein, 744 aa, Mus musculus
AESVNTSTLRRRKECGQESEDWAYREEPAQPTALSQDRGSWYLPVLRADPKGSQVLPETGRSRMGNPGDRVSLGETWSREVHPDIDSERHSPSFSVERLTNILDGGIPNTELRRRVESLIQRDPVFNLKHLYFMTRDELYEDAVQKRFHLEKLAWSLGWSEDGPERIYADRVLAGYNNLNLHGIAMNAIRSLGSDEQIAKWGQLGKNFQIITTYAQTELGHGTYLQGLETEATYDATTQEFVIHSPTMTSIKWWPGDLGRTVTHAVVLAHLICLGARHGMHAFIVPIRSLEDHTPLPGITVGDIGPKMGFENIDNGFLRLNHVRVPRENMLSRFAEVLPDGTYQRLGTPQSNYLGMLVTRVQLLYKGFLPTLQKACTIAVRYAVIRHQSRLRPSDPEAKILEYQTQQQKLLPQLAVSYALHFMTTSLLQFFHSSYSDILKRDFSLLPELHALSTGMKAMSSDFCAQGTEICRRACGGHGYSKLSGLPTLVTQAIASCTYEGENTVLYLQVARFLMKSYLQAQVSPGSIPQKPLPQSVMYLATPRPARCPAQTAADFRCPEVYTTAWAYVSARLIRDATQHTQTLMRSGVDQYDAWNQTSVIHLQAAKAHCYFLTVRNFKEAVEKLDNEPEIQRVLQNLCDLYALNGILTNSGDFLHDGFLSGAQVDMARTAFLDLLPLIRKDAILLTDAFDFSDHCLNSALGCYDGHVYQRLFEWAQKSPANTQENPAYKKYIRPLMQSWKPKL

SEQ ID NO: 745 - protein, 731 aa, Mus musculus
QRCPRTEVSQEFSPRPARELTEHTKGSWYLPVLRADPKGSQVLPETGRSRMGNPGDRVSLGETWSREVHPDIDSERHSPSFSVERLTNILDGGIPNTELRRRVESLIQRDPVFNLKHLYFMTRDELYEDAVQKRFHLEKLAWSLGWSEDGPERIYADRVLAGYNNLNLHGIAMNAIRSLGSDEQIAKWGQLGKNFQIITTYAQTELGHGTYLQGLETEATYDATTQEFVIHSPTMTSIKWWPGDLGRTVTHAVVLAHLICLGARHGMHAFIVPIRSLEDHTPLPGITVGDIGPKMGFENIDNGFLRLNHVRVPRENMLSRFAEVLPDGTYQRLGTPQSNYLGMLVTRVQLLYKGFLPTLQKACTIAVRYAVIRHQSRLRPSDPEAKILEYQTQQQKLLPQLAVSYALHFMTTSLLQFFHSSYSDILKRDFSLLPELHALSTGMKAMSSDFCAQGTEICRRACGGHGYSKLSGLPTLVTQAIASCTYEGENTVLYLQVARFLMKSYLQAQVSPGSIPQKPLPQSVMYLATPRPARCPAQTAADFRCPEVYTTAWAYVSARLIRDATQHTQTLMRSGVDQYDAWNQTSVIHLQAAKAHCYFLTVRNFKEAVEKLDNEPEIQRVLQNLCDLYALNGILTNSGDFLHDGFLSGAQVDMARTAFLDLLPLIRKDAILLTDAFDFSDHCLNSALGCYDGHVYQRLFEWAQKSPANTQENPAYKKYIRPLMQSWKPKL

SEQ ID NO: 746 - protein, 675 aa, Mus musculus
MGNPGDRVSLGETWSREVHPDIDSERHSPSFSVERLTNILDGGIPNTELRRRVESLIQRDPVFNLKHLYFMTRDELYEDAVQKRFHLEKLAWSLGWSEDGPERIYADRVLAGYNNLNLHGIAMNAIRSLGSDEQIAKWGQLGKNFQIITTYAQTELGHGTYLQGLETEATYDATTQEFVIHSPTMTSIKWWPGDLGRTVTHAVVLAHLICLGARHGMHAFIVPIRSLEDHTPLPGITVGDIGPKMGFENIDNGFLRLNHVRVPRENMLSRFAEVLPDGTYQRLGTPQSNYLGMLVTRVQLLYKGFLPTLQKACTIAVRYAVIRHHDPEAKILEYQTQQQKLLPQLAVSYALHFMTTSLLQFFHSSYSDILKRDFSLLPELHALSTGMKAMSSDFCAQGTEICRRACGGHGYSKLSGLPTLVTQAIASCTYEGENTVLYLQVARFLMKSYLQAQVSPGSIPQKPLPQSVMYLATPRPARCPAQTAADFRCPEVYTTAWAYVSARLIRDATQHTQTLMRSGVDQYDAWNQTSVIHLQAAKAHCYFLTVRNFKEAVEKLDNEPEIQRVLQNLCDLYALNGILTNSGDFLHDGFLSGAQVDMARTAFLDLLPLIRKDAILLTDAFDFSDHCLNSALGCYDGHVYQRLFEWAQKSPANTQENPAYKKYIRPLMQSWKPKL

SEQ ID NO: 747 - protein, 714 aa, Strongylocentrotus purpuratus
MASNLEHSAGLAADTTEKSIFNILPDLPAGPLDIYRHKASFDWKQLKVAIEGEEALRFQYQVWKTMEEDPLFQHSQEPLTMAKARQVTFRQARRLFEYRFPESLSNNISANAWLLRVLIMYDMALFAKFNLNRIMFGETLRNSGSSRHETLAQQSQKLEAMGCFALTELSHGTNTKAMRTTAIYDPSTKEFVLNTPDFEATKVWVGILGKSATHTIVFAQLYTPDGQCHGLNSFVVAVRDPNTLLPMPGILVGDLGEKLGQNGLDNGFVAFHNVRIPRENMLNRLGDVTESGKFVTPIEDPKERFGASLAALSGGRVGITSIAVCNLRLAISIAVRYSAVRRQFGPTSDEELPVLEYQMQQWRLIPYIAASFVTFRLAENINLHYAKLARAVATGDKTINALELGKEMHVLSSASKPLGSWLARDCIQECREACGGHGYLWVNRFGILRNDNDPNCTYEGDNNVLLQQTSNYLLAMALRLQKGKKVASPLGSVDFLNSADAIAKQKFTASTSEDVKKPKVLLDAYRWLVVYLLQESGQKFQAQLMDGNDMFTARNETQVFFCRTLSLAFIESVALSHFLDFIKSGDLIPEQTAVLTKLCSLYGLWSLEKHMATLYQGGYISGPQPASLIRDSILELCRELKDEAVALVDVLAPPDFILNSPIGASDGQVSNSFNSVYKRLYNAILQTPKCLERPDWWKEFLDTPIVGSAPPAKL

SEQ ID NO: 748 - protein, 714 aa, Strongylocentrotus purpuratus; identical to SEQ ID NO: 747

SEQ ID NO: 749 - protein, 502 aa, Candida tropicalis
VYARLIVDGEDYGVKTFVVPLRDSNHDLMPGVTVGDIGAKMGRDGIDNGWIQFSNVRIPRFFMLQKFCKVSAEGEVTLPPLEQLSYSALLGGRVMMVLDSYRMLARMSTIALRYAIGRRQFKGDNVDPNDPNALETQLIDYPLHQKRLFPYLAAAYVVSAGALKVEHTIETTLAELDAAVEKNDTKAIFKSIDDMKSLFVDSGSLKSTATWLGAEAIDQCRQACGGHGHSSYNGFGKAYNDWVVQCTWEGDNNVLGMSVGKPIVKQVISIEDAGKTVRGSTAFLNQLKEYTGSNSSKVVLNTVADLDDIKTVIKAIEVAIIRLSQEAASIVKKESFDYVGAELVQLSKLKAHHYLLTEYIRRIDTFDQKELAPYLITLGKLYAATIVLDRFAGVFLTFNVASTEAITALASVQIPKLCAEVRPNVVAYTDSFQQSDMIVNSAIGRYDGDIYENYFDLVKLQNPPSKTKAPYSDALEAMLNRPTLDERERFEKSDETAAILSK

SEQ ID NO: 750 - protein, 709 aa, Candida tropicalis
MTFTKKNVSVSQGPDPRSSIQKERDSSKWNPQQMNYFLEGSVERSELMKALAQQMERDPILFTDGSYYDLTKDQQRELTAVKINRIARYREQESIDTFNKRLSLIGIFDPQVGTRIGVNLGLFLSCIRGNGTTSQLNYWANEKETADVKGIYGCFGMTELAHGSNVAGLETTATFDKESDEFVINTPHIGATKWWIGGAAHSATHCSVYARLIVDGQDYGVKTFVVPLRDSNHDLMPGVTVGDIGAKMGRDGIDNGWIQFSNVRIPRFFMLQKFCKVSAEGEVTLPPLEQLSYSALLGGRVMMVLDSYRMLARMSTIALRYAIGRRQFKGDNVDPNDPNALETQLIDYPLHQKRLFPYFVPPMSSPLVPSRLNTPSRPPWLNWTLPLKRTTPRLIFKSIDDMKSLFVDSGSLKSTATWLGAEAIDQCRQACGGHGHSSYNGFGKAYNDWVVQCTWEGDNNVLGMSVGKPIVKQVISIEDAGKTVRGSTAFLNQLKEYTGSNSSKVVLNTVADLDDIKTVIKAIEVAIIRLSQEAASIVKKESFDYVGAELVQLSKLKAHHYLLTEYIRRIDTFDQKELAPYLITLGKLYAATIVLDRFAGVFLTFNVASTEAITALASVQIPKLCAEVRPNVVAYTDSFQQSDMIVNSAIGRYDGDIYENYFDLVKLQNPPSKTKAPYSDALEAMLNRPTLDERERFQKSDETAAILSK

SEQ ID NO: 751 - protein, 675 aa, Anolis carolinensis
MKKRSLSQISPNSIMKDVNPDLDIERQNPSFDVERLTNILDGGAEKTQIRRTVETWIQNDPELSRENQYFQSQNERYEEGIRKSLYLAKKMDEMGWVEGGPHRDYCSRSLSSDLAFNVHQVFVKSILGLGTDEQIAKWVPLAQKFYIAGTYAQTELGHGTYLRGLETTATFDVATQEFILNTPTLSAMKWWPGDLGRTATHAVVFAQLYLNGKSYGMHPFLMQIRSLRDHSPLPGVTVGDIGPKMNFENVDNGFLVLKNVRVPRENMLARFSQVLPDGQCKKQGTDKINYLTMIVVRVAMIQREVVIILMKACTIAIRYSAVRRQSELKPGDPEAKILDYQTQQQKLLPQLATAYAFHFVSSYLQEVFDKAYTDTKEGKFDQLPELHALASGIKVIATEYSSSGVEVCRKACGGHGYSLLSGLPSLYTRLVASCTYEGENTVLLLQTARFLIKCFGMAKDGHPIPSSVAYLSSKNFGKCQAWKKGDFLNPDVYIDAYQQRAFRMLQNAAIKLQSLVQLGVAQHEAWNSCSVQLAWAAMAHIHYIVVEQFAKALQRYEREADVHRILKHLCDLFALHGMYLNTGDFMQDGYLSTEQVAMVTESYLDLLPVIRRDAVPLVDVFDFTDTSLNSALGSYDGRVYERLYEWAKKSPTNNQDKRVFETYLKPLFKNALSKL

SEQ ID NO: 752 - protein, 679 aa, Aspergillus oryzae
MTRKAPPALGKGLYKRRNSFVYSIFTRNNFQPAIRTVSRLSNMSDFTDHLRPSQPNGPEILARKRAQTHIPVDELAHHLLAQDGYLERQARILRIVEQEPLFDKKRQANLSREDLFKLALARAKLLRRLVDKHGWDIDDYKMAETLVDDVSPYYLHLHMFITTIREQASDAQQAYWLPLIESFKIIGAYAQTELGHGSNVQGLELQARWDPGSKEFILHSPTLTASKWWNGSLGRTANHAIVVAQLLVPSSGGEYQSHGPHPFIVQVRDMQTHQPRKGVVIGDIGPKFGYATIDNAYMLFHHFRIPHSALLSRYAKLDPDSGQFSKPAVPAVVYGTMTYVRSLIVLQSRMALARAVTIAVRYTTVRRQFRDRDDLKGPEVAVLEYPTAMQRTYREAREQIQAGDFSGLAHMHSLSSGLKSFCTDLVADGIETCRRALGGHGYGGASGFIRLSPDYLSRVTVEGDNWMITQQVAAYLIKRMHAAVANIDSATGNETEDLSFHRRTIALLYDIYVERVTKKRRWTSLMTQLHRLSHAQSLALLVEIFHDTLQNDRSLPPPAKNTLRDLYHLFAFFHMETHAYDFFRSGAVPQRDLDELPNRVRHLMARIEPHAVALVDAWKIPDYLLDSALGRFDGKVYEDLFHRAHRLNPLNEITFNPNYWEDELVKGDGGGWSSVLAKL

SEQ ID NO: 753 - protein, 694 aa, Aspergillus oryzae
MPSPPPAWVQALKPAGPQGSELLAQERAQSNVDVDKLAELLHTKKALDRQQQILSILESDKVFDKSENYTLGRTEKIQRALAKAKRLQQLAVQHKWSQDDYYMANELLSEPTPYGLHASMFLVTLREQTTPEQKKLFLEPASKYEIIGCYAQTELGHGSNVRGLETTATWNPDDKTFTIHSPTLTASKWWIGSLGRTANHAVVMAQLFIGGKNYGPHPFVVQIRDLQTHQPLENIYVGDIGPKFGYNTMDNGFLLFNKVKIPHVNMLARFSSVDKETNKYLRPASHSLLYGTMTWVRSNIVLQAGSVLARGVTIATRYCAVRRQFQDRDGGKDAGENQVLNYKMVQIRLLPLLASMYALHFTGRGMMRLYEENQKRMKGAVEAGQDKRGAGPEQLRAGADLLADLHATSCGLKALASTTAGEGLEICRRACGGHGYSNYSGIGPWYADYLPTLTWEGDNYMLTQQVARYLLKSARAVLAGKGTNNDTSQILQTYLSRREKGASFDILEEDKDIVAAFAWRTAHLTFEALKRRDVEKRSWNSLLVDFWRLSTAHSQYLVVKNFYEAVTSPQLTSELDPETVTLMHKLFRLYSLHTLEREAGEFFSSSAVTTRQISLAQSNAVMKLLDEIRPHAVRLVDAWKFPDWQLDSSLGRYDGEVYPDLFRRASQNPVNDLVFDPYPWNENVLKNSAPKSKL

SEQ ID NO: 754 - protein, 692 aa, Arthrobacter globiformis
MTEVADRQGAATHAAAAGTAEPLPAVDVAALGELLLGKWAEVRRQARDLAARDELHKTEGLTHTEHRARTFGQLKLLVDSGAVHRAFPASFGGSDDHGGNIAGFEELVTADPSLQIKAGVQWGLFGSAVMHLGTAEHHEKWLPGIMNLDIPGCFAMTETGHGSDVASIATTATYDPDAQEFVIHTPFRAAWKDYIGNAAIDGLGAVVFAQLVTRGVNHGVHAFYVDLRDPVSKAFLPGIGGEDDGLKGGLNGIDNGRLHFDHVRVPRANLLNRYGNVDAAGNYTSPIASPGRRFFTMLGTLVQGRVSLDGAAVAASKIALKTAITYATERRQFNASSPVEEEVLLDYQRHQRRLFTRLATTYAAGFAHDQLLEKLDDVFSGVHDSDEDRQDLETLAAALKPLSTWHALDTLQECREACGGAGFLIENRFASLRADLDVYVTFEGDNTVLLQLVAKRLLADYAKEFRSATFGVLARYVVNQAAGTAVHRTGLRQVAQFVADNGSVQKAAIALRDEESQRALLTDRVQTMVAEAATALRGANRLPQREASALFNQHQDELIDAARAHAELLQWEAFTEALGRVADPGTRTVLTWLRDLFGLSLIENNLSWYLMNGRLSMQRARTVGGYINRLLVKLRPHALDLVDAFGYGPAHLRAAIATGAEKVRQDEARDYYRVQRASGTAPVPEKSLPPRG

SEQ ID NO: 755 - protein, 671 aa, Pediculus humanus
MSNNKTEYRGKKTINPDLIRERENCTFDPIQITYILDEDPKKTEERRKMEDWFLKDPRFQEVIPSEYLSHKEKYEEAVRKACLIFKKLEEMDAAFDSYSQVLGQLGSAVLKDGNPFTLHYVMFIPTILGQGTLQQQAHWVGRAWNKEIIGTYAQTELGHGTFIRGLETTAHYDEKKKEFVLNSPTLTSYKWWPGGLGQTANYAVVVAQLYTKNECHGIHPFIVQLRHEKTHKPMPGIKIGEIGTKLGMNSTNNGYLGFDHVRIPRENMLMKNSKVLEDGTYVKAPSSKLTYGTMMFVRVVLVKDAASMLGKAVTIATRYSAVRRQSELKPGEPEPQILDYRAQQFKLFPNIATVFCFRAAASWLWQMYNNVTAELEGGDLDRLPELHSIACCMKAVCTSDAAKGIETVRMACGGHGYMTCSNLPLLYGLCTAMCTYEGENTVLLLQTARYLVKQFQGARSGGKLTPTLEYIRTVENQGTTVRRWDQTMESILLGFKEVSVGKLKTAVENLEKRQNDGIPQEDAWNMSHLELTGCAEAHCRAFLVSKFYESVEKLNPSSEVKSVLRQLSELYALYWILEKLGDFLRFSSLESSQVGTIQKRLEDLLAQIRPNAVGIVDGFDYCDEVLNSALGSYDGRVYERLFEEASKSPLNKQQVNGSFSKYVKPLLKSKM

SEQ ID NO: 756 - protein, 649 aa, Mycobacterium abscessus; identical to SEQ ID NO: 605

SEQ ID NO: 757 - protein, 664 aa, Megachile rotundata
MSVNKDLQYERRRCTFNPTELTHFWDGSQLKTEQRHEREQFFLNDPELVDKVPIKYKSHKEVYEDAIRKSCRVLQKIRELQEMGKGGIDMFSHVLGAMIGSGIIREGNPLVLHYVMFIPAIMGQGTIKQQVHWLSKSWGGSIIGTYAQTELGHGTFIRGLETTATYDPQTQEFILNSPTLTSYKWWPGGLGHTANHAIVVAQLYIKGDCKGVHAFVVQLRDENTHEPLPGIKIGEIGTKLGMNATNNGFLGFDNVRIPREHMLMKNCQVLEDGTYVKSLNDKLTYGTMVFVRVVLVHDIVHYLLKAVVIATRYSAVRRQGQINADKPEVQIIDYVTQQYKIFPHLAACFAYRMSADAIWNMYNVVTGELDKGDMNKLPELHALACCIKAVASADAANGVEQLRLACGGHGYMDASNLPNLYGLVTAICTYEGENTVLLLQTARYLVKVWKQACSGQSLPESMQYLTAYTKGIKQAPWKNTLQCIVTAYQAVVAGKIRSAAENIHLRISKGVHLEDAWNQTGIELAQCADAYCRAFVVEKFIEGVQKTVVSKKLHLVLSQLCELYAVYWILQKRGDFLQFSSLKNENIPQLQSRLEELLAAIRPNAIGIVDGFDVRDELLNSALGAYDGDVYTRLFAEAMKSPLNQQSVNESFEKYLKPFLKSNL

SEQ ID NO: 758 - protein, 661 aa, Actinoplanes missouriensis
MNGQQNAVDPVRLQQVLDGRWAHVRQAVRDGLGADFVTIPGETGDEARTRVSALIRKIPTGVGVVDAFPAEYGGSGDPGGSVVAAEMLAQVDLSLMVKAGVHWGLFGGAVVALGTKRHHDEFLRDIISVELPGCFAMTETGHGSDVQQLRTTCTYDPASGSFDLHTPHQAARKDYIGNAARDGRMAVVFAQLITGGKRYGVHAWLVPIRDEHGRPMPGVTIEDAGAKAGLLGVDNGRISFDHVTVPRDMLLDRYGQVAEDGAYTSSIENDTRRFFTMLGTLVRGRVTVGGSALAATKSALTIAVRYGDARRQFTRPGDDREVLLNDYLAHQRKLLPALAYTYAYTFAQEELVATLADVQSGAEVEEHRQRELESRAAGLKAMQTWHATRTIQMCREACGGAGYLAENRLPGLKADTDVFTTFEGDNTVLLQLVAKGLLTGYRDAFGSLDGWGRATFVAEQVREMVLERTAARSVIQRLVSAVPGRDEDVAVTDRGWHLEMFEFREKHLLEGAIRRLRGGATAKKDRPFDIFNDVQDHVLQAATAHIERVTLEAFVAGIERAADPAAAALLSRVCDLYALSVIEGDKGWFLEHGRLTPARSKAVTGVVNDLLRELRPQMRTLVDAFAVPDTWLNAAILREEPARQDATAAEDAAVPSVPAGA

SEQ ID NO: 759 - protein, 653 aa, Streptomyces albus
MVTDEAPTEASGYVQPEIDVPALAALLDGEYAEIRELVRSNLKTYASILEEADELSLDAYRERVRELVVEMAATGQTGMGFPREYGGGGDVGASIAAFETLAFGDLSVLVKVGVQFGLFGGAILQLGTERHHDAYLPDLITGKLMGCFAMTETGHGSNVQALGTVARYDARSQEFVLTTPGEEARKDYIGNAARHGEVAVVFAQLEVDGTSEGVHAFVVPIRAGGEPAPGVRIEDDGRKMGLNGVDNGRLHFDGVRIPREALLNRFADVTPEGVYESPIDNPNRRFFTMLGTLVQGRVSVGGAAVNAAKVALTVATRYATRRRQFEPAPGEREQLLLDYGLHQRRLLPLIARTYALHFAQDVVRTRLHEVFSGIETDAQARRELEARAAGTKALTTWHATRTIQECREACGGAGYLSVNRFAALKSDSDIFTTFEGDNHVLLQLVAKGLLTDYASEFEDLDQLGTVRHVTGLAVETLLEKTSAHKLLERVRDLLPGGDEWDQEAGLLDSEYQLAMVRYREEHMLAGVARRLKSGVDQKRDPGAVFSQVQDHVIALAHAHVERLVLEAFVAKVRELPEGGEKVALGLLCDLFALSTIEADRAWFMEHGRLTVQRSKAITREVNDLCRKIRPLALDLVDAWGVPPELLRAPELVG

SEQ ID NO: 760 - protein, 649 aa, Mycobacterium abscessus; identical to SEQ ID NO: 605

SEQ ID NO: 761 - protein, 696 aa, Renibacterium salmoninarum
MTETTTRDDLAGSTESSEARIDTAELGELLLGKWAHIRKIAREAAKDSRAFKVEGLTHFEHRARAFNQLKLLVDLKAVHRAFPKRLGGDEDHGGNVAGFEEMVTADPSLQIKAGVQWGLFGSAVMHLGNTEHQDKWLPGIMSLEVPGCFAMTETGHGSDVASIATTATYDEATDEFVIHTPFRAAWKDYIGNAAVDGLAAVVFAQLITKSVSHGVHAFYVQLRDPVTHQFMPGVCGEDDGIKGGLNGIDNGRLHFDQVRVPRTNLLNRYGNVDEDGEYTSSIASPGRRFFTMIGTLVQGRVSLDGASVAASKVALQIAITYAAQRRQFNATSDIEEEVLLDYQRHQRRLFSRLATTYAASFAHEELLQKFDDVFSGAHDTDEDRQDLETLAAGLKSLSTWHALDTLQECREACGGAGFLVENRFTSLRADLDIYATFEGDNTILLQLVAKRLLTDYAKEFRNVDFGVMARYAFGQAADVAINKTGLRQVAQFVADTGSVQRSATALKDEESQRALLNERVQGMVAEVGGVLKDAARLPKAKAAAVFNQHQDELVEAARAHAELLQWEAFTAGIKKIEGPKTKEVLTWLRDLFGLGLIEKHLSWYLMNGRISMQRGRTVGEYINRLLAKIRPHALDLVESFGYTQEHLRAPISSGQEKVRQDEAAEYFRVQRASGGSPIDEKVLLLKERQAAKAAKK

SEQ ID NO: 762 - protein, 786 aa, Salinibacter ruber
MRSGSRRPLFVSRIHSASMLDTDSPRVRAVLPLLYVAWADGVLTPSEAETIRGHLRTQEWLDASTREAICDHLDPQSPPTPTQYFRWIRTLRDGAGDAAVTTRSSLAELGMALANVGGDGTALPEASRRALEDIEAALNIDGEEVVRDLLGERPEPSPVEPEAPFDTDAMRRLLDGPHAELREDIRTLLQDPVFEYQDGLGTEAYREQVLRWCEHLADQGLGALAYPDAYGGGGDMEKFIVAFETLAYHDLSLVVKFGVQFGLFGGSIHHLGTERHHEEYLDRVGTLDLPGCFAMTEWGHGSNVRELETTARYDPTTEEFVINTPHDGARKEWIGNAAAHGQVATVFAQLRTDGEEHGVHAFLVPIRADDGTPKPRVRIEDCGEKVGLNGVDNGRLWFDQVRIPRANLLDRYAQVAPDGTYDSPIPSSGKRFFTMLSTLIGGRISVARAGLSATKSGLTIAVRYGNRRRQFGPKDEPEVPLLDYRTHKRRLLPRLATTYALHFALDDLTARFARKGRGESLEAIEAEANALKAYATWHTSATLQEAREACGGQGYRADTRIGRLRADTDVFTTFEGDNTVLMLQVAKGLLSDFQREFRDMNLWGMARLVADEVATQVQELNPVVTRTTDPDHLRALPFQQSALTYRAEKQLQNVGRRLQRRIDDGMEPFDAFVDVQDHLVQCARADAERVILERFADAVEGVEDADLRETLTTLRRLFALSRIEADLDWFLEAGYVSGSKAKAIRGAVNDLCDEVRPQAEALVNAFGIPDALLGAPIATKPGPGPK

SEQ ID NO: 763 - protein, 724 aa, Candida orthopsilosis
MAMANFPPSLQTNKNKQDPDTKAKIVKDVISSQPAPNPAEDIAKERARTNWNLKEVHEFLEGNEAKSTEILRLYQSIERDPILQTRPEHFDITQKQERELVAQRIDKMARFIEIEPYAKFRRRLQLMTVIDPSMGIRILVNLGLFLNCIRGNGTQKQYDFWAKKKESGIIKQMYGCFGMTELGHGSNVAGCETTATFDPETDEFIIDTPHIGATKWWIGGAAHSATHTVCYARLIIKDVDYGVKTFVVPLRDSQHNLLPGIAVGDIGAKMGRQGVDNGWIQFTEVRIPRFFMLQRWCKVDRKGNVTLPPLEQLSYISLLEGRVGMAADSYRIGARFTTIALRYAVGRRQFNKTGGPQETQLIDYTLHQRRLFPYLALTYAAAVGTDRLEVEHNELLENLDRGLKTNDKLLLKNTIASTKSMFVDSGSLKSTLTWEASNLIDECRQACGGHGYSAYNAFGKTYNDWAVQCTWEGDNNVLAMSAGKSIIKTVQQILNGKKVKNSTLEFLNDAPELAKAKKAVIRVKDHVDDPQRVLKAIASLISKTSMDLIPQSYQSWDAIGAQRVILSKLRCHYYLLETFIDRLESQIKANSPARPHLENILKLYYVTNILGPFIGEFLRYGVISPNVAKYITNVYPQGLCWKVRPYVIGLTDSFQQPDNFIHSLIGKYNGDIYHNYLAEVKSVNDPRNPKAPYSVALEDMLNRASLDERQRGERSEEAAAILSK

SEQ ID NO: 764 - protein, 711 aa, Candida orthopsilosis
MSVPFTAKNVSLSKGPDPKTSLQTERDAQKFNPQAMQYFLEGSKERAELIKALTQQMERDPILWTDGSYYDMSKEQLREFTAVKINRISRYLEGDSIDVFNRRLSLVGVFDPAVGTRIGVNLGLFISCIRGNGTYDQLKYWALDKHTAHIRGIYGCFGMTELAHGSNVMGLETTATFDKANDEFIINTPHIGATKWWIGGAAHSATHCTVYARLIVDGEDYGVKTFVVPLRDSNHDLMPGITVGDIGAKMGRDGIDNGWIQFSSVRIPRFFMLQKFCKVSREGEVILPPLEQLSYSALLGGRVMMVLDSYRMLARVSTIALRYAIGRRQFKGDNVDQDDEEALETQLLDYPLHQKRLFPYLAAAYVVSAGALKVERTIEETLLLLDDAVDEGDEAGIMKSIDAMKSLFIDSGSLKSTCTWLAAEGIDQCRQACGGHGYSGYNGFGRAYNDWVVQCTWEGDNNVLGINIGKPLVKHILAIEDDGKVVKGSSDFLNQLKEYTGSEASKVVLDNANDITDLKTFIKSLEVAIIRLSYETGKTVRKENFDFVGAELVNISKLKAHHYLLSEYARRVDTHDDESLKPYLYDLGRVYAATVVLDKFAGIFLTFNVASTNAITDLAKVVIPKLCKQVRPNVVGLTDSFQMSDMMINAAIGRYDGDIYENYFDLVKTLNPPAKHKAPYSEALEAMLNRPSIDERERFEKTIETGEILSK

SEQ ID NO: 765 - protein, 664 aa, Apis florea
MTVNKDLEYERSKCTFQPIELTYFFDGGPEKTIERREREKYFLSDPELQNNILVKYKNHKEIYEDAVRRVCRLLHKLRKLQETGKAGMEDFTHIFGARLGSAILKDGNPLVLHYAMFLPSIMGQGTTKQQEYWITRSWNGDVIGTYAQTELGHGTFIRGLETTAIYDPKTKEFILNSPTLTSYKWWPGGLGHTANHAIVVAQLYTQGECKGIHPFIVQLRDVNTHQPLPGIKIGEIGTKLGMNATNNGFLGFENFRIPRENMLMKNSKVLEDGTYVKALNDKLTYGTMVFVRVVLVHDIVIYLSKAVTISVRYSAVRRQGQINLEKPEVQILDYVTQQYKIFPHLATCFAFKITANWIWEMYNVINVEMDHGELDRLPELHALSCCLKAVASADAAAGVEQVRLSCGGHGYMDASNLPATYGLVTAICTYEGENTVLLLQTARYLVKVWKQAVNGKKLPVTVQYLSNATKNIQRPWSNNLDYIAEAYHTVAAGIIRIATENMDRRIHNGISAEDAWNQTSIELAYCAEAHCRAFIVKTFVENIKEIRSISDQLKQVLFQLCELYVIYWVLQKRGDFFQFCSMKQNDVQILQSRLEELLMAIRPNAVGIVDSFDICDEILNSALGAYDGNVYERLYTEAMKSPLNHESVNESFEKYLKPFLKSNL

SEQ ID NO: 766 - protein, 709 aa, Spathaspora passalidarum
MAIATNTVNISQGPDPKTSIQNERANSKFDPVKMHYFLEGSKERAEELKSLMQQMERDPVLFTDASYYDLTKDQQRALTAVKINRVSRYLEGDSIDTFNKRLSLIGLFDPQVATRIGVNLGLFISCVRGNGTYEQLKYWALDKETAHIKGIYGCFGMTELAHGSNVSGLETTATFDKDTDEFVINTPHIGATKWWIGGAAHSATHTTCYARLIVDGEDYGVKTFVVPLRDSNHDLMPGISVGDIGSKMGRDGIDNGWIQFSNVRIPRFFMLQKFCKVSREGKVILPPLEQLSYSALLGGRVMMVLDSYRMIARMSTIALRYAIGRRQFKGDNVDPDDENALETQLLDYPLHQKRLLPYLAAAYVFATGAVRIEQTIDETLSDLDDAVDQNDDEAIMKSIDAMKSLFIDSGSLKSTCTWLAAEAIDQCRQACGGHGYSAYSGFGKAYNDFVVQCTWEGDNNILGVNIGKPLVKHVLAIEDDGKVVKGSSSFLNNLKQYTGSNATNVILDNVADLNDLKKVAKAVEIAIIRLAHQAATTARKNSLDYVGAELVTLSKLKAHHYLLNEYVVRLERFEEKDLIPYLVSLGRLYAATMVLERFAGIFLTFNVVSPSVMAALTSNQIPQLCKEVRPHVVALTDSFQQSDMLVNSVLGKYDGDIYENYFGTVKTLNKPSNTKAPYSGALEAMLNRPSIEERERFEKTVETGEILSR

SEQ ID NO: 767 - protein, 704 aa, Kocuria rhizophila
MSTTTVSGTIPDTDRIEDLPEDGATAPSTIDTAELGRILLGRWPEARLAARKRAEDPRFQSQYDQSFADQRNVTFEQLKLLADAGPQYLGMPESVGGAMSPGANLSAFEELVLADPSLQIKSGVQWGLFGSAVLNLGTEEHHKKWLPSILDLSMPGAFAMTEIGHGSDVASIGTTATYIPETDEFEIHTPFKAAWKDYLGNAAVHGRAATVFAQLIVDGMNHGVHCLYVPLRDENGEFLPGVGGEDDGRKGGLNGIDNGRLHFDHVRVPRTNLLNKYGDVDENGVYSSPIPSPGRRFFTMIGTLVQGRVSLDGAATIANQAALSIAVRYAEQRRQFTTDSDIQEQTLLDYQRHQRRLIPRIAETYAMTFAHQQLLDKFHEVFSGEDESDGNRQELETLAAAFKPMSTWSALDTLQECREACGGAGFMAKNRFVQLRADLDVYVTFEGDNTILLQLVAKRLLNDYSAEFKNADVGVMARYVADRATEAGFNRSGLRKLTQAFSDTGDSRKSVNALRDPAAQRALLTDRVQTMIGDIADELRAVSRKSRTEQAKAFNDNQNRLLEAARSHAQLLQWEAFTAGLEKVEDPDTKRVLTWLRDLFGLHLIEQDLAWYLSYGRLSMRRGRALESYINRLIARLRPYSLELVDAFGLSPELLRAEIGGTVEAERQEEAADYYRRLRASGKAPVKEPKPAKDPGAQTRGHHG

SEQ ID NO: 768 - protein, 681 aa, Homo sapiens; identical to SEQ ID NO: 342

SEQ ID NO: 769 - protein, 724 aa, Gordonia sputi
MRAPPPEGGGKQLRPERIARHMGSSLRVSPPVSDLIRNVELMSTPTESPSTPATDDDPSIDTAGADSSELSDAERDLLVDNLRYVLDGRWRATRDEVRRRANRADLLPDPSRTLEQARARILDEMRELSEEGFAAAGFGADHGGTGDVGASITAIEMLGYADLSLMVKAGVQWGLWGGAVENLGTARHHEKYVADTISLDLLGCFAMTETGHGSNVQELETTATYDATTKEFVIHSPTPSARKDYIGGAAEHARMASVFAQLITAGPGQEPESYGVHCFVVPIRDADGNDLPGVTTSDCGYKGGLPGVDNGRIMFDEVRIPKDNLLNRYADVEDDGTYSSPIDNPNRRFFTMLGTLIRGRITVAATAGAASRKALAIATRYGLVRRQFDAPGDEEEIVILDYLGHQRKLLPLIAKSYAIAFAQNELTEELHEVQSDTPTESPDGSSDDSKAGRQRELEANAAGLKAYATWHASHAINVAREACGGAGYLDENQISIIRGDIDVFTTFEGDNTVLTQLIAKEVLSAYADDVQGLSAGGWVRFIASMARDVVVEKTAARQVVQTLLESSDEDTEKSALTDRGTQLRLFRNREDHLVRTCAQRLRRETNDDNDAFEVFNNAQDHLLKVGQARTERIVLEAFVQAINDCDSRAAAEVLGKVCDLFVYSALEADLGWFMMHRHISVERAKAIRRGVNELCQDLRPYAATLVDAFGIPEELMGAPMIENH

SEQ ID NO: 770 - protein, 724 aa, Gordonia sputi; identical to SEQ ID NO: 769

SEQ ID NO: 771 - protein, 694 aa, Aspergillus kawachii
MPSSPPDWVKALKPADPQGSQLLQHERDQSNVAVDKLAELLHTKEALVRQEHLLSILQAEKVFDKSQNHTQGRTERIQRSLAKAKRLQQLSVEHKWSQEELHAANELLGEPTPYGLHASMFLVTLREQGTPEQHKLFLEPAQNYQILGCYAQTELGHGSNVRGLETTATWNPEDKTFTIHSPTLTASKWWIGSLGRTANHAVVMAQLFIGGKNYGPHPFVVQIRDMNTHQPLENVYVGDIGPKFGYNTMDNGFLLFNKVKIPHINMLARFSRINKDTNEYMRPASPSLIYGTLTWVRSNIVLQAGGVLARGVTIATRYCAVRRQFQDRDATGNVGENQVLNYKMVQVRLLPLLASMYALHFTGRGMMRLYQENQNRMKAAAQAAQEKRGAGPEELRAGADLLADLHATSCGLKALASTTAGEGLEVCRRACGGHGYSSYSGIGPWYSDYLPTLTWEGDNYMLTQQVARYLLKSARAVLAGKASNNDTSRILQAYLSRRDKGASFDILGNDSDIVAAFAWRTAHLTFEALKHRDAEKRSWNSLLVDFWRLSTAHSQYLVVKNFYEAVTSPQVTGALDPETAGILHKLFRLYALHTLEREASEFFSSSAVTVRQIGLTQTNAVMKLLDEIRPHAVRLVDSWKIPDWQLDSSLGKYDGEVYPDLFRRASQENPVNDLVFDPYPWNAAVLKNERPSKL

SEQ ID NO: 772 - protein, 760 aa, Robiginitalea biformata
MQTYSYSQGIYPYLPVFYVIWSDDLLSASEIAVVKKAIAADPGLSHEERNRLLGWLDRDSPPDAEEFRHWNHLIVRSGVTYREDADYPLSEFAAAFAESQAPGGSPHPVLRDIEVNLGIQPNHYRHLFGQNAVPVAVASEFQGEVLAEMGLRPHYPDYLTCREFLQAPVFEQHLERDKEAHRQRVLQQLKRLAAEGYGALAYPPEYGGKNDMPAYATLFENLMFIDGSLCVKFGVQFGLFGGSIQKLGTKRHWEAYLKDAGTAKLLGCFAMTETRHGSNVRGIRTTATYVKESDELVVHTPGPDDNKEYIGNALHAQMATVFAQLIVDGENQGVHAVLVPMRDGSGELLPGIRVEDNGYKMGLNGVDNGKIWFNQVRVPRGNLLDRYGSITESGSYHSDIKNPNKRFFTMLGTLVGGRICVARGALAGARFGLSIAVRYALRRRQFNDAARVQEDLIMDYPSHQVRLLPAVASSYVYQAALTRLLKSYDGADGTDTRQLEAGVAGLKALVTEFADRTLQECREACGGKGYLLENRIGQLKNDVDIFTTFEGDNTVLLQLAAKSRLTDFRAEFNSDDFFGVLRLLGTQIGKRLSAINPAYTNKTDREHLYNPAFHLHALTYRTDRLTYTLALRIRDYIKKGVPAYQAFLKVQTHLLALGRAYAALLAFELFLEHTEDLSDDPHADLIRKLGTLHALSEIRADAAWYLEQGYIGKRKSKAIRSRVERLCTELRPHARALVDGFGIPPTRLSEVPIADQSGSL

SEQ ID NO: 773 - protein, 768 aa, Salinibacter ruber; identical to SEQ ID NO: 334

SEQ ID NO: 774 - protein, 696 aa, Renibacterium salmoninarum; identical to SEQ ID NO: 761

SEQ ID NO: 775 - protein, 701 aa, Arthrobacter aurescens; identical to SEQ ID NO: 186

SEQ ID NO: 776 - protein, 649 aa, Mycobacterium massiliense; identical to SEQ ID NO: 615

SEQ ID NO: 777 - protein, 606 aa, Kitasatospora setae
MSITPLSTSPLDPAALAEALFRDGPDGDYPHQHWRKVVADELFRHDPAARTADRHRHAYDRLRAVNGQLPSPADWFAADPRALAALHEWLALVDGAAATVAGIHYNLFLGSLLDDRVSPPRDLAPYTALERIGTFLCTERAHGNDAAALETTARYDRERDGFVLHTPHPGAAKYMPNTSPAGGPKSAVVAARLLVDDTDHGVFLFLVPLSDERGTRPGITVTALPERIGSPVDHCVTAFDRVRLPRTALLQGPHGRLRPDGTLDSAVGSPRKRFLHAIRRVTAGKLCMSASTLGGCRAALATAVRYAHLRHVSGPVAGQRVPLAAHRSHHARLLACVAAAYAMTFLHRAATERWITHHPAERPAAERLVAVAKGWITWRARDIVTESRERCGARGLFPVNGLAEYAANVDGAITAEGDNLAIWCKAGAEMIFGHDLAAQPPLATGRESTTDPAFLRRALTAAELHWHLAARQDLRATGDGDGSGSGSGAGDGLGRWNHASDAALALVEAHTVGLAADAFAAARAGTADPAARDALAALEALFLLGEVEARGGLLLARGALTAAQVTALPRARRELTARLAPHLPALTDAFGIPEEHLAALPMLAGA

SEQ ID NO: 778 - protein, 649 aa, Mycobacterium abscessus
METRTAPADPEVLTSNLRVALDGRFGPIRDAAREYLNRADLLPDPSLTLEQARARSLRIMRELVPHGLPHAGFRTEHGGTGDVGAAIVGIEMLGYADLSLMVKAGVQWGLFGGAIENLGTAAHHEQYVVPLINLDVLGCFGMTETGHGSNVQALQTVATYDRTTGDFVLNSEGSLARKDYIGGAAEHATVSAVFAQLVTGGPGEEATGRGVHCFVVPIRDTDGNDLPGITTSDCGYKGGLAGVDNGRIVFDNVRVPRANLLNRYADVAEDGTYSSPIENENKRFFTMLGTLIRGRVSVAATSGAAARKALTIASRYALVRKQFDTPDSDDEVIIADYLVHQRKLLPLIARSYALAFAQNELTEELHEVQTADEVDADRQRQLESAAAGLKAMTSWHAQHAITVCREACGGAGYLDANQLTILRRDIDVFTTFEGDNTVLTQLVAKELLSAYAEDVRGLNAVGWTRFIAGMARDVILERSAARQVIQTILDSSDEDVEESDLSNRGTQLRLLRNREDHLLRTAATRMQRAQSDDEDPFEVFNSAQDHILKVGSAHTERVVLEAFIEAIDSCDSKSAQELLEKLCDLFVYSALEADLSWFLMHRHVSTERAKAIRRGVNQLCEELRPHLGTLVDAFGIPEALLATEMIPDN

SEQ ID NO: 779 - protein, 649 aa, Mycobacterium massiliense; identical to SEQ ID NO: 615

SEQ ID NO: 780 - protein, 470 aa, Glarea lozoyensis
MSPPQWVKDLKPAPPQGSDLIQAEREKSKLSVDKLSNFLFTKQVIERQERILKILQSEKVFDKSQNYFDGRIDKFKTALARAKRLRQLQVKHNWSRDEYMCANDLVSEPGPYGLHASMYLTTLRDQGTPEQHKLFLQPAENYRAIGFKIPHINMLAKFSSVDPESNKYVKPSSPSLVYGTLTWVRSTIVLQSGGVLARGVTIAVRYASVRRQFQDRDAPSDADGENQVLNYTMVQFRLLPLLAATFALHFTGKAMMGLYEENQKKMINSDAGKVADTNRGAGPEEIHSGSDLLADLHATSCGLKALSSTTAAEGLELLKSARAVLKGNAPNNDTTKIFTNFLQKQDMGAAHDVLGSDADLVAAFAWRTSFLTFEALKHRDVEKNSWNSLLVDFWRLSTAHSQYLVVKNFYDALQNWQLDSSLGRKDGKVYEDMFHRASELNPLNGLTIDPYPDSDVLVKKDESERFKSKL

SEQ ID NO: 781 - protein, 719 aa, Leishmania donovani
MPARLSAHLAPRRHFARRTEPRLFEVNPTRESYVIETAFEEPTFRFICEGVDVDFKEDVREALAKVLPPSPSNFTQREEGTALQLPQILLALRSLCRQQLVSFAQVRSTPRLLASYYEALAAANPVLAVLAAEHYTFAGLVATHAKKSVRDVVLAGVDSAATIGCIAEQELIAEGTPLNTEARYDVHERCFVLRGTGKFGVVAAACAQWAVVSATLTLNKKEHNGTHLFLVQLREGDLLSASGQLRRGISVRPITGENTTMAGCGVAVLHFEDVRIPSDHLLDPYCITSESKVGYVAGQESQEPATEVLRTRRRIATGAIYIGVTKKLLTDVVTYTADKYVVGPDYRRNYPFLGLQHIQSPLVSMVAKSYVYLVAWQRLLPVFTNPSGSPSYEDYMRLAGTVHFLQENLLDLQTFADKTMGLHGSFASTGKDAAVTLVHLRQEDLDTSALIREVAFRSVTKNIGTTHWGWWLTSLLQPVFPALNRFLKNPLYSPRIADLGRHLIFFSHKHYSLKKRLRQSRELERRKGGSEHEWYDWVMFRHRTVVHCGEAFMEVYYLDVMMKETEKCSDPRGRKILRDIAWIYALTRQMDRLDFLLSSKMLSPGKAETLVSHIDNIVTVLAPQCVHLVEAMQVPEFARAPCRSATYMEAYWTIPGTNTHIERGDRLTLRDASKASSSKGRRGAENAKAAQEAIRESPEEFDLFHGLADEPSYARRKAP

SEQ ID NO: 782 - protein, 719 aa, Leishmania major
MPARLSAHLAPRRHFARRTEPRLFEVNPTRESYVIEAAFEEPTFRFICEGVDVDFKEDVREALAKVLPPSPSNFTQREEGTALQLPQILQTLRSLCRQQLVSFAQVRSTPRRLASYYEALAAANPVLAVLAAEHYTFAGLVATHAKKSVRDAVLAGVDSAATIGCIAEQELIAEGTPLNTEARYDAHERCFVLRGTGKFGVVAAACAQWAVVSATLTLNKKEHNGTHLFLVQLREGDMLNASGQLRRGISVRPITGENTTMAGCGVAVLHFEDVRIPSDHLLNPYCITSESKVGYVAGQESQEPATEVLRTRRRIATGAIYIGVTKKLLADVVTYTADKYVVGPDYRRNYPFLGLQHIQSPLVSMVAKSYVYLVAWQRLLPVFTDPSGSPSYEDHMRLAGTVYFLQENLLDLQTFADKTMGLHGSFASTGKYAAVTLVHLRQEGLDTSALIREVAFRSVTKNIGTTHWGWWLTSLLQPVFPALNRFLKNPLYSPRIADLGRHLIFFSHKHYSLKKRLRQSRELERRKGGSEHEWYDWVVFRHRTVVHCGEAFMEVYYLDVMMKETERCSDPRGRKILRDIAWIYALTRQMDRLDFLLSSKMLSPGKAETLASHIDNIVTVLAPQCVHLVEAMQVPEFARAPCRSATHMEAYWTIPGTNTHIERGDRLTLRDAANASSSKGRRGAESAKAAQEAIRESPEEFDLFHGLADEPSYARRKAP

SEQ ID NO: 783 - protein, 719 aa, Leishmania infantum
MPARLSAHLAPRRHFARRTEPRLFEVNPTRESYVIETAFEEPTFRFICEGVDVDFKEDVREALAKVLPPSPSNFTQREEGTALQLPQILLALRSLCRQQLVSFAQVRSTPRLLASYYEALAAANPVLAVLAAEHYTFAGLVATHAKKSVRDVVLAGVDSAATIGCIAEQELIAEGTPLNTEARYDVHERCFVLRGTGKFGVVAAACAQWAVVSATLTLNKKEHNGTHLFLVQLREGDLLSASGQLRRGISVRPITGENTTMAGCGVAVLHFEDVRIPSDHLLDPYCITSESKVGYVAGQESQEPATEVLRTRRRIATGAIYIGVTKKLLTDVVTYTADKYVVGPDYRRNYPFLGLQHIQSPLVSMVAKSYVYLVAWQRLLPVFTNPSGSPSYEDHMRLAGTVHFLQENLLDLQTFADKTMGLHGSFASTGKDAAVTLVHLRQEDLDTSALIREVAFRSVTKNIGTTHWGWWLTSLLQPVFPALNRFLKNPLYSPRIADLGRHLIFFSHKHYSLKKRLRQSRELERRKGGSEHEWYDWVMFRHRTVVHCGEAFMEVYYLDVMMKETEKCSDPRGRKILRDIAWIYALTRQMDRLDFLLSSKMLSPGKAETLVSHIDNIVTVLAPQCVHLVEAMQVPEFARAPCRSATYMEAYWTIPGTNTHIERGDRLTLRDASNASSSKGRRGAENAKAAQEAIRESPEEFDLFHGLADEPSYARRKAP

SEQ ID NO: 784 - protein, 675 aa, Gallus gallus
MALLDTTKDTQGSGLASVNPDLASERLTASFCVPRLTAVLDGGAERTRLRRAVVNVIESDPVFSSENQYFQSQNERYEAAVRKAVHLRKKMQEMGWSEGGPESLYVYRALSGDVAFLLHRVFMRSISVLGSDKQVAKWIPLATEYQIIGSYAQTELGHGTYLQGLETTAIFDVSTQEFILNTPTISAMKWWPGDMGRSATHTVVFAQLYIHGKCYGVHPFIVQIRSLQDHSLCPGITAGDIGPKMNFEHIDNGYLMLKNVRIPRENMLNKFCEVQPDGTYVRRGSQKINYFTMTSVRISLISDEVILPLMKACTIAIRYSVVRRQSKLKPGEEEAKILDYQTQQEKLLPQLAAAYAFHFINNYLHELFDRGYREIQGRNFDLLPELHAFSSGFKAMVSQYCTTGVEICLRACGGHGYSLLSGLPSLYTKILASCIYEGENTILLLQTARFLIKCFSAASAGQPVPPSVTYLAAMKPGKCPAKDKLDFLSPDVYTEAYQHAAIRLISSTAAKLQDLIQSGVERHEAWNQCTVQLVQAAKAHCHYITVKNFVETVEKLENTAGIQNIMKHLCDLFALHGIFSNAGTFLHDGYITGAQMDMVTASYLDLLGIIRKDAVPLVDAFDFTDKNLNSALGSYDGQVYQRLYEWARKAPTNKQISPAYEKYLKPLLHNKLSKL

SEQ ID NO: 785 - protein, 596 aa, Vitis vinifera
MEGIDYHEGERSKAEFDVEEMKIVWAGSREVFEVSDRMGRLVASDEVNFFVFSFGFLGVFGCSQIVGELGFFSSGFRRSFIFPCVFVCRKSDEFVIHSPTLTSSKWWPGGLGKVSTHAVVYARLITDGQDHGVHGFIVQLRSLEDHLPLPGITIGDIGMKFGNGGYNSMDNGVLRFDHVRIPRDQMLMRVFQVTREGKCVQSNVPRQLVYGTMVFVRQTIVSDASSALSRAVCIATRYSVVRRQFGSQNGGPETQVIDYKTQQSRLFPLLASAYAFRFVGQWLKWLYMDVTQRLQANDFSTLPEAHACTAGLKSLTTSATADGIEECRKLCGGHGYLCSSGLPELFAVYVPACTYEGDNIVLLLQVARFLMKTVSQLGSGKQPVGTTAYMGRVADLMQCCCAVQRAEDWLNPSVILEAFEARSARMSVACAQNLSKFANSEEGFAELSADLVEAAVAHCQLIVVSKFIEKLQEDIPGKGVKRQLEILCNIYALYLLHKYVGDFLSTSCITPKQASLANEQLRSLYAQARPNAIALVDAFNYTDHYLSSILGCYDGNVYPKLYDAAWKDPLNASVVPDGYQQYIRPMLKQQLRNARL

SEQ ID NO: 786 - protein, 439 aa, Vitis vinifera
MTIYSSNNADDSEKAKKGSYFGLPSLDVSVAFPQATPASIFPPCASDYYQFDDLLTPEEQALRMKVRKCVEKEIAPIMTEYWEKAEFPFHVVPKLAALRIAGGTIKGYGCPGLSVTASAITTAEVSRVDASCSTFILVHSSLAMLTIALCGSEAQKQKYLPSLAQLNTIACWALTEPDYGSDASSLKTTATKVEGGWILEGQKRWIGNSTFADVLIIFARNTTTNQINGYIVKKGAPGLTATKIQNKIGLRIVQNGDIQFKKVFVPDEDRLPGVNSFQDTNKVLAVSRVMVAWQPIGISMGAYDMCHRYLKERKQFGAPLAAFQINQQKLVEMLGNIQAMTLVGWRLCKLYEKGKMTPGHASLAKAWITLKARETLALGRELLGGNGILADFLVAKAFCDLEPIYTYEGTYDINTLVTGREITGIASFKPAALNRRSRL

SEQ ID NO: 787 - protein, 654 aa, Gordonia amarae
MEAMSAPVTPEKTDSDNSADGDAALATVLRAALDGPWHQTREEVRANIDRAELLPDPSRTLDQARADILDTMRTLAEKGFAAPGFAADHGGTGDVGAAVTGIETLGYADLSLMVKSGVQWGLFGGAVENLGTARHHEKYVPGIINLDVLGCFAMTETGHGSNVASVETTATYDPATQEFVIHSPTASARKDYIGGAGQHARVAAVFAQLITGGPGEEPEGRGVHCFVVPIRDDDGTDLPGVATSDCGYKGGLAGVDNGRILFDNVRIPAENLLNKYGDVAADGTYSSPIESTNKRFFTMLGTLIRGRVCVAATAGAAGRKALTLATRYGLLRKQFEAPDEQGEVTILDYLGHQRKLLPLIAKSYAIAFAQNDITARLAEGDPEAARTLEADVAGFKAYSTWHGSTAVNIAREACGGAGYLSENQLPIIRGDIDVFTTFEGDNTVLTQLIGKELLGAYAEDMRGLSARGWVRFIATMARDVVAEKTAVRQVIQTILDDSDENTDDSPLTNRGTQIRLFRNREDHLLRTCAQRLRKSTSDDDAFEVFNSAQDHLLKVGHAHTERLVLESMIAAIVEVEDEAARELLWKVCDLFVYSALEADLGWFLMHRHVSVERAKAIRRGVNDLCADLRPHARTLIDAFGVPENLLHTPMLDHG

SEQ ID NO: 788 - protein, 692 aa, Arthrobacter globiformis; identical to SEQ ID NO: 754

SEQ ID NO: 789 - protein, 687 aa, Vitis vinifera
MDSPNTNPTAEDESQLVSRRIQRLSLHLTPIPNSFIRDHHQLQLLTCARVKLSVNTALLSDFLRGKHRGIQEKVYEYFKSRPDLQTPVEISKDEHRELCMRQLLGLVREAGIRPFRYIVEDPSKYFAIAEAAGSVDMSLGIKLGVQYSLWGGSVLNLGTKKHKDKYYDVIDNLEYPGCFAMTELHHGSNVQGLQTVATFDPITDEFIINTPNDGAIKWWIGNAAVHGKFATVFARLLLPTHDIKGVSDMGVHAFIVPIRDLKTHQTLPGVEIHDCGHKVGLNGVDNGALRFHSVRIPRDNLLNRFGDVSRDGKYTSNLPSINKRFAATLGELVGGRVALAYSSVSVLKVSMTIAIRYSLLRQQFGPPKQPEISILDYQSHQHKLMPMLASTYAFHFATLHLVQMYSEMKKSHDDQLVGDVHSLSAGLKAYVTSYTAKSLSTCREACGGHGYAAVNRFGSLRNDHDIFQTFEGDNTVLLQQVAADLLKQYREKFQGGTLAVTWNYLRESMNTYLSQPNPVTARWEGEEHLRDPKFQLDAFRYRTSRLLQSVAVRLRKHSKTLGSFGAWNRCLNHLLTLAESHIESVILAKFIEAVQSCPEETRVTLKLVCDLYALDRIWNDIGTYRIVDYVAPNKAKAIHKLTEYLSFQLRNVAGELVDAFNLPDHVTRAPIAMQSEAYSQYTQHVGF

SEQ ID NO: 790 - protein, 446 aa, Vitis vinifera
MTIYSSNNAGYSSNNPDDSEKAKKGSYFGLPSLDVSVAFPQATPASIFPPCASDYYQFDDLLTPEEQALRMKVRKCVEKEIAPIMTEYWEKAEFPFHVVPKLAALRIAGGTIKGYGCPGLSVTASAITTAEVSRVDASCSTFILVHSSLAMLTIALCGSEAQKQKYLPSLAQLNTIACWALTEPDYGSDASSLKTTATKVEGGWILEGQKRWIGNSTFADVLIIFARNTTTNQINGYIVKKGAPGLTATKIQNKIGLRIVQNGDIQFKKVFVPDEDRLPGVNSFQDTNKVLAVSRVMVAWQPIGISMGAYDMCHRYLKERKQFGAPLAAFQINQQKLVEMLGNIQAMTLVGWRLCKLYEKGKMTPGHASLAKAWITLKARETLALGRELLGGNGILADFLVAKAFCDLEPIYTYEGTYDINTLVTGREITGIASFKPAALNRRSRL

SEQ ID NO: 791 - protein, 654 aa, Gordonia amarae; identical to SEQ ID NO: 787

SEQ ID NO: 792 - protein, 681 aa, Canis lupus
MGSPVHRVSLGDTWSTQVHPDIESERYIQSFNVERLINILDGGAQNTALRRKVESIIHSDPEFSLKDNYFMTQNERYEAAVKRKFYLQTIAKRQGWSEGSPELYYSYRTLSGDLAFSIHMVFLKSLKSLGSEEQIAKWAPLCNDFQIIATYAQTELGHGTYLQGLETEATYDAATQEFVVHSPTMTATKWWPGDLGRSATHALVQAQLICSGARQGMHAFIVPIRSLQDHTPLPGVTVGDIGPKMGFHHIDHGFLRLDHVRIPRENMLSRFAQVLPDGTYLKVGSLQINYLSMVVMRVDLLLGEIIPMLQKACVIAIRYSVIRHQSSLRPSGPEVKILDYQTQQHKLLPQLATVYAFHFLASNLLKFFHSSYSAILNRDFSHLPELHALSAGIKALVSDLCLQGTELCRRACGGHGYSKLSGLPSLVSRVTASCTYEGENTVLYLQTARFLVKNYLQVHGSLGSTSQMFLPKSTAYLTTPYQARCPAQKAADFLHAKLYTAAWAHVAARLIKDSAHHLQTLMQSGADWDEAWNQSTVLHLQAAKAHCYYISVKNFTETLDKLENEPAIQQVLKRLCDLYALHSILTNSGDFLHDGFLSGTQVDAVRTAYLNLLLLIRKDAILLTDAFDFMDHCLNSALGCYDGNVYERLFHWAQRSPTNTQGNPAYEKYIKPLLQSWRSKL

SEQ ID NO: 793 - protein, 697 aa, Danaus plexippus
MSTITENEDLRKERAKCTFNIEELTYLLDDGYENTRRRRDLENKVLSTKGLLDEIPEEYLSHKEKYENVIRKCVKLHRALLEYDDLRDKPIDEKIKAILRDTVSLAVTKDNSPMMLHSGMFLMAIEGQANEKQQEYWLKRGRNMEIIGTYAQTELGHGTFLRGLELRATYDEKTEEFILHSPTLTSYKWWPGGLAHTANYAIVMAQLYIKDKCYGMQPFMVQLRDEETHMPLPGIKVGEIGPKLGFNTVNNGFLGFENVRIPRDRMLMKNAQVLKDGTFIASPNSKLTYNTMVNVRVLIVNTVAKYLSSASTIAVRYAAVRRQSQMKPGEPEPQILDYVTQQHKLMIAIATSHAYHFTVRWLYDVSDTVKENITKGQLDTLPELHVLACALKVLSSSECTSLVEVCRRACGGHGYMLSSNLPQLYGVCTATMTYEGENTVLLLQVARSLVKAWDRAARGQPLSPSMSYIENKTLAAKWDASLDGIVRNFQIVSRSKLASSVASFQQYMKSGLSYEDAWNKASVQLIAAAEAHGRAIVLAIYKQQIEKQARNVSLPLRDVLHQLLELYMVYWTLEKVGDLLLYTQISERDVKALQRRYEDLLEILRPNAVGLVDAFDIRDEVLCSTLGSYDGRVYERLMEEAMKSPLNKEPVLCSTLGSYDGRVYERLMEEAMKSPLNKEPVNDTFHKYLKPFMRGKL

SEQ ID NO: 794 - protein, 670 aa, Danaus plexippus
MVLNKYKVNPDLAIERQKCTFDIEEIINIFDGGKKKTSQRRKIEDIVLKSGLCYDDVPEECMSLKERYENAVRKSCLFSKLMKTELQEITGIEDFETPAIRRIADALFKDISPFLLHLGMFVPTIIGQCTSEQLMIWLPKALDLQIIGGYAQTELGHGTFIRGLETTATYDASTEEFVLHTPTLTAHKWWAGGLGKTINHCIVVAQLYTKGVCYGTHLFMVQIRDLDTHMPLPGIKVGEIGPRMGFSSADNGFLGFNNFRIPRNNMLMKHAQVQKDGTYVKPARHGKLTYQTMVFVRVNLVNEAAFNLSKAVTIAVRYSAVRRQSELRPNEPEPQILDYPTQQHKLFIGIATAHAFQLAANWLWNTFKSVLSDMKKGDVGTLPELHALSSCLKAVSTSDAALLIEQCRYACGGHGYMLSSNLPYIYSFVAATRTYEGDYTILLLQTARFLVKAWEQAEAGKTVTPTVSYISRSIKGEKFSWQSTDEGIIKSFQAVSAGKIALCVKSIRDRMKSGLDYEDAWLLTTVQLVDAAEAHCRSVILETYWNEVRRLTKSSSDSVKIVMHQLVTLYLTYWTLQRTGDLLRYSSISEKDIDFMQRQYEELLQQIRPNAVALVDAFDLRDEILHSSLGAYDGRVYERLMEQAENNPMNVEPVNQSFYKYIKPLLQGKL

SEQ ID NO: 795 - protein, 665 aa, Danaus plexippus
MSVQINEDLVKERKKCTFDVQELIHFIDGGKQKTELRKYIENLVLSIDNLKDDIPEEYLSHKECYENVIRKGSVLYDIFSELSKDRKHKAHQAPSNAYRISDGIMQNVNPFLLHFALFVPAITNQATPEQQAEFLKHGFGIIGTYAQTELGHGTFLRGLETTATLDLETDEFVLNSPTLTSYKWWPGGLGHTANHCVVMAQLYVKGKCHGPHLFFVQIRDIETHEPLPGLKLGEIGAKMGFNTADNGFLGFHNFRIPRNNMLMKNSQVLKDGTYVESKNEKLTYGSMVFVRVYLLSDMAYMLARAATISVRYSAVRHQSHIKPDEPEVQILDFVIQQHKLFISIATSHAFKICGLWLWQTYSKVMEDIGKGSMDRLPELHALSCCLKTTSTRDAGWLIEQCRLACGGHGYLMSSNLPSLYTTATAAITYEGESTVLLLQTARYLIKSWKRAMEGESLPATVSFLSEYFNKRYNKWENTPKGIVDGLKLVVAGVTKMCAESIQKHVSRGQQYEEAWNSSSVQLIKASEAYSRALLCEVFWFEVDKVSSTLSNNLAVVLKQLAELYITYWALEKRGDLLVYTTISKDDLDKLQERYEELLALIRPNAVGLVDSFDIRDEILCSTLGAYDGRVYERMMEHALKSPLNAETVNQSFHKYMKPVILKHKI

SEQ ID NO: 796 - protein, 664 aa, Medicago truncatula
MEGVDHLAFERNKAEFDVNEMKIVWAGSRQEFELSDRISRLVASDPAFRKDNRTSLDRKELFKNTLRKTAYAWKRIIELRLNEQEASKLRSFVDEPAFTDLHWGMFVPAIKGQGTDEQQEKWLPLAYKMQIIGCYAQTELGHGSNVQGLETTATFDPKTDEFIIHSPTLTSSKWWPGGLGKISTHAIVYARLITEGQDQGVHGFIVQLRSLDDHLPLPGITVGDIGMKFGNAAYNTMDNGVLRFDHVRIPRNQMLMRVSQVTREGKYVQSNVPRQLIYGTMVYVRQAIVADASTALSRAVCIATRYSAVRRQFGSQKGGPETQVIDYKTQQARLFPLLASAYAFRFVSEWLKWLYTDVTQRLQANDFSTLPEAHACTAGLKSLTTSATADGIEECRKLCGGHGYLCSSGLPELFAVYVPACTYEGDNTVLLLQVARYLVKTISQLGSGKKPVGTTAYLGRVEQLMQYQSDVKRAEDWLKPNVVIEAFEARAARMSVAVAQNISKFSNPEEGFQELSVDLVEAAAAHCQLIVVSKFIEKLQQNIPGKGVKQQLEVLCSIYALFLLHKHLGDFLSTGSITEEQGSLANEQLRSLYSQVRPNAITLVDAFNYTDHLLGSVLGRYDGNVYPKLYEEAWKDPLNDSVVPDGFKEFVQPMLRQQLHNARL

SEQ ID NO: 797 - protein, 664 aa, Medicago truncatula
MEGEDHLAFERNKAEFDVDAMKIVWAGSAHALEVSDRMSRLVASDPAFRKDHRPMLGRKELFKSTLKKAAYAWKRIIELRLTEEEASMLRSFVDEPAFTDLHWGMFIPAIKGQGTEEQQQKWLPLAQRMQIIGCYAQTELGHGSNVQGLETTATFDPKTDEFVIHSPTLTSSKWWPGGLGKVSTHAVVYARLITDGRDHGVHGFIVQLRSLDDHLPLPGITVGDIGMKFGNGAYNTMDNGVLRFEHVRIPRDQMLMRVSQVTREGKYVQSNVPRQLVYGTMVYVRQTIVSDASTAMSRAVCIAARYSAVRRQFGGNNGSLESQVIDYKTQQARLFPLLASAYAFRFVGEWLKWLYTDVMKRLQANDFSTLPEAHACTAGLKSLTTSATSDGIEECRKLCGGHGYLCSSGLPELFAVYVPTCTYEGDNIVLLLQVARHLMKVISRLGSGKKPVGTTAYMGRVEQLLEARSDVQKAEDWLNPNTVLRAFEARAARMSVACAKNLTKFSNPEEGFQELLADLVDAARAHCQLIVVSKFIEKLQQDIPGKGVKRQLEILCNIYALFHLHKHLGDFLSTGCITPKQGSLANDQLRSLYSQVRPNAIALVDAFNYTDHYLSSVLGRYDGNVYPKLYEEAWKDPLNDSVVPDGFQEYIRPMLKQQLRNARL

SEQ ID NO: 798 - protein, 664 aa, Medicago truncatula; identical to SEQ ID NO: 796

SEQ ID NO: 799 - protein, 664 aa, Medicago truncatula; identical to SEQ ID NO: 797

SEQ ID NO: 800 - protein, 444 aa, Aspergillus fumigatus
MDNGFLLFNNVKIPHINMLARFSRVDKETNKYVRPASPSLVFGTMTWVRSNIVLQAGSVLARGVTIATRYCAVRRQFQDRDAKADAGETQVLNYKMVQIRLLPLLAAMYALHFTGRGMMRLYQENQNKRAAAEAEQDKRGAAPEALRAGSDLLADLHATSCGLKALASTTAGEGLEICRRACGGHGYSSYSGIGPYYSDYLPTLTWEGDNYMLTQQVARYLLKSARAVLAGKGTGNDTSQILQAYLARRDKGASFDILEVDSDIVAAFAWRTAHLTFEALKHRDLEKRSWNSLLVDFWRLSTAHSQYLVVKNFYEAVSSPDLAAKLGPETTKIMHDLFRLYALHTLEREAAEFFSSGAVTVRQITLTRTNAVMKLLDEIRPHAVRLVDAWKIPDWQLDSSLGRYDGDVYPDLFNRASQNPVNDLVFDPYPWNEAVLKNAPKAKL

SEQ ID NO: 801 - protein, 692 aa, Brachypodium distachyon
MATTSSRSNSNPGSDDDDSTPAMRRLRRLSLHLLQPEGPASSHLAPAACAARRRLEADAAALAAYMRGRHRAMQARVYEFYVARPELQTPVELPTAAHRELCFRQMAALVRDAGVRPLSLMAADPAEYFAVMEAVGGLDISLAIKVGVQYSLWGGSIINLGTKKHKEKFFDKIDNLEYPGCFAMTELHHGSNVQALQTTATFDPVNDEFIIDTPNDGAIKWWIGNAALHGKFATVFARLILPLQGKGGEPADMGIHAFIVPIRDLETHVVLPGIEINDCGHKIGLNGVDNGALRFRSVRIPRDNLLNRFGDVARDGKYTSSLPTINKRFAATLGELVGGRVGLAYSSVGVLKVAVTIAVRYALLRQQFGPPKQPEISVLDYQSHQHKLMPMLASAYAFHFARGYLVDKYSEMKKTNDEDLSADVHVLSSGLKSYITSYTAKSISICRESCGGHGYAAVNRFGGLRNDHDIFQTFEGDNTVLLQQVAGDLLKQYQQKFKGGTISVTWSYLRESMSTYLSQPNPVTARWEGEDHLRDPNFQLDAFRYRTSRLLHSVAARLQKHMKTLGGFGAWNRCLNHLLTLAESHIESIILARFIEAVKSCPDEKTREVLKLVCDLYALDRIWNDIGTYRNVDYVAPNKAKAIHKLVDYLSYQVRLVARELVDAFDLPDQIIRAPIGMQSEAYAQYTQFVGF

SEQ ID NO: 802 - protein, 437 aa, Brachypodium distachyon
MGSLRGSAGGEGRNEDGGKVGLPALEVALAFPQATPASLFPPSVSDYYQFDDLLSDEEKTLRKKVRAISEKEIAPIMTEYWEKAEFPFHAIPKLATLGLAGSTTKGYGCPGLSLTASAISIAEVARVDASCSTFILVHSSLAMSTIALCGSEAQKQKYLPSMAQLKTVGCWALTEPDYGSDASSLKTSATKVPGGWLLDGQKRWIGNSTFADVLIILARNADTKQLNGFIVKKGAPGLKATKIQNKIGLRMVQNGDILLNKVFVPEEDRLTGIDSFQDISKVLAMSRIMVAWQPIGIAMGVYDMCHRYLKERKQFGAPLAAFQLNQEKLVRMLGNIQAMVLIGWRLCKLYESDKMTPGHASLGKAWTSTKAREVVSLGRELLGGNGILADFLVAKAFCDLEPIYTYEGTYDINSLVTGREITGIASFKPAALAKSRL

SEQ ID NO: 803 - protein, 438 aa, Brachypodium distachyon
MGSLRGSAAGEGRSEDGGKVGLPALDVALAFPQATPASLLFPPAVSDYYQIDDLLTDEEKALRKKVRAISEKEIAPIMTEYWEKAEFPFHAIPKLATLGLVGSTMKGYGCPGLSLTASAVSIAEVSRVDASCSAFILVHSSLAMSTIALCGSEAQKQKYLPSMAQLKTVGCWALTEPDYGSDASSLKTSATKVPGGWHLDGQKRWIGNSTFADVLIILARNADTKQLNGFIVKKGAPGLKATKIQNKIGLRMVQNGDILLNKVFVPDEDRLTGIDSFQDINKVLGMSRVMVTWQPIGVAMGVYDMCHRYLGERKQFGAPLAAFQLNQEKLVRMLGDIQAMVLVGWRLCKLYESGKMTPGHASLGKAWTSTKAREVASVGRELLGGNGILADFLVAKAFCDLEPIFTYEGTYDINSLVTGREITGTASFKPAVLVKSRL

SEQ ID NO: 804 - protein, 669 aa, Brachypodium distachyon
MAAADGGEADHLAGERATAQFDVDGMKVAWAGSRHAVEVNDRMARLVASDPVFRKDTRTMLPRKELFKDTLKKAAHAWKRIVELRLTEEEANLLRLYVDQPGYVDLHWGMFVPAIKGQGTEEQQKKWLPMAYKFQIIGCYAQTELGHGSNVQGLETTATFDPSTDEFVVHSPTLTSSKWWPGGLGKASTHAVVYARLITEGKDYGIHGFIVQLRSLEDHSPLPGITLGDIGGKFGSGAYNSMDNGVLRFDHVRIPRDQMLMRLSQVTREGKYVHSNVPKQLLYGTMVYVRQTIVADASKALSRAVCIAVRYSAIRKQFGAQAGGPETQVINYKTQQSRLFPLLASAYAFRFVGEWLKWLYTDVTQKLEAKDFSTLPEAHACTAGLKSVTTSATADAIEECRKLCGGHGYLNSSGLPELFAVYVPACTYEGDNVVLLLQVARFLMKTVSQLASGKQPVGTTAYMGNIQYLMQSKCAVNTAEEWLNPAVIKEVFEARALRMAVNCAQNISKAPSQEEGFSELSPDLLEASVAHVQLIIVTKFIEKLQQDIPGHGVKDQLQNLCNIYALHLLHKHLGDFLSTGCVTAKQGALANEQLGKLYAAVRPNAVALVDAFDYTDHYLGSVLGRYDGDVYPALYQEAWKDPLNDTVVPDGYHEHLRPLLKQQLKLSRL

SEQ ID NO: 805 - protein, 421 aa, Glycine max
MPSYFNFPALDVSVAFPQATPASTFPPCASDYFHFNDLLKPEEQAVRNRVRECMEKEIAPIMTEYWEKAEFPFHVIPKFAALRIAGGTIKGYGCPDLSIAGSAVAAAEVARVDASCSTFFLVHSSLAMLTIALCGSEAQKQKYLPSLAQMKTIACWALTEPDYGSDASALKTTATKVEGGWILDGQKRWIGNSTFADLLVIFARNMTTNQINGYIVKKDAPGLTVTKMENKIGLRIVQNGDIVMGKVFVPDDDRLEGVNSFQDTNKVLAVSRVMVAWQPIGLSMGIYDMCHRYLKERKQFGAPLAAFQISQQKLVQMLGNIQAMILVGWRLCKLYESGKMTPGHASLGKSWITLRARETAALGRELLGGNGILADFLVAKAFCDIEPIYTFEGTYDINTLVTGREITGFASFKPVAQKSRL

SEQ ID NO: 806 - protein, 421 aa, Glycine max
MPSYFNLPALDVSVAFPQATPASNFPPCASDYFHFNDLLKPEEQAVRNKVRECMEKEIAPIMTEYWEKAEFPFHVIPKFAALRIAGGTIKGYGCPGLSITGSAVATAEVARVDASCSTFYLVHSSLAMLTIALCGSEAQKQKYLPSLAQMKTIACWALTEPDYGSDASALKTTATKLQCGWILDGQKRWIGNSTFADLLVIFARNTTTNQINGYIVKKDAPGLTVTKMENKIGLRIVQNGDIVMRKVFVPDDDRIEGVNSFQDTNKVLAVSRVMVAWQPIGLSMGIYDMCHRYLKERKQFGAPLAAFQISQQKLVQMLGNIQAMILVGWRLCKLYESGKMTPGHASLGKSWITLRARETAALGRELLGGNGILADFLVAKAFCDIEPIYTFEGTYDINTLVTGREVTGFASFKSVAQKSRL

SEQ ID NO: 807 - protein, 665 aa, Glycine max
MEDSIDHLAFERNKAQFDVDEMKIVWAGSRQDFELSDRISRLVASDPAFRKDDRTTLGRKELFKNTLRKAAYAWKRINELRLNEQEAYKLRSFVDQPAFTDLHWGMFVPAIQGQGTDEQQQKWLPLAYRMQIIGCYAQTELGHGSNVQGLETTATFDPKTDEFVIHNPTLTSSKWWPGGLGKISTHAVVYARLIIGGEDHGVHGFIVQLRSLDDHLPLSGITIGDIGMKFGNAAYNTMDNGVLRFDHVRIPRNQMLMRVSQVTREGKYVHSNVPRQLVYGTMVNVRQKIVADASVALSRAVCIATRYSAVRRQFGSHNGGLETQVIDYKTQQARLFPLLASAYAFRFVGEWLKWLYMDVTKRLQANDFSTLPEAHACTAGLKSLTTTATADGIEECRKLCGGHGYLCSSGLPELFAVYVPACTYEGDNIVLLLQVARYLMKTVSQLGSGNKPVGTTAYMARVEQLMQYHSDVKKAEDWLKPNVVLEAFEARAARMSVACAQNLSKFTNPEEGFQELAADLVDAAVAHCQLIVVSKFIEKLQQDIPGKGVKKQLEVLCSIYALFLLHKHLGDFLSTGCINPKQGSLASEQLRNLYSQVRPNAIALVDAFNYTDHYLGSILGRYDGNVYPKLYEEAWKDPLNDSVVPDGFKEYIQPMLKQQLRNARL

SEQ ID NO: 808 - protein, 682 aa, Paracoccidioides brasiliensis
MAPIPEWVKALKPAGPQGSELLQRERDSSNVSVDKLGELLHTKEVLDRQQKILAIMKNEKIFDKSQNLSMGRVERLTASLGKAKRIQQLREQHNWTDEEFVMANNLLSEPTPYGLHASMFLVTLRNQSTPEQAKLFLEPAERYEIIGCYAQTELGHGSNVQGLETTATWDPTDKTFVMHSPTLTASKWWIGSLGKTANHAIVMAQLIISGKRYGPHPFVVPIRDLKTHEPLEGVHVGDIGPKFGYNTMDNGFLLLNKVKIPHVNMLARFSHVDPATSKYVRPAAASLVYGTMTWVRSTIVLQSGSVLARGVTIATRYCSIRRQFKDRDAKDKTAGENPVLDYKMVQIRLLPLLAATFALHFTGRRMMEMYEQNQKLIAAGGSEKAGAILLADLHSTSCGLKALGSTIAAEGLEVCRRACGGHGYSSYSGIGPWYADYLPTTTWEGDNYMLTQQVARYLLKSARAVFAGQAPDNDTCRILKGYLSRKDTGAAFDILDSDAEIVDAFAWRTAYLTFEALKHRDVEKRSWNSLLIDFYHLSTAHSQYLVVKNFYEALSSPSTTSALDPDTTAVLQKLFRLFALNMLDRESAEFFTSGAVTIRQITLTRTKAVVTLLDEVRPHAVRLVDAWKFPDWQLDSSLGRSDGKVYEDLFYRASEQNPANNITFDPYPSTDVLVKNKRQSKL

SEQ ID NO: 809 - protein, 694 aa, Paracoccidioides brasiliensis
MANKTDFSAALKPAAPDGATILANERARSSIPVHELSQHLLTSEYLEQQNRVLNVLESDPLFKKTNQANLSRPDRYLLALARSKRIRQFQDKFRWNKDGYSMAASLCDDVLPYHLHTSMFTTTVAQQGSEAQKAYWMPKIEAWEVIGAYAQTELGHGSNVRGLELEAKWDPKTKEFVLHSPHLTASKWWNGTMGRTANHVIAIAQLLLPVSGSGIDTKYKNYGPHPFIVQIRDMKTHQPPESIVVGDIGPKYGYDSMDNGYLLFNHHSIRRVPHDAMLAGYSSVNPESGEYTKPKNPVVVYGTLTHIRAKLVMEARLALARAVTVAVRYLSIRRQFKDKDAPNDAALEINVLDYPTVQFRILPLLATTFALHYSGKAMSELYDRTRQDIEKAGDFATLAELHSTSSGLKSLCTDLSANGIETCRRAMGGHGFGGGSGLVQLNNNYLSKPTVEGDNYMITQQVARYLIKKVGELVQNNGGPTTTRTEEGLKRYLNSKDRKLNFNVLKNDEDIVHAFEWRAAYFSFKAYEKREIQKQSWNSLLIDFYRLSRTHSQSILVINFYNALKNDANIPSEQTREVLWDLFRLFALSTMETESREFYSCGAVSNEDLDAVTTRVFDLMQRVRPHAVRLVDSWAIPDFLLNSALGRYDGKVYEELFELAHRQNPLNEVTANSDYRTDELVLGSGDAGRILSKL

SEQ ID NO: 810 - protein, 686 aa, Paracoccidioides brasiliensis
MAPIPEWVKALKPAGPQGSELLQRERDSSNVSVDKLAELLHTKAVLDRQQKILAIMKNEKVFDKSQNLSMGRVERLTASLGKAKRIQQLREQHNWTDEEFVMANNLLSEPTPYGLHASMFLVTLRNQSTPEQAKLFLEPAERYEIIGCYAQTELGHGSNVQGLETTATWDPTDKTFVMHSPTLTASKWWIGSLGKTANHAIVMAQLIISGKRYGPHPFVVPIRDLKTHEPLEGVHVGDIGPKFGYNTMDNGFLLLNKVKIPHVNMLARFSHVDPATSEYVRPAAASLVYGTMTWVRSTIVLQSGSVLARGVAIATRYCSIRRQFQDRDAKDKAAGENQVLDYKMVQIRILPLLAATFALHFTGRRMMEMYEQNQKLITAGGSEKAGAILLADLHATSCGLKALGSTIAAEGLEVCRRACGGHGYSSYSGIGPWYADYLPTTTWEGDNYMLTQQVARYFWVQLLKSARAVFAGQAPDNDTCRILKGYLSRKDTGAAFDILDSDAEIVDAFAWRTAFLTFEALKHRDVEKRSWNSLLIDFYHLSTAHSQYLVVKNFYEALSSPSTTSALDPDTTAVLWKLFRLFALNMLERESAEFFTSGAVTIRQITLTRTKAVVTLLDEVRPHAVRLVDAWKFPDWQLDSSLGRSDGKVYEDLFYRASELNPANNITFDPYPSTDVLVKNKRQSKL

SEQ ID NO: 811 - protein, 694 aa, Paracoccidioides brasiliensis
MANKTDFSAALKPAAPDGATILANERTRSSIPVHELSQYLLTSEYLEQQNRVLNALESDPLFKKTNQANLSRPDRYKLALARSKRIRQFQDKFGWNKDDYSMAASLCDDVLPYHLHTSMFTTTVAQQGSEAQKAYWMPKIEAWEVIGAYAQTELGHGSNVRGLELEAKWDPKTKEFVLHSPHLTASKWWNGTMGRTANHVIAIAQLLLPVSGSGVDTKYKNYGPHPLIVQIRDMKTHQPPESIVVGDIGPKYGYDSMDNGYLLFNHHSIRRVPHDAMLAGYSSVNPESGEYTKPKNPVVVYGTLTHIRAKLVMEARLALARAVTVAVRYLSIRRQFKDKDAPNDAALEINVLDYPTVQFRILPLLATTFALHYSGKAMGELYDRTRQDIEKSGDFATLAELHSTSSGLKSLCTDLSANGIETCRRAMGGHGFGGGSGLVQLNNNYLSKPTVEGDNYMITQQVARYLIKKVRELVQNIGGPATTRTEEGLKRYLNSKDRKLNLNVLKNDEDIVHAFEWRAAYFSFKAYEKREIQKQSWNSLLIDFYRLSRTHSQSILVINFYNALKNDTNIPSEQTREVLWDLFRLFALSTMETESREFYSCGAVSNEDLDAVTTGVFDLLQRVRPHAVRLVDSWAIPDFLLNSALGRYDGRVYEELFELAHRQNPLNEITANPDYRTDELVLGSGDAGRILSKL

SEQ ID NO: 812 - protein, 697 aa, Paracoccidioides brasiliensis
MAPIPEWVKALKPAGPQGSELLQRERDSSNVSVDKLAELLHTKAVLDRQQKILAIMKNEKVFDKSQNLSMGRVERLTASLGKAKRIQQLREQHNWTDEEFVMANNLLSEPTPYGLHASMFLVTLRNQSTPEQAKLFLEPAERYEIIGCYAQTELGHGSNVQGLETTATWDPTDKTFVMHSPTLTASKWWIGSLGKTANHAIVMAQLIISGKRYGPHPFVVPIRDLKTHEPLEGVHVGDIGPKFGYKFVHSSTSLIFEKILTIISTMDNGFLLLNKVKIPHVNMLARFSHVDPATSKYVRPAAASLVYGTMTWVRSTIVLQSGSVLARGVAIATRYCSIRRQFQDRDAKDKAAGENQVLDYKMVQIRILPLLAATFALHFTGRRMMEMYEQNQKLITAGGSEKAGAILLADLHATSCGLKALGSTIAAEGLEVCRRACGGHGYSGIGPWYADYLPTTTWEGDNYMLTQQVARYLLKSARAVFAGQAPDNDTCRILKGYLSRKDTGAAFDILDSDAEIVDAFAWRTAFLTFEALKHRDVEKRSWNSLLIDFYHLSTAHSQYLVVKNFYEALSSPSTTSALDPDTTAVLWKLFRLFALNMLERESAEFFTSGAVTIRQITLTRTKAVVTLLDEVRPHAVRLVDAWKFPDWQLDSSLGRSDGKVYEDLFYRASELNPANNITFDPYPSTDVLVKNKRQSKL

SEQ ID NO: 813 - protein, 690 aa, Paracoccidioides brasiliensis
MANKTDFSAALKPAAPDGATILANERARSSIPVHELSQHLLTSEYLEQQNRVLNVLESDPLFKKTNQANLSRPDRYLLALARSKRIRQFQDKFRWNKDGYSMAASLCDDVLPYHLHTSMFTTTVAQQGSEAQKAYWMPKIEAWEVIGAYAQTELGHGSNVRGLELEAKWDPKTKEFVLHSPHLTASKWWNGTMGRTANHVIAIAQLLLPVSGSGIDTKYKNYGPHPFIVQIRDMKTHQPPESIVVGDIGPKYGYDSMDNGYLLFNHHSIRRVPHDAMLAGYSSVNPESGEYTKPKNPVVVYGTLTHVCHAQFQPKEMEYPELITISQIRAKLVMEARLALARAVTVAVRYLSIRRQFKDKDAPNDAALEINVLDYPTVQFRILPLLATTFALHYSGKAMSELYDRTRQDIEKSGDFATLAELHSTSSGLKSLCTDLSANGIETCRRAMGGHGFGGGSGLVQLNNNYLSKPTVEGDNYMITQQVARYLIKKVGELVQNNGGPATTRTEEGLKRYLNSKDRKLNFNVLKNDEDIVHAFEWRAAYFKPAHSQSILVINFYNALKNDANIPSEQTREVLWDLFRLFALSTMETESREFYSCGAVSNEDLDAVTTRVFDLMQRVRPHAVRLVDSWAIPDFLLNSALGRYDGKVYEELFELAHRQNPLNEVTANSDYRTDELVLGSGDAGRILSKL

SEQ ID NO: 814 - protein, 640 aa, Heterocephalus glaber
ESERRGRALDVERLTHLLDGGARNTALRREVESLFQDDPAFSLINNYFMTPNERYEAAIRKRVLLHRMAQRLGWPKDGLQHHYAFRAISGDVTFNVHDIATKAIRSLGSEEQIAKWAPLSETYRIIVTFAQTELGHGTYLQGLETEATYDAATQEFVIHSPTMTATKWWPGDLGRSATHALVMAQLVCSGARQGIHGFMVPIRSLRDHSLLPGIAAGNIGPNMDLENADNGFLRLDHVRVPRENMLNRFAQVLPDGTYIRFGIAQNNYLSMVVARVDILVNGVLPALQKACVIATRYSVIRRQSRLRPSDPETKILDYQTQQQKLFLPLAMSYAFHFQLASLREFFQNSYVNILNKDISLLPELHALTTGTKAMMSDFCTHGAELCRRACGGHGYSKLSALPSLVTQLMASCTYEGENTVLYLQLARFLVKNYQRAQQVAGPTLQKSLPQSVAYLATPHLTKCPAQRTADFLSPELYTMAWAHMATRLIEDSVRHLQTLRQSGADQHEAWDQTGIILLQAAKAHCYYLTVKSFKEALEKLDNEPAIQPALKRLCDLFALHGILTDSGNFLYDGFLSGPQVDMVRTAYLDLLLLIRKDAILLTDAFDFTDQCLNSALGCYDGNVYERLFHWAQMSPNNKSQ

SEQ ID NO: 815 - protein, 670 aa, Bombus impatiens
MKQQKMNMNKDLQYERSRCTFDPVEVTYLFDGSPEKTKRRRDQEQYFLDDLALKENVAMKYKSHKEIYEDSLQIACNVLQKVRELQCSGKEDIDLLLHIFGARLGSALFEGGNPLVLHYAMFLPSILGQANSEQQAYWINRAWAGDVIGTYAQTELGHGTFLRGLETTATYDPETKEFVLNSPTLTSYKWWPGGLGHTANHAIVVAQLYTQGECRGIHLFVVQLRDVETHEPLKGIIIGEIGTKLGMNGVNNGFLGFRDFRIPRENMLMKNSKVLEDGTYIKSMNDKLTYGTMVFVRVMLLQDLLHYLMKAVTIAVRYSVVRRQGQINPEQPEVQILDYVTQQHKIFPHIATCFAIKVTASWVWDMYNTVQSQLHQADYEKLPELHSLSCCLKAVVSADTAAGIEQLRLSCGGHGYMTASNLPGLYGLATAVCTYEGENTVLLLQTARYLVKSWKQAMNGEPLPDSVEYLNEAAKGVKHRRWSNDLECLIDAYDAVAAGFVRSAAEHLDRRIRDGVPMEEAWNQTGIELAQCAEAHARVFIVKTFAKAVKQLNSKSEEFRQVMFQLCELYIVYWALRNVGNFLRFSSMQKEHVETLHSRLEYLLTTIRRNAVGIVDGFDFDDHILCSALGAYDGNVYERLFQEAMKSPLNREAVNISFEKYLKPFLKSNL

SEQ ID NO: 816 - protein, 674 aa, Bombus impatiens
MKNTIADLPKGPLDPYRKSATFDWKLLKLNIEGEDFVEFQKTLWDFMKKTSVFQRHNCTTLDEQRRLCNARVRALRDNNIASPLTHAHWFNIVFQYEASIPIKMGVMDGMVPSTILALGNDDHFQTVAKIQEGEYTCCFALTEISHGTNAKGIRTTATYDAKSKAFILNTPDFEAAKCWIGGLGKTATHAIVFAQLVTPDQQNHGLHTFIVPIRNPNTHIPYPNIDVGDMGEKIGLNGVDNGFIMFNNYLISRTCLLNKTADVTEDGNYTASVKDKSKRFGASLGALSSGRITITSICANFASVAITIAVRYCTVRKQFGPSELEEWPVIKYQAQQWRLFPHLAATYALKIFSAEFVNQMCEFNFKLITAKNQDNIDNEGMEIHALSSATKPVCSWTSRDIIQDCRESCGGHGYLKISRLGDLRAENDVTCTFEGENNVLIQQASNWLLNQWSNVLNGKPINSPLRTADFMKDANSILMQTFPYTTVDETLKPENLFLSFTWLLCYYLKRTYEQTQNLKRKGCDDFEIRNNTQVFFAQTLSLLYGQHVIMKYFIECIQNPSWRSEERNVLIKLCSLYGAAILEKRLGDFYAGGYASPKSNMDTLLRRGIIILCKELVQEAVALVDVLAPPDFVLNSPLGMSDGQVYKHIKEEIFKVKENFERPSWWREIVRSKL

SEQ ID NO: 817 - protein, 681 aa, Sus scrofa
MDRLAYRMSLGDTWSRKVHPDIESERCMPSFNVEQLTNILDGGAQNTALRRKVESIIHSDPELSLEDNYFMTQNERYEAAFKKTFYIQMLAQRLGWSQDSHELHYAQRSLSGDLALGIHKVFQKTLRSLGSEEQIAKWDPLCAKFQILGTYAQTELGHGTYLQGLETEATYDAATQEFVVHSPTITAIKWWPGDLGRSATHALVQAQLICSGARKGMHAFIVPIRSLEDHSPLPGITVGDIGPKMDFDHVDNGFLKLDHVRVPRENMLSRFAQVLPDGTYIKLGTEKSNYFSMVVVRVEVLMVEVLPLLQKACIIAIRYSVIRRQCQLRPSNPEAKILDYQTQQQKLFPQLAMAYAFHFVAKSLQAFLHRSYSSILGRDFSLLPELHALSAGMKAMVSDFCTQGAEVCRRACGGHGYSKLSGLPFLVSKVTASCTYEGENTVLYLQTARFLVKNYLQAQESAGSTSQRSIPESVAYLIAPDLARCPAQMAADFLHPELYTTAWAHVAVRLIKDSVHHLQTLMQSGVDRQEAWNQTTLRHLQAAKAHCYYVTVKIFTEALETLESEPAIKQVLKRLCDLYALHGILTNTGDFLHDGFLSGAQIDVVRTAYLDLLLLIRKDAVLLTDAFDFTDQCLNSALGCYDGNAYERLFQWAQKSPTNTQRNPAYEKYIRPLLQSWRSKL

SEQ ID NO: 818 - protein, 698 aa, Cavia porcellus
MSSRAHRVSLGDSWSQRVHPDIESERRRQAFDVERLTNLLDRGARNTTLRREVESLFRSDPAFSLVNTYFMTQKEHFQAAAQKRFLLHKMAQRLNWPEDGLEIDYARRALSGDIILGVHTVATKAIISLGSEEQIAKWVPLCKTYQIIATYAQTEMGHGSYLQGLETEATYDAATQEFVIHSPTITATKWWPGDLGCLATHAIVMAQLICSGAKRGMHAFVVPIRSPQDHTPLPGITAGDIGPRMGLENADNGFLQLDHVRVPRENMLSRFAQVLPDGTYIRCGTAQSNYLPMVVTRVDILTSVVLPSLQKACVIATRYSVIRRQGRLRPSDPEAKILDYQTQQQKLLFPLAMSYAFHFQAVSLLEFFQHAYNAVQSNDTSLLPELHVLTTGSKAMMTDFCAYGVELCRRACGGHGYSKLSGLPSLATQVVASCTYEGENTVLYLQVARFLMKNYQQIWETEGAHSQRSLPQSVQYFTMVHHDKCPAQNASDFLLPEIYTTAWAHTAARLVEDSARHLQVLTQSGADQQDAWNQTSVSLVQAAKAHCYYVTVKSFQDAVKKLDSEPAIQLVLKRLCDLFALHGILADSGIFLYDGFLSGPQVDMVRTAYLDLLSLIRKDAVLLTDAFDFTDQCLNSALGCYDGNVYERLFQWAQMSPNNNSQEYPVLRQIIPTPNNEFLDPSYEIIKHIQDQVPTWFI

SEQ ID NO: 819 - protein, 671 aa, Ascaris suum
MMRRDLIEEGDNPDITMERRKATFSVDKMAAFIHGGEHKLKRRREILKFVESEADFRDPIPPEFMSRQQRLENNTRKVVAMTDKSDVIDQSDFFEEGMYYQSLVMGRDLHPMSLHYVMFIPTLQGQTDDKQLDHWLPLAVSRAIVGTYAQTELGHGTNLSKLETTATYDPTTEEFILHTPSISAAKWWPGGLGKSCNYAIVVAQLITQHQPRGPHPFIVQLRDHKTHKPIEGITIGDIGPKLGINGNDNGFLIFNNYRIPRRHMLMRHAKVQPNGEYIAPSHAKLGYGAMVFVRSVMIRDQAMQIAAAAVIAIRYSAIRRQGEITAGSGEVQILDYRTQQYRIMPQFAKALVFLFAATQVKELFQKVSAQITGGNTELLQELHVLSSGLKAVVSWEVAQGIEQCRLACGGHGYSQASAFPEIYAYAVGGCTYEGENIVMLLQVARFLMKAAESVRKGNARLAAITGYLNEIGRSKCDLDSWQTASDADLIRDFEHVARKQVFTAFDFLQQLQREGRSTEDAWNAASVELCKASRMHVKRYLVKTFLERVSECKDPELKPTLDLIGRLFIFDQICAHMGSFRKECYMRDKQAENVSRAVYDILALLRPNAVALADSLDFSDRELHSILGRRDGNVYPALLKWAQQSQLNVTEVLPTFGKFLGPMMHEARSKL

SEQ ID NO: 820 - protein, 453 aa, Bizionia argentinensis
MELFKKIKQITHLMKNIDFAELGEISEKIDLPKIMKSVGELDDVQLKGLMKMLTEKAKKGQHKLPPIDGDFYDYDLKLTQEQREIQLKVRSFMETEIQPIANHYWNKAEFPMDIIPKLAALNICGVTYDGYGCPNMPFLMEGIIAEELARVDVSISTFFGVHSGLAMGSIYLCGSEEQKQEWLPKMQKMEAIGAFGLTEPNVGSGVAGGMETTCEKVGDEWVLNGQKKWIGNATFADVIIIWARDIEDNQAKGFLLRKGNPDYKAEKIENKMALRTVQNALITLTDCKIPESDRLQKANSFKDTAKVLRMTRAGVAWQALGCARGAYESALKYTKKREQFGKPIAKFQLIQNHLVEMLANLTAMKAMVYRLSELQDQGLLTDEHASLAKVFCSMRTRDVVSRAREVMGGNGILLEYDVARFVADAEAIYSYEGTKEINSLIVGRAITGYSAFV

SEQ ID NO: 821 - protein, 664 aa, Nasonia vitripennis
MNEELRRERQRCSFEPLELTHLLDGTPEKTAQRRERENFFLSDPELTDKVPAKYLSHKEIYEEAVRKGCIILKKVRELQSMGKGDMEVFTQVLGGTLGSAILKDGNPLTLHWVMFIPAIMGQGTVEQQGYWIAKAWSCSIIGTYAQTELGHGTFIRGLETTATYDPVTREFILNSPTLTSYKWWPGGLGQTANYAVVVAQLYTNGECKGIHPFIVQLRDEETHEPLPGIKIGEIGTKLGMNATNNGFLGFDNVRIPREHMLMKNSKVLADGTYVKAPSDKLTYGTMMFVRVVIVRDVAKYLSKASTIAIRYSVVRKQGQAKPDGPETQIIDYVTQQYKLFPPLAMCFALSWAADWIWEMYNNVTAELDQGELDRLPELHALACCLKAVASTDASAAVEQLRLSCGGHGYMDASNLPTTYGLVTAVCTYEGENTVLLLQTARYLIKAWKQAISGDTLPPTVKYLELLSRRVKQRPWKNTLTCIVRAHQSVAAGKIKQATDNMERRVRCGMALEDAWNDTSIELAQAADSHCRAFIVLRFVEAVRGLSSTVSKSLHDVLMQLCELYCVNSVLLRLGDFLRFSCLNNEDVPSLQKQLEEMLAAIRPNAVGIVDGFDIRDEILGSALGVYDGNVYQRLYDEAMKSPLNQESVNQSYHKYLKPFMKSNL

SEQ ID NO: 822 - protein, 453 aa, Bizionia argentinensis; identical to SEQ ID NO: 820

SEQ ID NO: 823 - protein, 401 aa, Corynebacterium lipophiloflavum
MADTPQFTEFQGIPLDPRTDYYRIFDDVDGADLEWWKKARDFCEFARPFVNDAWEKAEYNIPGAEEAARRGLIRDGIDIEGQPAMSIRAKRMIGMEASRLDASTATAFGVQAGLAMQSINSFGTDEQKAKYLGPMSRMEIRGAFALTEPDHGSDSIALETTAKRDGDDWVINGEKKWIGHGSVGHITVVYARMEDGKVGAFIVDQDQEGYEATTITGKGSLRGIPQAEIKLNNVRVSDDRRLPGCKSFRDTAKVLMSTRIGVAWSALGLAIDCYEKVLKYASERHQFGRPLIKNQIIQQRLADMLMDVTGMALYCKRLLELEESGEVTEQQAALAKVHNTRAARRVAANARDMFGGVGILLENDVIRHFTDIETLHTYEGTDTMQSLIVGKSITGVGAFTG

SEQ ID NO: 824 - protein, 688 aa, Sporisorium reilianum
MAPPRYIQLPEGLKPAGVSGSELLAYERSKASFDSKAMAEYIHGKDFLELQERLVNLLSSDPVFDKTSDAYYGRADKFRRAMLKDKRLAQLAAEHGWSQTETAMAEKLADLPGPMGLHKSMFLTTLYNQGSDEQRKVFYEPASKYHIIGCYAQTELGHGSNVQGIETTATWIAESQEWEIHSPTLTASKWWIGGLGRTADHAVVMAQLTIKNKSYGPHPFVVPIRDVKTREVLPGRTIGDIGPKAGYNTTDNGFMLFEHVRIPHFNLLARFSKVEPETGKYLPPPNAKLAYGTLTWVRANIVRDASTVLMRAVTVAIRYCAVRRQFADRDAPKFGQDGKPLETQVLDYTMVQIRLLPILAQAFAFHYTSRFMFELYEQNQANIESGDLSLLADTHASSSGLKSLTTLYASDAIEVCRKACGGHGYSMASGLPDFYANYLPNATWEGDSYMLSQQCTRYLFKTMRAIKSGRGKVDKNITTDYMLRYLDNKNEKATIQFSGDLYDPLFFMRAFGHRAAYLTEQTLALRDDAKRSWNSLLMELYRCSKAHSQYLLVRNFGMAILKDEKLNSQPALRQIVQKIFLLWACHTMESESADFLASGYINGQQFHLLGSKVQELMAELRPNAVALVDSFAVPDYLLNSALGRSDGNVYEALFDFALREPLNSAKWNVDVADLETTDFDSDLPRAKL

SEQ ID NO: 825 - protein, 743 aa, Sporisorium reilianum
MSRPDPKSTTFQPLNEPTGDWPAAKVTLPIPMGEVAARTSQDIAAARAAADFDPERIEDTLRDARIDNESRKKVMTTLSRDPIFGNWKKRMVHMNREQQMRQSHFACRRLLELGEKHEWTTHEIIEAALTLDLQSPITIHWVAFVPVIFGQGNAQQIERWGQKAMNHEILGCYMQTELGHGTNVQQLETTCTYDEASDSFVLHSPTLTSTKWWAGGLGTTATHGVVQAQLIIHGKRYGPHLFFTQLRDMDTGKLLDGIVAGDIGPKTYGAFGGLDNGWARFNQFKIPHDHMLSKHAQVKKGGEYIKPPSDKLSYGGMIFIRSQMIDRTGWMLSRGVTIATRYALVRRQFRDPSSKDINDVERSVLSYPSTARRILPLLAKAYAYILAGRRMRTLYEDMAQQLEEGNTELLADVHVASSSLKAYCTKQALDGIEECRQALGGHGFSAYAGFTSVFPEQAPAVTYEGDNIVLASQVGRAMLKISGELESNPATKVAATSGFLKAISQQGAIPFTQPKSAADWYSPQVYSAALGLRAAQLVVDLRAEIKSGRAFVDLSFECIEVAKSHAEFVVDLWFGEGIRDDAERLGAKECQWLNKLVTLHALTALSRNITPLVLPASAGRSLAGYATNQAILTPDSVILLEKAIRDLVADILPQVIGLSDGFGWLDWELGSSLGRKDGRVYEQLMADAEANPLNHPGAVPDLQGIDKVGVYKYGSPAIGKGVPDWYTSEIGTLLKAAAKRSNL

SEQ ID NO: 826 - protein, 717 aa, Sporisorium reilianum
MASTRPAPETLQPRDMQQERQACSFDVDAMSCILPGSKAERDNARWLLSLLKDDADRTFDKEDRVFQSRNERFFKGQKVALRYFEIRNRHGLDKKDADLLRLYTDEYLPIQVAESMAQPTLMRQASQEQWAEWGPMVRSGRWLGCYMQTELAHGSNLSALRTTATLDLDKDEWVINTPEPSAGKVWIGGSGLTATYGVVMANLIIKGKSYGMHPFLVHLRSLRDHTLLPGRRIMEMGCKLGAPAMDNGYICFDSVRIPRNNLLQRFQTVSKDGVYQKRNADAQVMTRGTMTLVRVGLVEIAAHHLARAATIAIRYAVVRRQGTSATKPDQLEPKILDYASVQTRVLTALSSAYAITFVSQHLRRMYNDMIADIESKGNSGLLPIVHGYSSVLKAVCTNESLAGIERCRRSMGGHGFSQASGFDFERNLPNAGLIYEGENSMLLAGPSANFLVKQLNETRKRNGKAVRPELAYLEHIAGGSDASGAISRRAQGVSVQQIDEPTALLDLLGYRAALLVDRLAKHRASTQSADGVSKHIDTNLAVRASNAHGSYLLAYAFHDLVQQLKTSSPAATQKRFGVAVQSSHISALDNLLRFYLLQNCILSQDTLGDFLELQLLTSAQLDKLRHSAASLLSGPVRRDALGLVESFDMDDWYLCSPLGSSDGRAYERMIEWMKLEPLNHTGERGARDANGVVKGYHDGIGRLIRGEAVQFTERAKL

SEQ ID NO: 827 - protein, 718 aa, Sporisorium reilianum
MSSWTDSLTMDTMAKERANPPFDVRKMAIEHHGSEADLVKKEKFMLEASRDPVFYSGDIYDLTKEQIRERTMQRIQRLAHYVTSEPVDDFQKRMELMSLLDPGLWTRLGVHYGLFLGAIRSGATPNQFSYWMEKGVIACQGMFGCFGMTELAHGSNVAGLETTAHFDATTDEFVIHTPNLGATKWWIGGAAQTATHCSVFAQLIVKGKRYGTKTFIVPLRDPKSFQLLPGINIGDIGKKMGRDGIDNGYIQFTNVRIPRAYMLMKHTQVTRDGEVREPPLQQLTYGALLQGRTAMVADAANTAKKALTISVRYAAARRQFKSDAKAQLETQIIDYPIHQRRLMPLVAQAVAFGYTALELQRLFEETSQALEALEPGDPNLDATIERLKETHSTSAGLKAFCTWATLETIDRSRQACGGHGYSSYNGFANMYSDFAVHCTWEGDNTILALQSGRFLISAFQDALDGKKQVSQGTRYLNDLDKVLSAKCESDDALDTLDGIDRGWATVAAHAVKKASEDYQACLKAGRSREQAFEDCSQVRFVAASVHTSGYIFRQFRSAVERVEKGSDGVREHLELLAKFYGLWQMEEKAAFFLRSGWLTPAQLDFASAKVTEYCAKTRSFAIPLIDSFAISDHVLNSPIGRYDGDIYREYFRMVRRNNPQLKEHPYFERLIRPFIERQMPDAEDFDEAIGIDDEIEEIKQDREEAEAEAKAQAAENKK

SEQ ID NO: 828 - protein, 707 aa, Bombus terrestris
MLNISLFWYYISDTNLHISTRGINKLLGHKCRILKFNVIHTEKCKYDTYESHCGINKEKTEYIACRRQYNHLQFMTLLCKQYFLGDLVLKENVAMKYKKSHKEIYEDTLRICCKVLHKIRELQRSGKADIDLVLNIFGGLLGTALFEDGNPLLLHYAMFLPALMGQANSEQQAYWINRAWTGDVIGTYAQTELGHGTFLRGLETTATYDPETKEFVLNSPTLTSYKWWPGGLGHTANHAIVVAQLYTQGECRGIHTFVVQLRDVETHEPLKNIIIGEIGAKLGMNGVNNGFLGFHDFRIPRENMLMKNSKVLEDGTYVKSANDKLTYGTMVFVRVMLLQDVLHYLSKAVTIAVRYSVVRRQGQINAEQPEVQILDYVTQQYKIFPHIATCFAIKVTAMWLLDMYKTVQSQLHQADYEKLPELHSLSCCLKAIVSADTAAGIEQLRLSCGGYGYMTASNLPGLYGLATAVCTYEGENTVLHLQTARYLIKSWKQAMDGEPLPESVEYLNEAAKGVKHCRWSNDLECLIDAYDAVAAGFIRLAAEHLDRRIHDGVPTEEAWNQTSIELTQCSEAHARGFIAKTFAKAIKQLNSKSEEFRQVMFQLCELYIVYWALRNVGNFLRFSSMQEEHVQTLHSRLEYLLMTIRRNAVGIVDGFDFNDHILCSALGAYDGNVYERLFQEAMKSPLNRETVNMSFEKYLKPFLKSNL

SEQ ID NO: 829 - protein, 670 aa, Bombus terrestris
MTQQRKTVHKDLQYERNRCTFDPVEVTYFLDGSPEKTKQRRDQEQYISDVLVLKENMSMRYKSYKEVYEDSLRIARAVLSKIKKLQLSKIEEYEFVHGIFSERLGSALFQDGNPLSLHYGMFLPTLMGQANSEQQAYWINRAWTGDVIGTYAQTELGHGTFLRGLETTATYDPETKEFVLNSPTLTSYKWWPGGLGHTANHAIVVAQLYTQGECRGIHPFVVQLRDVETHEPLKNIIIGEIGAKLGMNGVNNGFLGFRNYRIPRKNMLMKNSKVLEDGTYAKSENDKLTYGTMVFVRVMLLQDLLHYLSKAVTIAVRYSVVRRQGQINAEQPEVQILDYVTQQYKIFPHIATCFAIKVTAIWLLDMYKTVQSQLHQADYKKLPELHSLSCCLKAVVSADTAAGIEQLRLSCGGHGYMTASNLPVLYGFATAVCTYEGENTVLLLQTARYLVKSWKQAMGGKPLPESVEYLNEAAKGVKHCRWSNDLECLIDAYNAVAAGSIRLAAEHLDRRIRDGVPTAEAWNQTSIELTQCAEAHARVFIVKTFANDIKQLNSKSEEFRQVMFQLCELYIVYWALRNVGNFLRFSSMQEEHVQTLHSRLEYLLMTIRRNAVGIVDGFDFDDHILCSALGAYDGNVYERLFQEAMKSPLNRETVNIPFEKYLKPFLKCNL

SEQ ID NO: 830 - protein, 670 aa, Bombus terrestris
MKQQKMNMNKDLQYERSRCTFDPVEVTYLFDGSPEKTKRRRDQEQYFLDDLTLKENVAMKYKSHKEIYEDSLRIACNVLHKVRELQSSGKEDIDLLLHIFGARLGSALFEGGNPLVLHYAMFLPSILGQANSEQQAYWINRAWAGDVIGTYAQTELGHGTFLRGLETTATYDPETKEFVLNSPTLTSYKWWPGGLGHTANHAIVVAQLYTQGECRGIHPFVVQLRDVETHEPLKGIIIGEIGTKMGMNGVNNGFLGFHDFRIPRENMLMKNSKVLEDGTYVKSANDKLTYGTMVFVRVMLLQDLLHYLSKAVTIAVRYSVVRRQGQINAEQPEVQILDYVTQQYKIFPHIATCFAIKVTASWVWDMYNTVQSQLHHSDYEKLPELHSLSCCLKAVVSADTAAGIEQLRLSCGGHGYMTASNLPGLYGLATAVCTYEGENTVLLLQTARYLVKSWKQAMDGEPLPESVEYLNEAAKGVKHLRWSNDLECLIDAYNAVAAGSIRLAAEHLDRRIRDGVPTEEAWNQTSIELTQCAEAHARVFIVKTFAEAIKQLNSKSEEFRQVMFQLCELYIVYWALKNVGNFLRFSSMQEEHVQTLHSRLEYLLMTIRRNAVGIVDGFDFDDHILCSALGAYDGNVYERLFQEAMKSPLNRETVNMSFEKYLKPFLKSNL

SEQ ID NO: 831 - protein, 670 aa, Bombus terrestris; identical to SEQ ID NO: 830

SEQ ID NO: 832 - protein, 609 aa, Amphimedon queenslandica
LSTEESFDSAVRKNVHYIELLKSGKLKESNAKAYFKSAIDDNFPTGVHELMFVPTIEGQGNEEQKKKWLKISRNFDIIGCYAQTELGHGTFIRGLETIATYDPSTEEFVMNSPTLTSMKWWPGSVGHTATHAIVVARLITKGKDEGIHLFIVQIRSLEDHNPLPGIKVGDIGPKFGYFGTDNGFLHMTNVRIPRDHMLMKYAQVSRDGTYSKPPAEADKISYAVMVYVRALIVDHSAETLARAITIAIRYSVVRRQTQNRPGEPETQVLDYQTQQFKLFPLLASAYAIKFAGHYMTKLYTEVTEEISEGKLRSLPELHATSAGLKAFCTELCCSGIELCRLSCGGHGYSAASGLPQLYADYSSSQTYEGENTVMLLQTARYIFKVCKQNMPQAQLPSNVAYLAADYPKYKESPVSDPKHFNDPHILLEAYRQRVIRLVAVALERYSKSIATGLDSVAAWNNSSVDWTMAARAHCHYLVLKAFHSSIDAAKVCEANFNIMRVLCCLFGLHGIIQYSGEFCLDGYMNSEQIEMAKNQLYFLLKEVRYEAVPLVDAFDIHDDILNSSLGRYDGDVYRHLYEWALRAPRNKKEVHDNYEKYLKPLLKNTKSKL

SEQ ID NO: 833 - protein, 712 aa, Amphimedon queenslandica
MASSLEDYRRRASFSVPRMQDVLIGREILDFKRKVCDTLKADPLFNPKPLHYYSLDKEREMTFKRVKRLLEYNFLPEEAILDNPMLISGLNSVLISYDLGTLAVNSLHRDVFAGAIRGLGTAKHYHYVDDAYSMRIFGCFALTELSHGSDTRRMRTTATYDPKTQEFILHTPDIEAAKCWSGNLGKLATHAVVYAQLYTPDGACHGLHPFIVPVRDPSTHATYPGLTIGDMGRKIGQNGVSNGYMLFDNYHIPRDNLLNKSADVTPQGNYETPYKSASKRLGVSLGALSSGRVGIAGMAGFNMGKALTIAIRYAAVRKQFGPSADVEVPLLEYQLHQYRLFPYLAATYCFQHFNNWFFEQFVMFTGALIIGDKSDRQAELGREIHALSCAVKSLMGFVARDCIQECREACGGHGYLTLSGLGVIHDDHEPNLTYEGDNNVILQQTANYLLGMMREGRDASSPLGSVNFMTDLPNVLRRRYVPSNTLTFTLSDVLHSYEWLVCYLLVESSQKVRQEEFKTKSDFWAKENSQVYYCHTLSLAFTEYFILKTFNEFVCEAEREREGGNEVCNVLKLLGLLYGLWSLQKHSAWLCQGEYFTQPSHIQSMRNNILLICEKIKNDAVSLIDAIAPPDWMLGPLGQSDGDVYRHLYNAMSSEPGANEKPNWWKEIATPPQVGANDWMRGERGIGKEISQVSTFGIIFLDKSYFLCLVCW

SEQ ID NO: 834 - protein, 666 aa, Amphimedon queenslandica
MATARSAVPELRVERERSRLDLEQLTNFLDGGEMFTERRRELVKLVVEDPVYKRDDKYFLSREEAFESSMRKSIHYIEALKSGKIKGRPDAYFYRTAINDDLPTVLHDSMFLPTIEGQCTEEQKEKWLKLASNYSIIGAYAQTELGHGTFIRGLETTATYDPLTEEFVLNSPTLTSMKWWPGTLGHTATHAVVVARLITKGKDEGIHLFIVQLRSLEDHRPLPGIKIGDIGPKFGYFGMDNGFLHMTNVRIPRDQMLMKYAQVSRDGTYSKPPTDKITYGTMVFVRAGIVVQSASILARAVTIAIRYSVVRRQTQNRPGEPETQVLDYQTQQFKLFPLLASAYAMKFASQYMLKLYVGITGEIAEGNLESLPELHATSAGLKALCSEISSNGVELCRLCCGGHGYSAASGLPQLYVDYSPAQTYEGENTVMLLQTARYLLKISRQKVPQAQLPNNVAYLGVDYPKYKESPVLTPKQFNDPHILLEAYRQRVIRLVAVALRRYMNGIDSGLDAVAAWNNSSVDWTVAARAHCHYLVLKAFQSSIDTAEMCEANLSIMRVLCCLFGLFGIMQYSGEFCLDGYMNSDQIEMAKNQLYSLLKEVRYEAVPLVDAFDIHDDILNSCLGRYDGDVYRHLYQWALRAPRNKKEVHDTYEKYLRPLLKKTKSKL

SEQ ID NO: 835 - protein, 719 aa, Leishmania infantum; identical to SEQ ID NO: 783

SEQ ID NO: 836 - protein, 702 aa, Cryptococcus gattii
MAFPRPKPTTVETLAMERANPPFNVRKLSIKMHGSEKALVLKEKFMAEIARHPAFKLSDIHDLSKDELRERTMEKFASMVYFVTNESLEVFTLRMQLIGIADPSFWTRFGVAYGLFLGALRSGATPNQLSYWIDRGVLGLNGVIGCFAMTELAHGSNVAGLETTATFDRETDEFIIHTPHLGATKWWIGGAASTATHAAVFAQMIVDGKQYGVKTFVTQLRDTKTFQLLPGITIGDIGKKMGRDGIDNGYIQFTYVRVPRAHMLMRHTQVSRDGVVTEPPLAQLTYGALLGGRTSMVTDSSNSAKKALTVAVRYAAVRRQFAIGTNQLETQILDYPIHQRRLMPLVAQAIAIGFTGLKLTKMYEDMTQSLDTMDPSDLKETHATSAGLKAFCTWACLDTIDKCRQSCGGHGYSAYSNFPTMYADFAVQCTWEGDNTILSLQAGRSLVGAWGAAIKGKRLVSGVAYLNDRSILTAKSDSSLTLSDVKRAWNCVAANVIKKAAEEYVSHFKAGKSKEVAMEMCSQSRFIAAKVHTVGYIFTMFKEAVEEMEDSAETEVLRTVAKLYGLWQIEEQQGYFLKYGYFTAEQMDNVQTSVDALCAEIRVIAVPLVDAFALSDHILNSPLGRYDGSVYESYFSQVQAANPLPKEHPYFTRLIKPLLERQNAEMEDPEQVMGLDNELEEMEAERREAAKGKEDKVRKEDY

SEQ ID NO: 837 - protein, 702 aa, Cryptococcus gattii; identical to SEQ ID NO: 836

SEQ ID NO: 838 - protein, 691 aa, Equus caballus
MGSPVHRVSMGDTWSRQVHPDIESERYKQTFDVERLTNILDGGAQDTALRRKVESIIHSDPEFSLKDNYFLTQSECYEAAVEKKFHLQMLAQRQGWAEDSREAYYAYRLLNHSVSPLQNPFWKSGLSVCSISFLKALRSLGSEEQIAKWVPVCNKFQIIGTYAQTELGHGTYLQGLETEATYDAATQEFVVHSPTMTAIKWWPGDLGRSATHALVQAQLICSGARQGMHAFIVPIRSLQDHTPLPGITVGDIGPKMGLDHVDNGFLQLDHVRVPRENMLSRFAQVLPDGTYIKLGTAQSNYLSMVVTRVELLPGITAELQKACVIAIRYSIIRHQSRLRPSEPEAKILDYQTQQQKLLPQLATAYAFHFLARSLLEFLHDSHDAILDRDFSLLPELHALSAGLKAMVSDFCTYGAELCRRACGGHGYSKLSGLPSLVTKVTASCTFEGENTVLYLQMARFLVKSYQRTQVSLGPTLQRSLPQSVAYLTAPDLARCPAQRAADFFHPELYTTAWAHVAARLTKDSVHHIQTLMRSGADEHEAWNRTTVIHLQAAKAHCYYVTVKSFTEALEKLESEPAVRQVLRRLCDLYALHGILTNTGDFLHDGFLSGAQVDMARTAYLDLLLLVRKDAILLTDAFDFTDQCLNSALGCYDGNVYERLFDWAQKSPSNTQENPAYEKYIRPLLQSCRSKL

SEQ ID NO: 839 - protein, 1025 aa, Pan troglodytes
MASTVEGGDTALLPEFPRGPLDAYRARASFSWKELALFTEGEDMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGVSLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVQDGACFRSPLKSVDFLDAYPGILDQKFEVSSVADCLDSADELKDAHLPPYTLPLAFPSHRIKGVRGHLAWSLSTKQPLPAALVPGLLLSLGPPSHLTSPVCKAAYHREQLKAAATPPSRHRLTQQYLVNVFTLPPKHLFAQKRRAERGPDALSRRARTDAVDVIAAPERVSLSVSSPAGYFLVHTAKNRTTAVAEASVEPGPVRLPGAFPCPHRQHRHQEASASLLAFSWSLRWVTASDVLADAAEATRIPPHWRPGACENVQPSHSGAHSSGGAVFLWPPGCWNSVYGQLTLAASSLRSACHSPSWGQFGSSGGAAEVVQKIPLEQSPAPPCLGGSWWGQWGSRMCLGATLFREPIPRACVLPGDYWPYVDLSWKNSAVSCRQILGTEMPLSTIELPSLVLPVSHGRPLALAFVELTVVQRFHEHVHQPCVPPSLRAVLGRLSALYALWSLSRHTALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 840 - protein, 681 aa, Pan troglodytes
MGSPVHRVSLGDTWSRQMHPDIESERYMQSFDVERLTNILDGGAQNTALRRKVESIIHSYPEFSCKDNYFMTQNERYKAAMQRAFHIRLIARRLGWLEDGRELGYAYRALSGDVALNIHRVFVRALRSLGSEEQIAKWDPLCKNIQIIATYAQTELGHGTYLQGLETEATYDAATQEFVIHSPTLTATKWWPGDLGRSATHALVQAQLICSGARQGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLLASCTYEGENTVLYLQVARFLVKSYLQTQMSPGSTPQRSLPPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLCLIRKDAILLTDAFDFTDQCLNSALGCYDGNVYERLFQWAQKSPTNTQENPAYEEYIRPLLQSWRSKL

SEQ ID NO: 841 - protein, 681 aa, Nomascus leucogenys
MGSPVHRVSLGDTWSRQMHPDIESERYMQSFDVEQLTNILDGGAQNTALRRKVESIIHSYPEFSCKDNYFMTQNERYEAAMRRAFHIRLIARRLGWLEDGRELGYAYRALSGDVALNIHRVFLRALRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIVGDIGPKMDFDQTDNGFLQLNHVRVPRENMLSRFAQVLPDGTYVKLGTTQSNYLPMVVVRVELLSGEILPILQKACVIAMRYSVIRRQSRLRPSDPEAKVLDYQTQQQKLFPQLAISYAFHFLAVSLLEFFQHSYTAILNRDFSFLPELHALSTGMKAMMSEFCIQGAEMCRRACGGHGYSKLSGLPSLVTKLSASCTYEGENTVLYLQVARFLVKSYLQTQMSPGSTPQRSLPPSVAYLTAADLARCPAQRAADFLCPKLYTTAWAHVAARLIKDSVQHLQTLTQSGADQHEAWNQTTVIHLQAAKAHCYYITVKGFTEALEKLENEPAIQQVLQRLCDLHAIHGILTNSGDFLHDAFLSGAQVDMARTAYLDLLRQIRKDAILLTDAFDFTDQCLNSALGCYDGNVYERLFQWAQKSPTNTQENPAYEEYIRPLLQSWRSKL

SEQ ID NO: 842 - protein, 713 aa, Acromyrmex echinatior
  MOD_RES (662)..(708): Any amino acid
MSTANNLIKDLPSGPLDVYRKRATFDWKSFKLSLEGEDSVRMQLKLWQLIKTHPVFQKSTYPKSLDEIRKRVNSQIQVLCENNIDPISDINSVLYLFQYDGSISIRISITRGMVPGAIFALGTNQHHQLLAEFSTGNYIGWFVLTEIAHGTNAKGIQTKATYDVATKSFILHTSDFEAAKCWAGNLGKCATHALIFAQLITSDGVNRGLHVFIVPIRDLQTHLPFPGVTVGDMGEKIGLNGIDNGFIMFDNYSIPRNCLLNRTADVTEDGKYVLALKNERKRYGSSLGALSGGRVTITGICYHYMVIALTIAIRYCAVRKQFGPTEDNELPVIEYQTQQWRIIPHLAATYAVKIFSSALRKDFDELQMNRLSKDEDSTADLGMEIHALSSATKPLCSWISRDMIQDCRESCGGHGYLKMSRLGEIRADNDANCTYEGENNVLIQQASNWLLNQWANVIKGQAVPSPLNSADFLVNAEQILNNKFNQTTVEDVLKPKNLLLIFKWLVCYYLKKTYQRMKEFQSDGMSDFDVKNNIQTFLARTLSLVYAEHAVMLYFNRCLQDPKWKTNEREVLTKLCSLFGAITLEKRLGDLYSGGYASPNSNIDNFLREGIIMLCRDLVDNAVALVDVLAPPDFILNSALGMSDGEVYKHIKEWIFKDKENXXXXXXXXXXXXXXXXXXXXXXXXXXXXXXXXXXXXXXXXXXXXXXXINISC

SEQ ID NO: 843 - protein, 666 aa, Acromyrmex echinatior
MTTINMDLRRERERCNFDPMELTNFWDGSKAKTLHRHELEDFFLSDPILHDRIPAKYKSHKEIYEEAIMKGCRVLQKVQQLHDSGKGSMDVFSQILGGMLGSAILKDGNPLTLHYVMFIPAIMGQGTVEQQGYWISRAWSCNIIGTYAQTELGHGTFIRGLETTATYDPETKEFVLNSPTLTSYKWWPGGLGHTANYAIVVAQLYTKGECRGIHAFIVQLRDENTHEPLPGIKIGEIGTKLGMNATNNGFLGFENVRIPREHMLMKNSQVLEDGTYVKAPSDKLTYGTMMFVRVVLVRDISNYLSKAVTIAIRYSAVRRQSQIKPDEPESQIMDYVTQQYKLFPNLAACFAFRMCADWIWEMYNNVTAELDQGELERLPELHALACCLKAVASSDGATGIEQLRLACGGHGYMDASNLPATYGLVTATCTYEGENTVLLLQTARYLVKAWRQAIGGEPLPPTVGYLAVLSRGVKQHPWKNTLSCIVQAHQAVAAGKIRLATENMDRRIRSGTSPEDAWNKTSIELAHCAESHCRAFLVMRFVENVRELTSVSKQLREVLMQLCELYSIYWVLQRLGDFLRFSCLNNEDVPALQARFEEMLAAIRPNAVGIVDGFNIRDEILASALGAYDGNVYQRLFDEAMKSPLNQESVNQSFHKYLKPFLKSNL

SEQ ID NO: 844 - protein, 699 aa, Oryza sativa
MATAASRSGRRRGGGDDEDDRTAAMRRLRVLSLHLQDPSPSSEAGLAPAACAAAGRRRATGGADAAAALAAYLRGRHRDTQARVFEFFLSRPDLQTPVEMSTAAHRELCFRQLCALVREAGVRPLSLMANDPAEYFAVMEAAGGADISLGVKLGVQYSLWGGSIINLGTKKHRDRFFDGIDNLDYPGCFAMTELHHGSNVQALQTTATFDPVTDEFIINTPNDGAIKWWIGNAALHGKFATVFARLILPLQGKGGDPADMGIHAFIVPIRDLDTNAVLPGIEINDCGHKIGLNGVDNGALRFRSVRIPRDNLLNRFGDVSRDGKYTSSLPTINKRFAATLGELVGGRVGIAYSSVGILKVSVTIAVRYALLRQQFGPPKKPEISVLDYQSHQHKLMPMLASSYAFHFATRYLVDKYSEMKKTNDEDVMADVHVLSSGLKAYITSYTAKSISVCRESCGGHGYAAVNRFGALRNDHDIFQTFEGDNTVLLQQVAGDLLKQYQEKFKGGTLSATWNYLRDSMGTYLSQPNPVTSRWEGEDHLRDPNFQLDAFRYRTSRLLHSVAARLQKHSKTLGGFGAWNRCLNHLLTLAESHIESVILAKFIEAVKRCPDEKTRELLKLVCDLYALDRIWKDIGTYRNVDYVAPNKAKAIHKLADYLSYQVRLVAQELVDAFDLPDLIIRAPIGMQSEAYAQYTQHVGF

SEQ ID NO: 845 - protein, 743 aa, Puccinia graminis; identical to SEQ ID NO: 188

SEQ ID NO: 846 - protein, 696 aa, Streptomyces griseoaurantiacus
MPPPPAGGPEPGSPSAPGATTTAERDVTQDATQDATRDASSDVSRDADALPGAGTATADARADLTRLLFAGPDPDRTHGTWRRLLGGPAFTYRPGLAPAERAALSYERLRLLNDVLTAEDPAAPARFAADPHRLAALHEWIGPVDGGLTTLASIHYNLFLGSLVDHDLAHDHDLSAFTAMRRVGTFLCTELEHGNDVAAMETVAVLDRERGGFDLHTPTPGAAKFMPNTSLTGGPKTAVVAARLLVDGEDQGIFLFLTPLSDEHGHLPGIRVRRLPDRTGTPVDHCLTSFTHVRLPHEALLQGEHGRLTPEGSLTSVLGNRRKRFLRSIGRVTMGKLCMSAGTLGMARAALTIAVRHAHSRRISGPRAGERLPVAAHRSHHGRLLDALATAYAMTFLHREVVDRFAGLGDGEGDRTDWAAGAAGAGREDRADGTSREDRADGTGRGDREDRGDREEIERLAAVAKGWITWQARDIAIECRERCGAQGLFPANGISDLPANIEGGITAEGDNLVIWVKAASEMVFGHTVPLPPARTAPGDVDDPAFLRDLLTHAESLWQKRARTALREGPSGDPTGRWNATSTPALEMVEAHACRTAADAFLTAADRATDPTARALLRALCRVFLLRRLREHTGDLLAEGLLTPDQVRALPRALDTATAEAAPHLPTLAEAFDLPPDLLATIPLASGAGITRTLEQP

SEQ ID NO: 847 - protein, 696 aa, Streptomyces griseoaurantiacus; identical to SEQ ID NO: 846

SEQ ID NO: 848 - protein, 433 aa, Dictyostelium fasciculatum
MEENNQVIRKSISRIESISNHLQVVNVAVTEQQQQQQQVKDQVNVGGSVDYYGLNDLLNDKERLIRKQAKQFAESKILPIANKYYEKAEFPFELIPLLKQLKWAGGNIKGYQCPGMTATELGMIAMEFAKVSADIATFYSILQTISMLPIYYCGSELQKLKYLPKMAAMDSIGCFGLTEPLAGSDASGLLCEARKVDNGWILNGEKRWIGNAPFADIIIVWARDTESKKIKGFIVEKGTPGLNVETINNKISLRMVQNGHIYFKECLISDDQRLPNANDFNSGPGKCLFLTRIMAAWISLGVAANAYESCFKYVQSRKQFGTPLSKFQLIQERLVKMLGNLQAMTLMCLRVSHLFDQQKLSYGQIGLLKAYCTSHGREIVSLARECVGGNGIVTDYGVARSFVDMEAIHTFEGSYDINTLIAAREITGHSSFR

SEQ ID NO: 849 - protein, 688 aa, Dictyostelium fasciculatum
MEDIQQQEQHTKSLDRIQTISQHLTSNNVAAVSNSTSSSSSNASRDVAAATAILKQSVLDQPKIDKLADFLLGHPSEELIATRKQIFDILKDPIYKPNLYASIPEQRELTLQRLKKLADARILKMDEIITNFKKFALFQESLVYCDMSLTVKSSVQWGLFAGSLKCLGSDRHKKYFYDIDGGQILGCFALTELGHGSNVRGVETRADYDTETKEFIMTTPTTTAQKIWIGNAAQHGTMATVFANLYVKGENYGLHPFLVPIRDPSTGTLMPGVRAADNGPKMGLNGVDNGRLWFDSVRVPYENLLNKFGDITPEGEYSTPIKNPNVRFNSMLEALIGGRVTVSAMALNASKMGLAIAIKYAFQRRQFGAPTEDLLIDYLTHQRRLFPLLAATYAYQPSVHHIISRFQAHEEKEARDVFLMACGFKAVTTWHRAKTLQICREACGGMGFAASNKIGLLRNDADVDLTYEGDNTVLLQAVAKSLLVEFKSYFTGSKRLTGMLNYTYSKGHIGIFLRNQNFFVKRLHTEAHLLDPDMLLDAFIYREFKLLRMLVKSLRSKTSGPDKMPAAKAWNQSLDLVMHLGTAYVERVTIEKFLESIANEEESIRPVLRLLCILFALTKIEEDMGWFLSNKYFAPVKAKAIQNSINKVCGMVREHAIPLVKAFNIPDHLMTAPIANDYVEHFSNPNNY

SEQ ID NO: 850 - protein, 665 aa, Apis mellifera
  MOD_RES (32)..(37): Any amino acid
MTVNKDLEYERSKCTFQPIELTYFFDGSPEKXXXXXXSEKYFLSDPELQNNIPVKYKSHKEIYEDAVRKVCRVLYKLRKLQETGKAGMDDFTHIFGAKLGSAILKDGNPLVLHYAMFLPSIMGQGTTKQQEYWITRSWNGDVIGTYAQTELGHGTFIRGLETTAIYDSKTKEFILNSPTLTSYKWWPGGLGHTANHAIVVAQLYTQGECKGIHPFIVQLRDVNTHEPLPGIKIGEIGIKLGMNGTNNGFLGFENFRIPRENMLMKNSKVLEDGTYVKALNDKLTYGTMVFVRVVLVYDIVTYLSKAVTISIRYSAVRRQGQINSEKPEVQILDYVTQQYKIFPHLATCFAFKITANWIWDMYNVINVEMDHGELDRLPELHALSCCLKAVASADAATGVEQVRLSCGGHGYMDASNLPATYGLVTAICTYEGENTVLLLQTARYLIKVWKQAVNGQKLPVTVQYLSNAAKKIQQRPWSNNLDYIAEAYYTVAAGIIRIATENMDRRIHNGISAEDAWNQTSIELAYCAEAHCRAFIVKTFIEGVKGISSISDQLKQVLFQLCELYVIYWVLQKRGDFLQFCSMKQNDVQILQSRLEELLMAIRPNAVGIVDGFDICDEILNSALGAYDGNVYERLYAEAMKSPLNHKSVNESFEKYLKPFLKSNL

SEQ ID NO: 851 - protein, 671 aa, Acyrthosiphon pisum
MVELQTVNEDLRNERAKCTFNQEELTNFIDGGVENTNIRRNIANFFFSDPRFKDEVPVEYLSHQEHYEQSIRKACIFYEKMKEWEEISNSNMMEIYTVIWTSGIDTAILKQSIPFAVHTIMFLPSLVGQGTQEQKEEWVGRAFKYTILGTYAQTELGHGTFIRGLETTCTYDPDNEEFILNSPTLTSYKWWPGGLGHSCNYAIVLAQLYTQGIHRGIHPFIVQLRDSETWMPMPGIKVGEIGSKMGMNSANNGYLAFNNVRLPRMHMLMKNSKVHKDGTYEKSPHEKLTYGTMILVRVLIVKSLVTSYLMKSATIAIRYSAIRRQSELKPGEREPQILDYQTQQYKLFPVIASSLVYKFAAKWLWDKYSAVTSQLERGDLVQLPELHAMACCLKAVGTADASTSVTSCRLACGGHGYMNCSNLPNIYSLSTATEIYEGENTVLLLQTARFLMKSYETVQLGNYVSTSETLSYLKIYNSLKRSPWTTTLDCMASAFFQVAGSKIDDCYFTMKRLIDSGTPQEDAWNQTSIKLTQASEAHCRAFVISIYVKTLEANQFSPELMAVLTQLGELICAQWILNRLGDFLQHSNLKPNDVHSIQRLLEDCLERIRPNAVGLVDSFDIQDEILDSALGSYDGNVYERLLSEANKSPLNKEPVNRSFELYLKPFLKSNM

SEQ ID NO: 852 - protein, 699 aa, Arthroderma otae
MVSSPDWVKKLTPSGPQGSELLKHERDQSNVSVEKLAELLHTKEVLERQDRILSIIQNEEVFDKSQNHSLGRVDRIQRSLAKAKRLEQLKRQHNWSEDDFLMANSLISEPTPYGLHASMFLVTLRNQGTPEQHRLFLEPAERYEIIGCYAQTELGHGSNVRGLETTATWNPDDKTFIIHSPALTASKWWIGSLGRTANHAVVMAQLYINGKNYGPHPFVVQIRDFKTHKPLENVHVGDIGPKFGYNTMDNGFLLFNKVKIPHVNMLARFSRVDPNTNKYVRPASPSLIYGTLTWVRSTIVLQSGGVLARGVTIATRYCAVRRQFQDRDAPADEPGENQVLNYKMVQIRLLPLLAATFALHFTGRGMMALYNHNQAIMKKSASNQPSGRGAGPEELNPGADLLADLHATSCGLKALGSTIAAEGLEVCRRACGGHGYSSYSGIGSWYSDYLPTTTWEGDNYMLTQQVARYLLKSARSVFIGKPANNDTCTILQSYLSRRDTGAAFDILENDSDVVAAFAWRTAYLTFEALKHRDVEKRSWNNLLVDFWRLSTAHSQYLMVKNFYEAVFPSGSSAEAATSLGIDEPTLDVLRKLFRLHSLHTLERESADFFTSGAVTTRQIILTRTKAVMKLLDDIRPHAIRLVDSWMFPDWQLDSSLGRYDGKVYEDLFHRASEQNPLNELTFDPYPWNKALVKSDKSKL

SEQ ID NO: 853 - protein, 640 aa, Meleagris gallopavo
MCVRQSDFAVTGPWEEALVINDPDFQHEDLNFLSRSQRYEQAIRKSSLMVMKLREYGIADPEEIYWFKRTCLGNFIEPFGLHFSMFHKTIETQTTDAQKKKWLPLVRGVKIIGTYAQTEMGHGTHLRGLETTATYDPATQEFILNSPTVTSIKWWPGGLGKTSNHAIVLAQLYTQGQCKGLHAFIVPIRQLGTHEPLPGITVGDIGPKFGYDEMDNGYLKMDNFRIPRENMLMKYAQVEPDGTYVKPVSDKLTYGTMVFIRSLIVGDSARSLSRACTIAIRYSAVRHQSELKPGAPEPQILDYQTQQYKLFPLLATAYAFHFVGAYIKDTYHRISGDIHDGDLSELPELHALTAGLKAFTSWTANAGIEECRMACGGHGYSRCSGIPDIYVTFTPSCTYEGENTVMMLQTARFLVKSYNQVSSGQRVTGMVSYLNDLSRQRIQPQHVAGRTEAVRINDPVSLVEAYKARAARLVEAAAKNLQAELNHRKSKEDAWNRTSVDLVRASEAHCHYVIVKLFTAKLSEISNAAVCAVLTELCLLYALYGISRNAGDFLQAGILTDTQITQVNQRVKELLAVIRPNAVALVDSFDFHDVHLGSVLGRYDGNVYENMFEWAKKSPLNKTEVHESFHKHLKPMQSKL

SEQ ID NO: 854 - protein, 675 aa, Meleagris gallopavo
MALPDTTEDTQGFGLASVNPDLASERLTASFSVPRLTAVLDGGAERTRLRRAVVDVIESDPVFSRENQYFQSQNERYEAAVRKAVHVRKKMQEMGWSEDGPESVYVYRALSGDVAFLLHRVFMRSISVLGSDKQVAKWIPLASEYQLIGSYAQTELGHGTYLQGLETTAVFDISTQEFILNTPTISAMKWWPGDMGRSATHTVVFAQLYIQGKCYGVHPFIVQIRSLQDHSLCPGVIAGDIGPKMNFEHIDNGYLMLKNVRIPRENMLNKFCEVQPDGTYIRRGSQKINYFTMTSVRVSLISDEVILPLMKACTIAIRYSVVRRQSKLKPGEEEAKILDYQTQQEKLLPQLAAAYAFHFINNYLHELFNRGYREIQGRNFDSLPELHAFSSGFKAMVTQYCTSGLEICLRACGGHGYSLLSGLPSLYTKILASCIYEGENTILLLQTARFLIKCFRAASAGQSVPPSVTYLAAMKPGKCTAKDKLDFLSPDIYTEAYQHAAIRLISSTAAKLQDLIQSGVERHEAWNQCTVQLVQAAKAHCHYITVKNFVETVEKLENTAGIQNIMKHLCDLFALHGIFSNAGIFLHDGYITGAQMDMVTASYLDLLGIIRKDAVPLVDAFDFTDKNLNSALGSYDGQVYQRLYEWARKAPTNKQISPAYEKYLKPLLHNKLSKL

SEQ ID NO: 855 - protein, 620 aa, Meleagris gallopavo
  MOD_RES (180)..(180): Any amino acid
MAPTLNVKQATGNQSSWNTLLPDFPKGPLSKYRKKASFNWKEMAMFLDGEDIIRLKNRIFSALESDPFFARHPGEELSREKYQELTFLRCKRLFEYDFLTQQEIMENPLKILNLVICIGMYDWSPCLQFFLHCGVFGGTILSASKRFANFVKKIYNMEIFGCFALTELSHGTNTKGIRTXFAMFHNVRIPKENILNITGDVSPEGKYSSSFTDVKERFSAALGSLSTGRILITAVSATNLKLALSIAIRFSATRRQFGPTDEEEIPVIEYQTQQWRLLPYLAAAYALDYFSKSLFENFVEFYAGLLTKQKSQRQADLGREIHALSAASKPLSSWTAQQAAQECREACGGHGYLAMNRLGEIRNDNDPNCTYEGDNNVLLQQTSNYLMSWMNCIRNKVPFESPLGTINFLQDYHHIIGWKFKANSVDDCMDSSAPLAAYKWLVCYLLRESDLKLRKEKQSGHSDFEAKNNCQVYFCRSLAIAFVEQTVLQRYHDYTHDPNIPSTLQPVLKNLCALYGLWSLSKHLAVLYQGGYVSGEQAGRFIQNAILELCSRLKDDAVALVDVFAPPDFILNSPIGKASGELYKNMWAEILQGNKALSRPSWWAEFCINKPVTGRLSSRL

SEQ ID NO: 856 - protein, 699 aa, Trichophyton equinum
MVSSPDWVKKLTPAGPQGSELLKHERDQSNISVDKLAELLHTKEVLERQDRILSLIQHEEVFDKSQNHSLGRVERVKRALARAKRLEQLKRQHNWSEDEFLMANNLISEPTPYGLHASMFLVTLRNQGTPEQHKLFLEPAERYEIIGCYAQTELAHGSNVRGLETTATWNPEDKTFTIHSPSLTASKWWIGSLGRTANHAVVMAQLYINGKNYGPHPFVVQIRDLKTHEPLENVHVGDIGPKFGYNTMDNGFLLFNKVKIPHINMLARFSGVDPNTNKYVRPASPSLIYGTLTWVRSTIVLQSGGVLARGVTIATRYCAVRRQFQDRDAPANAPGENQVLDYKMVQIRLFPLLAATFALHFSGRGMMALYNHNQAIMKKSASNQASGRGAGPEELNPGADLLADLHATSCGLKALASTIAAEGLEVCRRACGGHGYSSHSGIGPWYSDYLPNTTWEGDNYMLTQQVARYLLKSARSVFVGKPANNDTCAILQSYLSRRETGAAFDILENDADIVAAFAWRAAYLTFEALKHRDVEKRSWNSLLVDFWRLSTAHSQYLVVKNFYEAVFPSGSSAEVAASLEIDEPTLDVLRKLFRLHSLHTLERESADFFTSGAVTTRQIILTRTKAVMRLLDEIRPHAVRLVDSWKFPDWQLDSSLGRFDGKVYEDLFRRASEENPLNELTFDPYPMSNTLVKNEKSKL

SEQ ID NO: 857 - protein, 542 aa, Streptomyces clavuligerus
MSYARLRAFNEEIESPEELARDPRGLAALHEWAAVVDGALATVAGIHYNLFLGSLVDDESTERDLVPFHTLSRTGTFLCTERGHGNDAAALETTVTYDRGAQEFILHTPHERAQKYMPNTSPAGGPKSAVVAARLRVDGEDRGVFLFLVPLTDADGTLPGVTVEPLPDRIGSPVDHCVTSFDRVRLPRTALIQGPHGRLLPDGVLHTDVGSQRKRFLHAIGRVTTGKLCMSASTLGGCRAALSIAVRYAHTRRISGPTAGSRIPLAAHRSHVGRLLKSLATAYAMTFLHRSVVDTWVHHEPADRDRVERLVAVAKGWITWNARAITIEARERCGARALFPVNGLAEYPANADGAITAEGDNLAIWCKAGAEMIFGHTPAEPSLRSTAVPQGVNALGDPVFLRDLLAVVEGRWHHRARLNLRSGPSGDSLGRWNNASGAALELVEAHATLLAADAFVAAAGTVPHAPTRSLLRDLCALFLLDALAPRSGELLADGHLTAAQVRAIPDTVDRLTAGLTPHLGVIADAFDVPEEHLGDLPMLTAP

SEQ ID NO: 858 - protein, 655 aa, Gordonia neofelifaecis
MSAETAPDPTIIDDTTALAARLQTVLDGRWSAARDLVRAQIQQQALLPRTGLGLEEYRDRVLAQMKDMVELGFPASGFRPEHGGTGDVGGAVTAIETLGYGDLSLMVKAGVQWGLFGGAIENLGTRRHHDAYVRRLIDLDVLGCFAMTETGHGSNVQWLETTATYLPETEEFEIHSPTPSSRKDYIGGAAEHARYAAVFAQLITAGPDEEATGRGVHCLVVPIRDAAGDDLPGVTTSDCGYKGGLPGVDNGRIMFDHVRIPRENLLNRYADVDADGTYSSPIESDNRRFFTMLGTLIRGRVTVGASAGAAGRFGLALAVNYALVRRQFQAPGGDGELLLLDYRTHQRRLLPLVARAYAFALAQNEVTAELHDLQTADPDDVDPEAVRVLETKAAAIKAGHTALAQRAISEAREACGGAGYLSENLLPLLRGDIDVFTTFEGDNLVLTQLVAKEQLTSYADDVRGLDAVGWVKFVADTARSVALEKTAARQVVQTLLDGSDEDPENSALTHPGTQLRLLRNREDHLTRTAAARMGRARDDDADPLEVFTDTQDHLIKVGAAHIDRIVLESFVDAIGRVDDPETRSLLKQVRNLFVYSLLEQDLAWFLMHRHVSVERAKAIRRGVNELCADLRPHAQTLVDAFGVPEVCLDVPMMDQ

SEQ ID NO: 859 - protein, 655 aa, Gordonia neofelifaecis; identical to SEQ ID NO: 858

SEQ ID NO: 860 - protein, 683 aa, Metarhizium anisopliae
MPPPNPDWVKALKPSGLNGQELLEQERAKSNVNVDRLAEFLHTSQALERNARILEILQSHPVFDKSQNYFNGRIERIEAALARGKALRQLSVKHQWDQDEYTAANDLISEPTPYGLHATMFMKTLQEQGTPEQHKVFLEKAQNYEYIGCYAQTELGHGSNVRGLETTATWNQQDKTFTIHSPHLTASKWWIGSLGKAANHAVVIAQLIIDGKTYGPHPFVVQIRDLKTHKPLPNVHVGDIGPKFGYNTMDNGFLLFNKVKVPHISLLSRFSGVDPETGKYIRPQNPALVYGTMTYIRSTIVLQSGSVLARGVTIAVRYCAVRRQFQDRDSTNDELGENQVIDYTMVQHRLLPLLAATYALHFTGRAMLRLYNENQKRLASPSSKSSHDILPDLHATSCALKAFSSTVAAEGLEVCRRACGGHGYSAFSGIGSWYADYLPTVTWEGDNYMLTQQVARYLLKSARAVLKGKPASNDISGVLAEFKARQDIGAAFDILDSDEDLVKAFAWRVAFLTFEALKHRDEEKQAWNSLLIDFWRLSTAFAQYLIVKNFYETLQDQATTSSLDPATTTMLRSLFHLFALNYLQSHASEFFTSGASTVRQIQLARTKRTLSLLKEIRPHAVKLVDAWKFSDWQLDSSLGRYDGRVYEDMFHRASEVNPLNDITFDPYPDSRVLFQSDKRASKL

SEQ ID NO: 861 - protein, 683 aa, Metarhizium acridum
MPPPNPDWVKALKPSGLNGQELLEQERAKSNVNVDQLAEFLHTSQALERNAKILEILQSHPVFDKSQNYFHGRIERIEAALARAKALRQLSVKHKWDQDEYAAANDLISEPTPYGLHASMFMKTLEEQGTPEQHKLFLEKAQNYEYIGCYAQTELGHGSNVRGLETTATWNQHDKTFTIHSPHLTASKWWIGSLGKAANHAVVIAQLIIDNKTYGPHPFVVQIRDLKTHKPLPNVHVGDIGPKFGYNTMDNGFLLFNKVKVPHISLLSRFSGVDPETGKYIRPQNPALVYGTMTYIRSNIVLQSGSVLARGVTIAVRYCAVRRQFQDRDSTNDELGENQVIDYTMVQHRLFPLLAATYALHFTGRAMLRLYNENQKRLASPSSQSSHDILPDLHATSCALKAFSSTVAAEGLETCRRACGGHGYSAFSGIGSWYADYLPTVTWEGDNYMLTQQVARYLLKSARAVLKGKPAPNDISRVLAEFKARQDIGAAFDILDNDEDLVKAFAWRVAFLTFEALKHRDEEKQAWNSLLIDFWRLSTAFAQYLIVKNFYETLQDQATTSSLDPATTSMLRSLFHLFALNYLQSHASEFFTSGASTVRQIQLARTKRTLSLLKEIRPHAVKLVDAWKFSDWQLDSSLGRYDGRVYEDMFHRASEVNPLNDITFDPYPDSSVLFQSDKRQSKL

SEQ ID NO: 862 - protein, 696 aa, Aspergillus nidulans
MPNPPPAWVQALKPASPQGTELLTQERAQSNIDVDTLGDLLHTKEALKKQDEILSVLKSEKVFDKSRNHVLGRTEKIQLALARGKRLQQLKKAHNWSDEDVHVANDLVSEPTPYGLHASMFLVTLREQGTPEQHKLFYERARNYEIIGCYAQTELGHGSNVRGLETTATWDPSDQTFIIHSPTLTASKWWIGSLGRTANHAVVMAQLYIGGKNYGPHPFVVQIRDMETHQPLENVYVGDIGPKFGYNTMDNGFLLFNKLKIPHVNMLARFAQVDKATNKYIRPASPSLMYGTMTWVRSNIVLQAGGVLARGVTIAVRYCAVRRQFQDRDAKANAEENQVLNYKMVQIRLLPLLAAMYALHFTGRGMMRLYEENQERMKAAAQADQEKRGAGPEQLRAGSDLLADLHATSCGLKALASTTAGEGLEVCRRACGGHGYSNYSGIGPWYADYLPTLTWEGDNYMLTQQVARYLLKSARAVLAGKGTANDTSRILQAYLARRDKGASFDILGNDADIVAAFAWRTAHLTFETLKYRDVEKRSWNSLLINFWRLSTALSQYLVVKNFYEAVNSPEIRSSLDKDTASTLRSLFRLHALHTLDREASEFFSSAAVTVRQIGLTQTSEVPKLLDEIRPHAVRLVDSWKIPDWQLDSALGRSDGDVYPDLFKRASMQNPVNDLVFDPYPWNENVLKNAGEIKSKL

SEQ ID NO: 863 - protein, 693 aa, Ogataea parapolymorpha
MDSTMPEVKEPNPADLIWSERLKTTFDINKMHEFIEGSEPEALETLRLMQQLERDPVLNTGAAYYQLSKDEHREITARKIARMAQYMEIDAPNYSRFQNRLNLIAVVDPQLGTRIGVHLGLFLGAVRGNGTEEQFNYWAKERGALSINGVYGCFAMTELAHGSNVAALETTATYDKQRDTFVINTPHVGATKWWIGGAAHSATHTVCYARLIVDGKDYGVKTFVVPLRDSRHVLHPGVSVGDIGAKMGRDGIDNGWIQFSHVEIPRKFMLSKYTSITDDGEVLDPPLAQLAYGALLGGRVTMVTDSFRTSERFITIALRYSVGRRQFTKKGQKIENQLINYPLHQRRLLPYLSWTYGMAIASHAIQLSYKQTLEKLDEGVESGDFQQLQQAITALKTLFGESAALKSTCTWTCLNLIEECRQACGGHGYSAYSGFAKGYVDHAVQCTWEGDNNILAQNSGRITVQKVMAFKKSGKASREYEFLAKAVETGEILAADTITHLGKLVSAFDALILRLSLDCIEALKENNDWDSIAPEKLTLSKLYACRFILAKWVEKMNSLNENNGDIVTPLVSLAQLFALTNIEAFGSQFLRFGIVSASTFKAVLEKIGILCREIRPLVIGLTDSFKMSDFFINSTLGSYNGDIYHHYYGVVKMLNEPSKIKAEYSADFEQNLHRGTVEERENFERTSQTLRKL

SEQ ID NO: 864 - protein, 713 aa, Capsaspora owczarzaki
MERVSAIIRHLTFEAQSAASSAQSGAAAGGPLASYRAKSSFQPETMRRYLDGRFYEFKKAMYATLLQDPLFRLPIAELELSRKDARHQAIRLMRRVIEYQFVTEADLEQDPMIALIVSNLLTSFDVSLAPKLFLSCGMFAQCLVNMGTERHLKYLPMIATLEIVGCFALTELAHGSNVRAMMTTATYDRTTREFVLHSPSYLATKWWVGLLGQTANYAVVFARLIIGDKDHGLHPFLVPIRTMSDHMPFPGVTVGDLGSKLGQNSLDNGFVAFNQYRIPRESLLNRLADVTPEGEYVSQFSNADRLFGATLAPLSGKRPRVHRWAGAHQLALSSRHFRPVQFSPSDNVEELPVIEYQLQQYRLMPYVAACYALDRFYVWLSGHHFSQLQSARSGPVDPALVAEMHALSSAGKAVAGWITRDAIQTSRECCGGHGYSTCNRLGVLRDDNDPNLTYEGDNNVLIQQTSKFLMTSLRNVMTGKPVKSPLGSVAFLEQFSTLIGSKWAVESEGDLLKPAVLLHAMHYRTAYLLQEAGTKLQSIMESGKDVDTFSAWNQTQVHYLHAAAKAYLEAVIVAQFDAAIQSCPTVSLRGVLSKLLALFALWRLEGDIAVLREDDFITGQQAKLLKETVLALCLQVKDEAVSLVDAVAPPDQILFSPIGRSDGEVYKNLYNTVTTTPGCFERAPWWAEMHPPVEKGSKRAVFDSYLKAASSSH

SEQ ID NO: 865 - protein, 680 aa, Capsaspora owczarzaki
MSSSSKPNLPVTNAVNGPPNADLVRERGAASFPVRDLTYLVYGGQERTEHLERIANMVASDPVFRKTDRFFLSRTEQYRRSLEKVRHYKELIAKHNLHSELDQQDLRQAIDEDLPIGLHVGMFIPTIVGQGTDEQQKKWLPLARAYKIIGTYAQTELGHGSFIRGLETVATYDKSTQEFVLNSPTLTATKWWPGALGKTSTHCVVFARLVISDRECGVHPFMVQLRSLENHEPLKGITVGDIGPKFAYETMDNGFLRFDHVRIPRDHMLMRFAQVAADGTYSTPPHSKVSYATMVFMRAYIIGTASSTLAKAVTIAVRYSCVRKQFPLRSGEPEQQILNYQNQQAALFPLLATAYAFHFTGNYIRQMYSDFVRGMRAQDFSVLPEMHATSAGLKSLTTWIASAGIETCRASCGGHGYSKLSGLPSLYANYIPACTYEGDNTVMCFQLARYLLKLYGKAQAKPGLRLPGNVSYLEKSTLLDERCDASTEELWLDPARQLHAYRNRALRLVANCANRLVAEMQKGKDEVLAVEAIKSDMVKVAKAHSYYVVLNNFVNAIEQLRASGTSTPILRVLKTLCDLFALHFIQADLGDFLEYGYLSSLHTEPLHAQIRRLLEAIRPDAVALVDAFNFTDHALGSALGVHNGRVYETLFEWAQQEPLNKTQVAPGYHEYIKPFLLAKM

SEQ ID NO: 866 - protein, 451 aa, Ectocarpus siliculosus
MKRHGDIIRFHHVRVARTSLLGGVAVVSPEGKYSRVPGGQKQSYGSMLAVRANIVINASRSLARALSIAFRFGAVRTQGYDEREGASPGSERQVLDYPTQQRVLLPLLAHAYALHFAGQHMKSAYHYYLDTQDAEALPDLHATSAGLKSLVTQSVADGIEAARKMCGGHGYSQFSGLPDLSSGYLALATLEGTQQVLEPQTARHLLRSLAAARKGKRLSEAFSYLSPSSTQQGAATTTTSPAVSVRIGAQLRRPETQLRLFRGRARAAVLAAEEAVQRGGKGTAGAGGGAAAGREAMVGAAVELGRATRAHCQLHLVERCMAGVEQQREAAAAAAAAASGEELNTREVNVLSSLRDLFALSIVEEWWPGGLGKTSTHCVLMAQLVLDGKVLGVHPFFVQLRSMTDHSPLKGVAIGDIGPKLGFNSTDNGFCRPAVAACCLPRWWAGGEGGS

SEQ ID NO: 867 - protein, 693 aa, Aspergillus flavus
MAVFNRQMDLMQQARASSTFNPMKLTVIIYDNEATVSARRAAFHRVEDALGLLDNMKLPHVYSGLDREGLYLEGVRRARVITNDMITHGHSHFQWLNERYQICNSSPFGMNFLMFRRTIELQGTAEQRRYWLQEIDQMRINGAYAQTELGHGTFVRGIETTATFDVDTDTFTIHCPTPTSVKYWPGGLGFSCSHAIVAARLITHGKDHGVHMFIVQIRSLEDFAPVRGVELGDLGMKMAYNGTCNGYARFNYLRVSRSSLLAAHAQVSRDGTYSQAQAKAGTLPLSKRVYSTMLDTRRNIVRCVAFGLAQAATITARYSIVREQGRLMFSDAAEEETAIITFKSQHYRLLTLIAQSYAILFAAKDFDFRYDQLVREQENDDHARLPFMHALSTGLKAWATTIASAGATEARKMCGGHGYVALSGLPEIEGSVSATATFEGENYVMWQQLVVYLFKQVRASCAGQDVDAEVKDYIGGVRSYLGDGAFPSRIQSCDKKTLFDGSTLVLIYKKRSQRVLAAAYSSYRDMCSRCSAAEAWNACMMTSLAAGQAFVEYIVLESFVKRTSPSATRDAPVSQALSHLFSLFALTTITSPTPSFAAGSFLEHGLLTPDELNEIRVHINELLASLLPNIAALTDAWDFTDSSLCSALGCKDGNVYERLLSWTRQLPANSGRAVEKAWEASEGIEEFFKASRL

SEQ ID NO: 868 - protein, 694 aa, Aspergillus flavus; identical to SEQ ID NO: 753

SEQ ID NO: 869 - protein, 692 aa, Aspergillus fumigatus
MPSPPPEWVKALTPASPQGTDLLKQERAQSNVEVDKLAEFLHTKAFLEKQQRFVELLSSEKVFDKSQMHSQGRSERIQRALAKGKRLQQLKEKYNWSTEDFHFASEMIGEPTPYGLHASMFLVTLREQCTPEQKKLFLEPAEKYQIIGCYAQTELGHGSNVRGLETTATWNPEDKTFTIHSPSLTASKWWIGSLGRTANHAVVMAQLFIAGKNYGPHPFIVQIRDLETHQPLENIYVGDIGPKFGYNTMDNGFLLFNNVKIPHINMLARFSRVDKETNKYVRPASPSLVFGTMTWVRSNIVLQAGSVLARGVTIATRYCAVRRQFQDRDAKADAGETQVLNYKMVQIRLLPLLAAMYALHFTGRGMMRLYQENQNKRAAAEAEQDKRGAAPEALRAGSDLLADLHATSCGLKALASTTAGEGLEICRRACGGHGYSSYSGIGPYYSDYLPTLTWEGDNYMLTQQVARYLLKSARAVLAGKGTGNDTSQILQAYLARRDKGASFDILEVDSDIVAAFAWRTAHLTFEALKHRDLEKRSWNSLLVDFWRLSTAHSQYLVVKNFYEAVSSPDLAAKLGPETTKIMHDLFRLYALHTLEREAAEFFSSGAVTVRQITLTRTNAVMKLLDEIRPHAVRLVDAWKIPDWQLDSSLGRYDGDVYPDLFNRASQNPVNDLVFDPYPWNEAVLKNAPKAKL

SEQ ID NO: 870 - protein, 702 aa, Cryptococcus neoformans
MAFPRPKPTTVETLAMERANPPFNVRKLSIKMHGSEKALVLKERFMAEIARHPAFKLSDIHDLSKDELRERTMEKFASMVYFVTNESLEVFNLRMQLIGIADPSFWTRFGVAYGLFLGALRSGATPNQLSYWIDRGVLGLNGVIGCFAMTELAHGSNVAGLETTATFDRETDEFIIHTPHLGATKWWIGGAASTATHAAVFAQMIVDGKKYGVKTFVTQLRDTKTFQLLPGITIGDIGKKMGRDGIDNGYIQFTYVRVPRAHMLMKHTQVSRDGVVTEPALAQLTYGALLGGRTSMVTDSSNSAKKALTIAVRYAAVRRQFATGKNQLETQILDYPIHQRRLMPLLAQAIAIGFTGLKLTKMYEDMTQSLDTMDPSDLKETHATSAGLKAFCTWACLDTIDKCRQSCGGHGYSAYSNFPTMYADFAVQCTWEGDNTILSLQAGRSLVGAWGAAIKGKHLVSGVAYLNDRSILTAKSDSSLTLSDIKRAWNCVAANVIKKAAEEYVSYLKAGKSKEVAMEMCSQSRFIAAKVHTVGYIFTMFKEAVEDMEESAETEILRTVAKLYGLWQIEEQQGYFLKYGYFTAEQMDKVQTSVDGLCAEVRTIAVPLVDAFALSDHILNSPLGKYDGSVYESYFSQVQAANPLPKEHPYFTRLIKPLLERQNAEMEDPEQAMGLDDELKEIEEERREAAKGKEGKVRKEDY

SEQ ID NO: 871 - protein, 662 aa, Rhodococcus erythropolis; identical to SEQ ID NO: 193

SEQ ID NO: 872 - protein, 699 aa, Arthroderma gypseum
MVSSPDWVKKLVPSGPQGSELLKHERDQSNVSVDKLAELLHTKEVLERQDRILSLIQHEEVFDKSQNHSLGRVERVQRSLAKAKRLEQLKKQHNWSEDDFLMANNLISEPTPYGLHATMFLVTLRNQGTPEQHKLFLEPAERYEIIGCYAQTELGHGSNVRGLETTATWNPEDKTFTIHSPSLTASKWWIGSLGRTANHAVVMAQLYLNGKNYGPHPFVVQIRNLKTHKPLENVHVGDIGPKFGYNTMDNGFLLFNKVKIPHANMLARFSGVDPNTNKYVRPASPSLIYGTLTWVRSTIVLQSGGVLARGVTIATRYCAVRRQFQDRDAPANEPGENQVLNYKMVQIRLLPLLAATFALHFTGRGMMALYDHNQAIMKKSASKQASSRGAGPEELNPGADLLADLHATSCGLKALGSTIAAEGLEVCRRACGGHGYSSYSGIGPWYSDYLPTTTWEGDNYMLTQQVARYLLKSARSVFVGKPANNDTCTILQSYLSRRETGAAFDILENDADIVAAFAWRTAYLTFEALKHRDVEKRSWNSLLVDFWRLSTAHSQYLVVKNFYEAVFPSGSSAEAAASLGIDEPTLDVLRKLFRLHSLHTLERESADFFTSGAVTTRQIILTRTKAVMRLLDEIRPHAIRLVDSWKFPDWQLDSSLGKYDGKVYEDLFLRASEQNPLNELTFDPYPWSNTLVKNDKSKL

SEQ ID NO: 873 - protein, 670 aa, Brugia malayi
MRYNLIEPGDNEDITNERRGSSFSVGKMAAFIHGGEEKLRRRHEILKFVESQKDFQDPIPPEFMSRKERVENNARKIVAMTDKIAFIDQSDMFEEGLLFQSLIMGRDFHAMSLHYAMFIPTIQGQADDDQLDYWLPLAVTRGIIGTYAQTELGHGTNISKLETTATYDEKTEEFVLHTPSVSATKWWSGGLGKSSNYAIIPAQLIINGNNKGLHMFIVQLRDLDTHMPLPGITIGDIGPKMGIPGNDNGFLIFNNYRIPRKNMFMRYSQVLSNGEYIAPKHSKLRYGTMVFVRSIMVRDQAMQLAAAVTIAIRYSSIRRQGEWKPGLKEVQILDYRTQQYRILPCLAQSFVFLFAATEVKNLYMKVNKQLSHGITELLQELHILSSGFKAVVTWEVAKGIEQCRLACGGHGYSHASGFPEIYSFAVAGCTYEGENIVMLLQVARFLMKTVKEIHSNSAHLATIAKYLLDARRYKSSFQRWQTVEYEDLVGDFEQAARNQIYSTYNYLQQLQKDNHSAEEAWNCASVELCKASRLHILCFMAKSYLSRISQCSEPEISRILNLIGKLYMLHEISAHCYAFRMANYMSDEQMRSVKCGIYEILGNLRPDAVAIVDSFDFSDRELHSVLGRRDGNVYAAMLEWAKYLELNKTEVLSTFKNYLGPMMEDGRSKI

SEQ ID NO: 874 - protein, 452 aa, Algoriphagus sp.
MKNILKSLSGLRQILSNVDLDQISKLSQKVDLPKMVNLVSKMSEEDLSKMMGMLKGGSKPKVIPPVNGDFYELGKSLPPHEREIQLRVREFMEREIKPIANHYWNKAEFPMQIIPKMAELDIAGLTYQGYGCPGHSALLEGFIAMEMARIDTSISTFFGVQSGLAMGSIYICGSEEQKKEWLPAMQKLEKIGAFGLTEPEVGSGVAGGLTTTCKREGDTWILNGQKKWIGNATFSDLTIIWARDLDDQQVKGFIVRKDNPGFKAEKLEDKMALRTVQNALITLTKCEVPESDRLQEANSFRDTAKVLRMTRAGVAWQAVGCARGAYELALAYTNERKQFGRPIASFQLVQDILVTMLGDLTAMQTMVFRLSEMQDGDILKDEHASLAKVFCTLRMRSIVDHARELFGGNGILLKHDIARFVADAEAVYSYEGTKEINSLIVGRAITGHSAFV

SEQ ID NO: 875 - protein, 402 aa, Corynebacterium genitalium
MTQTDENLTGVAALLNPKTDYYQVFADVDGEDLEWWQKAREFMEWARPSLNESWEKAEYNIPAVEEAARRGLVTDGIEIDGQPGISIRANRLIQMELARTDASTATAHIVQSGLAMRSISECGSEDQKAKYLGPMSRMEIRGGFALTEPDHGSDSIGLETSARREGDEWVINGEKKWIGHGSVGHITVVWARDEEDGEVKGFIVDQDQEGYSAETITGKASLRGIPQAHIKLNDVRVSDDRRLPNSHTFRDTARVLTGTRIAVAWVALGMAIDCYEKALDYAQLRVQFGRPLVKNQIIQQRLADMLQDVTSMALYCRRLLELEEAGELNEKQAALAKVHNTRGARKISADARDMFGGVGILLENDVARHHADIESLHTYEGTDTMQSLIVGKSITGVSAYRS

SEQ ID NO: 876 - protein, 777 aa, Stigmatella aurantiaca
MAIDDVKGPSVQELLSLPRLAPLVPMLYVAWTDGELTHEEIRALGAAARVQPWLDLRASVVLAQWLDPLHPPSPLALAHLREHIRRTAERLESSDQQSLAELGSQLAQLLGGQDALPAPMPELARTLAPLETSLGLSGAEAVRTLVAPVHRDDTSPEPSFPVEALRAVLDRTYSAERAQVRAWLAEPAFRHADERDTSAYRAQVFTWLKALADRGLGKLAYPEDLTKVDLGAFIAAFETLAFFDLSLVIKAGVQFGLFGGSVFFLGTERHHRELLPKIASLELPGCFAMSELGHGSNVRDVGTVARYDEQRGDFVVETPSEGARKEWIGNAALHGRMATVFAQLEVKGERHGVHALLVPLRDENGQLLPGVRAEDCGLKMGLNGVDNGRLWFDSVRVPRENLLNRFSQVSPEGEYTSSIPSASKRFFTMLGTLVAGRVSVATAGLSAAKSGLAIAIGYAEQRRQFGPAGASEVRLLDYPTHQLRLLRPLATTYALDFALKHLVKRYTERTEEDAREVEALAAGLKAYTTWHTTRTLQEAREACGGQGYLAANRLPSLKADTDVFTTFEGDNTVLMQLVAKSVLTGYRQQFEDERVFTVMKLIVERASAALTDRNPFQARRTGSEHLRDGDFQLGALRFREADLVASAARRLRKRLGSGMDSFQAFNECQDHLLALAHAHVERVVLEQFIAGIAWVEDLPTRTVLSKLCDLYGLGCLMDAGGWFVENDLLEGAKAKAIRKEVARLCAELRPDAVALTHAFGIPDTCLAAPIGLGHLSP

SEQ ID NO: 877 - protein, 699 aa, Arthroderma gypseum; identical to SEQ ID NO: 872

SEQ ID NO: 878 - protein, 452 aa, Algoriphagus sp.; identical to SEQ ID NO: 874

SEQ ID NO: 879 - protein, 402 aa, Streptomyces sp.
MRTMAERRHGSEAGAVEGDFFGIVDLLDGEERKLLERVREFLRAEVAPHANELWEAGRSPVSLRGRIAGLGITGEEGDDAGVPARGSLFRGLLGMEMARVDPSFATFFGVHAELAMGSVRACGSEEQKARWLPAMTRWEKLGAFALTEPLVGSTTAAGLTTTARREGDTWMLDGEKKWIGNGSFADLLVVWARDVADDQVKGFVVEHGAEGLSAEVIPHKIALRGVQNAHLVLDGVRVPEADRLERAESFADTNRVLRVTRAAVAWTATGCALGAYEAARAYAVEREQFGRPIASFQLVQDNLARMLADITACQALAVRLAALEEKDELSDAQAALAKMFCTSRMRETVARAREVMGGNGILLDHDAARFFADAEALYSYEGTRDMNSLIVGRAATGLSAFV

SEQ ID NO: 880 - protein, 681 aa, Harpegnathos saltator
MKTSIVDSLISDLPKGPLDAYRKRATFDWKSFKLALNGEDYLRYEDDLWKLVKTNPAFQRLPGSATLDEIQRHCNAGVRAINEAEIFPWNNQNELYVLCQYDPSVIIKLGVSRGMVPNSILALGTDQHYHLIEKFEDGSYIGCFALTEISHGTNAKGIRTTATYDVATKSFIFHTPDFEAAKCWVGGLGKTATHAVLFARLITPDGVNHGLHPFIVQIRDLETHLPMPGVTVGNMGEKIGLNGIDNGFVMFNKYFVLRNCLLNRTADVTEDGKYLTTVKSESKRFGSSLGALSGGRIAITNICAEYMSLAIVIALRYCAVRRQFGPTEDNELPVIEYQTQQWRLLPHLAATYAIKLFSKDFFIKLIEFNLSRFTDENIDPDLIANMGMEIHALSSATKPFCSWTARDAIQDCRESCGGHGYLKMSRLGEIRANNDANCTYEGENNILVQQASNWLLNQWDNAIKGRLVPSPFGFIDFLPVAEQIFSIKFDRKTIDDTVEPKYLLLISKWLVCYYLKKTYQHVKQLKSSGMSDFDVKNNSQTFLARTLSLVYAEHAVLSYFCKNLQDPKWSLNERQVLTDLCSLFGAVLLEKRLGDLYAGGFASPDSNIDNLLREGIIKLCKKLVDNAVALVDVLAPPDFVLNSPLGMSDGEVYKHMKEWIYSEKENLQRPSWWTEIVKSKL

SEQ ID NO: 881 - protein, 666 aa, Harpegnathos saltator
MGTMNPDLRRERERCSFDPMELTHFWDGNVERTLERRERENFFLSDPILRDKIPAKYKSHKEIYEDAVMKGCRVIEKVQELQESGKGGIEVFSQILGGMLGSAILKDGNPLTLHYVMFIPAIMGQGTAEQQGYWISRAWSCNIIGTYAQTELGHGTFIRGLETTATYDSETKEFVLNSPTLTSYKWWPGGLGHTANYAIVVAQLFTRGECRGIHPFIVQLRDEDTHEPLPGIKIGEIGTKLGMNATNNGFLGFDHVRIPRENMLMKNSQVLEDGTYVKASSDKLTYGTMMFVRVVLVRDIASYLSKAVTIAVRYSAVRRQSQIKPDEPEQQIMDYVTQQYKLFPNLAACYAFRISADWIWDMYNNVTAELDQGELERLPELHALTCCLKAVASSDAATGIEQLRLACGGHGYMDASNLPATYGFVTATCTYEGENTVLLLQTARYLVKVWRQAASGQRLPPTVEYLGILLRRTKQQPWKNTLTCIVTAHQAVAAGKIRLATENLDRRIRSGVSPEDAWNQTSIELAHCAESHCRAFIMTRFVEIARNLTSLSKECHQVFMQLCELYSIYWVLQRLGDFLRFSCLNTKDIPALQTRFEEMLAAIRPNVVGIVDGFDIRDEILASALGAYDGNVYERLFDEAMKSPLNQESVNQSFHKYLKPFLKSNL

SEQ ID NO: 882 - protein, 666 aa, Camponotus floridanus
MVTINSDLRRERERCSFNPMELTHFWDGDSKKTSQRRERENFFLSDPLLHDRIPAKYKSHKEIYEEAIMKGCRVIQKVQQLQESGKGGVDVFSQILGGMLGSAILKDGNPLTLHYVMFIPAIMGQGTVEQQSYWISKAWSCNIIGTYAQTELGHGTFIRGLETTATYDPETKEFILNSPTLTSYKWWPGGLGHTANYAIVVAQLYTKGECRGIHPFIVQLRDENIHEPLPGIKIGEIGTKLGMNATNNGFLGFENVRIPRENMLMKNSQVLEDGTYVKAPSDKLTYGTMMFVRVVLVRDISNYLSKAVTIAIRYSAVRRQSQIKPDEPEAQIIDYVTQQYKLFPNLAACFAFRMCADWIWEMYNNVTAELDQGELERLPELHALACCLKAVASSDGATGIEQLRLACGGHGYMDASNLPATYGLVTAVCTYEGENTVLLLQTARYLVKAWRQAVGGQSLPSTVGYLAVVSRGVKQRPWKNTLSCIVEAHQAVAAGKIRLATENMDRRIRSGASPEDAWNQTSIELAHCAESHCRTFLVMRFVETVRGLTGISKQLHEVLIQLCELYSIYWVLQRLGDFLRFSCLNNENIPALQTRFEEMLAAIRSNAVGIVDGFDIRDEVLASALGAYDGNVYQRLFDEAMKSPLNQESVNQSYHKYLKPFLKSNL

SEQ ID NO: 883 - protein, 693 aa, Coccidioides posadasii; identical to SEQ ID NO: 218

SEQ ID NO: 884 - protein, 651 aa, Coccidioides posadasii
MPPRNISNKPNETPLSVFLLGGKDKFEARKQLLKALTTNPIFSKRAVTVPSLSRKDAWVRAVHQARELIALKQKEKWSHEQFRQAVVMLDYFLPVQPQFRIFLSNMERQMSDEQKAIWMPKAERLEIFGSYAQTELGHGSNVRGIETTATFDRDADEFVINSPTLSSTKYWIGATGIWATHSLVVARLIIHAKDYGNHLFLIQLRDLDTQELMPGVEIYELGPKAFQGMVGVDNGAMQFHNVRIPRSQMLARNAQVLRDGTYVPPKNTKHSYGSMVTVRAIMVEATGYELLKAVSVAYHYTTFRKQFWRKGQEEETTVFDYASVKYRLLPLLAQGTALVLVGQSIKQAFDEYSKLVINTGDFSQLEDLHLQTVGAKVYSTDITARGVETCRIACGGHGYSALSGFGRMYAHTVNAVTYEGDNYVISQQVPRAILKHYNGRTESTVPSLSYLSFIRDPDAAGILTAASESGWFKLENQQWVLERRLATLVRAHLDATVCGKDTSFTVHELTMAHCDFVYWRGFWDVVRKAVGSEFYGPLEALAHVFSLSILQTAYKDIYSPHSLTEHQRKTLVSAYDQAIETLAEHSKSIIEAYGFTDFEMDSALARPDMDPYEALWQGARQSEMNNFREIWPLIVDARKIWGRLEGEKAKL

SEQ ID NO: 885 - protein, 827 aa, Trichophyton verrucosum
MHAKLGAGKKLVMKKHCARDFQRLKPRRMVFSLPKPLSTSASFFRLPGASAYREIPKIRPGDAEEEPASCDQKALLVSCLLVLISGSSLPRSLLPQFLPFCFPSSPAFVRSLASLYLLSELLFIYIITMVSSPDWVKKLAPAGPQGSELLKHERGQSNISVDKLAELLHTKEVLERQDRILSLIQHEEVFDKSQNHSLGRVERVKKALARAKRLEQLKRQHNWSEDDFIMANNLISEPTPYGLHASMFLVTLRNQGTPEQHKLFLEPAERYEIIGCYAQTELAHGSNVRGLETTATWNPEDKTFTIHSPSLTAAKWWIGSLGRTANHAVVMAQLYINGKNYGPHPFVVQIRDLKTHEPLENVHVGDIGPKFGYNTMDNGFLLFNKVKIPHINMLARFSGVDPNTNKYVRPASPSLIYGTLTWVRSTIVLQSGGVLARGVTIATRYCAVRRQFQDRDAPANAPGDNQVLDYKMVQIRLFPLLAATFALHFSGRGMMALYNHNQAIMKKSASNQASGRGAGPEELNPGADLLADLHATSCGLKALASTIAAEGLEVCRRACGGHGYSSHSGIGPWYSDYLPNTTWEGDNYMLTQQVARYLLKSARSVFVGKPANNDTCAILQSYLSRRETGAAFDILENDADIVAAFAWRAAYLTFEALKHRDVEKRSWNSLLVDFWRLSTAHSQYLVVKNFYEAVFPSGSSAEVAASLGIDEPTLDVLRKLFRLHSLHTLERESADFFTSGAVTTRQIILTRTKAVMRLLDEIRPHAVRLVDSWKFPDWQLDSSLGRFDGKVYEDLFRRASEENPLNELTFDPYPMSNTLVKNEKSKL

SEQ ID NO: 886 - protein, 702 aa, Cryptococcus neoformans; identical to SEQ ID NO: 870

SEQ ID NO: 887 - protein, 699 aa, Arthroderma benhamiae
MVSSPDWVKKLTPAGPQGSELLKHERGQSNISVDKLAELLHTKEVLERQDRILSLIQHEEVFDKSQNHSLGRVERVKKALARAKRLEQLKRQHNWSEDDFIMANNLISEPTPYGLHASMFLVTLRNQGTPEQHKLFLEPAERYEIIGCYAQTELAHGSNVRGLETTATWNPEDKTFTIHSPSLTAAKWWIGSLGRTANHAVVMAQLYINGKNYGPHPFVVQIRDLKTHEPLENVHVGDIGPKFGYNTMDNGFLLFNKVKIPHINMLARFSGVDPNTNKYVRPASPSLIYGTLTWVRSTIVLQSGGVLARGVTIATRYCAVRRQFQDRDAPANAPGENQVLDYKMVQIRLFPLLAATFALHFSGRGMMALYNHNQAIMKKSASNQASGRGAGPEELNPGADLLADLHATSCGLKALASTIAAEGLEVCRRACGGHGYSSHSGIGPWYSDYLPNTTWEGDNYMLTQQVARYLLKSARSVFVGKPANNDTCAILQSYLSRRETGAAFDILENDADIVAAFAWRAAYLTFEALKHRDVEKRSWNSLLVDFWRLSTAHSQYLVVKNFYEAVFPSGSSAEVAASLGIDEPTLDILRKLFRLHSLHTLERESADFFTSGAVTTRQIILTRTKAVMRLLDEIRPHAVRLVDSWKFPDWQLDSSLGRFDGKVYEDLFRRASEENPLNELTFDPYPMSNTLVKNEKSKL

SEQ ID NO: 888 - protein, 681 aa, Ailuropoda melanoleuca
MGSPVHRVSLGDTWSRQVHPDIESERYIPSFNVERLINILDGGPQNTELRRKVESVIQSDPEFSLKDHYFMTQNEHYVAAVRKTFHLQIIAKRLGWSENSPEFYYAYRAVSGELAFNLHRVFQKSLRSLGSEEQIAKWNPLCNEFQIIASYAQTELGHGTYLQGLETEATYDTATQEFVVHSPTLTATKWWPGDMGRSATHTLVQAQLICSGARRGMHAFIVPIRSLEDHSPLPGVTVGDIGPKMGFDSIDNGFLRLDHVRVPRENMLSRFAQVLPDGTYFKLGSPQTNYFSMVVMRVDLLLGEIIPLLQKACVIAVRYSVIRRQSRIRPSDPEAKILDYQTQQQKLLPHLATAYAFHFLGSNLSEFLHSSYDAILNKDFSHLPELHALSAGIKAMVSDLCLQGTELCRRACGGHGYSNLSGLPSLVTKVTASCTYEGDNTVLYLQTARFLVKNYQQAHPTPGSTLQRSLPQSVAYLATTDLARCPAQKAADFLHPKLYTTAWAHVATRLVKDSVNHLETLMQSGADWDEAWNQTTILHLHAAKAHCYYISVKSFTETLQKLENEPEVQQVIKHLCDLYALHGILTSAADFLHDGFLSGAQVDAVRTAYLDLLRLIRKDAILLTDAFDFTDHCLNSALGCYDGNVYERLFHWAQESPTNTQGNPAYEKYLRPLLQSQRSKL

SEQ ID NO: 889 - protein, 664 aa, Phytophthora infestans
MSSLLDAERRKSSVPSRELAYILHQSKSNVEKLERLEHLLVQDPVFNHEKMNYLTRGEQYKRATQMAGRAEIIAHHNHLSEEDTALLHVILQGFTGCPSSTALHTGMFIKNLGLLFTDEQQTSWMEMAKQWRMVGCYAQTELGHGSNVRGLETTATYIPDTDEFEIHSPTLTSMKWWPGALARTANFGVVYARLLLGGKDYGVHNFMVQLRDLETHDVMPGVTLGDIGPKIGFNNVDNGYCTFSRVHIPRSNMGMRVAQVTREGKYVKNSDVPQKVLYFTMLQTRMSYVRSSGLALARACTITIRYSGVRRQGYDANNPNSNEELSVLDYQTQQYRLFPLLAAAYAITLTGNQMDAFSLQLADQIKHGDPSMLVVGHAMSCGLKVLASEMACNGIETCRRACGGHGYLLSSGLPVLLGDVLQMVTAEGENFVLCQQTARALLKIHGQFQSSGRLPTAMQFIANIGKLSHAQPRSKVQWLELETYLDVFQQRFLHSLRGLVNKVSSDSSIAAGIQNNSMHCYKLSYAYTYLVLVNNFVLAVRSASPEIQPVLQFLCKLFALTQLEATAGEFMESGCVFPSEMAIIRANIEELLKLIRPHAVTLVDGFNFSDHTLNSTLGRFDGNVYEALYESAQHDPLNHSSDKVALHELLRPIRDEIARGKSRL

SEQ ID NO: 890 - protein, 660 aa, Phytophthora infestans
MAVELKDLAPLLLKKERANGDINPAVLTNVLRDGNAANSRRKELIKVIEQHPVLSDRDMMFRNHTERYEFGLKKAFHYVKLLQDGGYTDPEDQQILYKALGEPLGFDVHRAMFIPTLENQGTDEQRAKWLPLARNYKIFGAYAQTELGHGSNVQGIETVATYDKATQEFIIDSPTLTSRKWWPGGLGKTANHAIVHARLYLDGKDVGVQAFLVQIRSMEDHQPLPGIEVGDIGPKVGFNGVDNGYCAFHKIRIPHDNMMMRYAKVLPDGTFVKPKSDKLVYLTMVQVRAYMIKTAGQQMGAASTICTRFSAARIQGRTPDNKGEFQVLDYQNQQHKLFPLIAVSYAALFAGVSLVDIHDSALNVIKKGGQSFGAKLAELHAVSSGLKAWLAERVSDGIETCRRLCGGHGFTQSSNLAHLFAEMVGANTYEGTSDVLVQQHARYLLKTLASLPVNEESTTFLNHVKRFSDAKLRCKAQTPDDFGNLELLLEAFQTRAARIVLALASQMKATKNDGNACMVLMTRASAAHAELILLEAFIHGAQNLPAGSEKDSVTQLCSLFGAWLITKSLGDFRQHDYLSSQQVDLVQSQVVRLLPVIRKNCVLLTDAWDFSDFELNSTIGRYDGDIYRALVKRAADEPLNKTQVPDGYEKFLKPLIQSDL

SEQ ID NO: 891 - protein, 640 aa, Phytophthora infestans
MAIELKDLAPLLLKTERANGDIDPSVLTTILRGGQVANDRRKELLQVIERHPVLSDRDMMYRNHTERYNFGVKKAFHYIKLLQEGGYTDPVDQQILYSAMGEPTAIEVHRSMFVPTLENQGSDEQRAKWLPLAKSFKILGAYAQTELGHGSNVQGIETVATYDKATQEFIIDSPTLTSRKWWPGGLGKTANHAMVHARLFLNGKDVGVQAFLVQIRSLKNHEPMSGVEVGDIGPKVGFQPIDNGYCAFHKVRIPRDNMMMRYAKVLPDGTFVRPQSDKLVYLTMVQIRAYLIRWLGQGMGMATTITTRYSAARVQGRKDPGSSKGEFQVLDYQNQQHVLFPYIAVSYAGFFAGTSLIAMHDSALEIAWLANHVSDGIENCRRLCGGQGFTHSSNLGHLFAETVGACTYEGTFDVLVNQHGRYLLKALYSGSHLPDSPTAFLANAKAHSNPNLRCKAQKPQDFADLQLLLEAFRVRASRAILTLAAEMKANKNDANACMVQITRASTAHAELLLVEAFVNGLSSIPSGNERRAVTHLCELFGVWLITKTLGDFREDDYISSKQAGMVRRQLVSLLLVIRKNCVLLTDAWDFTDFELNSTIGRYDGDVYRALVRRAADEPLNKTQVPECYEQFLKPLLQSAL

SEQ ID NO: 892 - protein, 676 aa, Phytophthora infestans
MASVSSVPLHDLAPLLLRRERQCSDIDVDLLADALRGGREVNRRRKLMVELVRRHPVLSQRNSMFQNHEQRCAKGLKKAYHYIKLVQDQRIDDPRDQEELYVALGERLPLEVHRAMFIPTLENQADNGQQAKWLPLARGYKIIGAYAQTELGHGSNVQGLETTAVYDKETQTFILNSPTLTSRKWWPGGLGKTATHAIVHAKLQIDGDDEGVQAFIVHLRSLEDHSPLPGIELGDIGPKVGFKSLDNGYAVFRNVRIPRRNMLMKYAKVRKDGTFIKPKNSKLVYLTMTQVRAYLILKLSFVLGAATTITTRFSAARVQGKKATSSDDMIKEYQVLDYQNQQHVLLPLLSLAYAANFAGRAITALHDDTLDLVTRGHGSFTTQIAEIHAISSGLKAFLADRVNDGIEQCRRLCGGSGFLQSSNLAHLLAENVGACTFEGTFDVLVQQHARYLLKAHARLRRSEATRGDYEETPTSFLRFTELYIRPGLRCNAHRAEDFGKLHVLTDAFEVRAARSIQRLAEAMASSGNDRNACMMLMTTVSTHHAELMLLKSFVSGVYALPAGKTKAAVAQLCQLFGASLLVRGLGDFRQDDYFSHAQGGMVHQQLQKLLSPVRRNAVRLTDAWDFSDFELNSTIGRYDGDIYRALVEQTKREPLNASEVVDEYDKYLRPLIQSAL

SEQ ID NO: 893 - protein, 622 aa, Phytophthora infestans
MELKDLTPLLLQRERESSDVDVELLTNTLRGGHAANRDTAFQNHTQRYVKLIQSGKVDSDAQQIMYDVIGEKLPIQVHRSMFNPTLENQADDEQQAHWLPLATSYRILGAYAQTELGHGSNVQGLETTAVYDKGKQEFVINSPSLTSRKWWPGGLGKTATHAVVHAQLRIDGVHHGAQAFIVPLRSLKDHKPLPGVEVGDIGPKVGFNSLDNGYAVFHSVRIPRRNMLMRFAKVLPDGTFIKPPSSKLVYLTMTQIRAYLILKLGLALGAATTIATRFSAVRAQGRKVSDNNLTLTSETPVLDYQNPQHALLPLVALSYAANFAGRSMVDMHDKVLAMVTSGQSDFATQSAQLHAISSGLKGWLADRVNDGIEHCRRLCGGHGFLQSSNLAHLFAETAGSCTYEGTADVLVQQHARYLLKELSSIATAQNEQFVGFLSRSDYYSSPKLRCRAKSSADLGSLKVLIEAFEVRAARSIRNLSRAMKKSNDNANACMVLMTAASTHHTELLLLKWFIAGAALLPVGTTKNAVTQLCQLFGVWLLVNGLGNFRHDGYFSSAQADMAHHQLAAMLPLVRQNVVRLTDGWNFSDFELNSTLGCFDGDIYRSSPDGYDKYLRPLIQSSL

SEQ ID NO: 894 - protein, 402 aa, Corynebacterium genitalium; identical to SEQ ID NO: 875

SEQ ID NO: 895 - protein, 664 aa, Arabidopsis lyrata
MERVDHLADERNKAEFNVDDMKIVWAGSRHAFDVSNRISRLVANDPIFEKSKRAVMRRKELFKNTLRKSVHAWKMINELRLSDEEGIKLRSFMDQPGFLDLHWGMFVPALKGQGTEEQQHKWLSLANKMQIIGCYAQTELGHGSNVQGLETTATFDPKTDQFIIHSPTQTSSKWWPGGLGKVSTHAVVYARLITNGKDHGVHGFIVQLRSLDDHSPLPGITVGDIGMKFGNGAYNSMDNGFLMFDHFRIPRDQMLMRLSKVTREGKYVASDVPRQLVYGTMVYVRQSIVSNASTALARAVCIATRYSAVRRQFGSQDGGIETQVIDYKTQQNRLFPLLASAYAFRFVGEWLKWLYTDVTKRLDTSDFATLPEAHACTAGLKSMTTSATSDGIEECRKLCGGHGYLWCSGLPELFAVYVPACTYEGDNVVLQLQVARFLMKTVSQLGSGKAPSGTTAYMGRAKHLLQCRSSVRNAEDWLNPGMVLEAFEARALRMAVTCANNLSKFENQEQGFSELLADLVEAATAHCQLIVVSKFIAKVEGNIEGKGVKKQLKNLCYIYALYLLHKHLGDFLSTNSVTPEQGSLANRQLRSLYSQVRPNAVALVDAFDYTDHYLGSVLGRYDGNVYPKLFEEALKDPLNDSVVPDGYHEYIRPLIKQRFRSAKL

SEQ ID NO: 896 - protein, 664 aa, Arabidopsis lyrata
MEGVDHLADERNKAEFDVEEMKIVWAGSRHAFEVSDRIARLVASDPVFEKSNRARLSRKELFKSTLRKCAHAFKRIIELRLNEEEAGRLRHFIDQPAYVDLHWGMFVPAIKGQGTEEQQKKWLSLASKMQIIGCYAQTELGHGSNVQGLETTATFDPKTDEFVIHTPTQTASKWWPGGLGKVSTHAVVYARLITNGKDYGIHGFIVQLRSLEDHSPLPNITVGDIGTKMGNGAYNSMDNGFLMFDHVRIPRDQMLMRLSKVTREGKYVPSDVPKQLVYGTMVYVRQAIVADASIALSRAVCIATRYSAVRRQFGAHNGGIETQVIDYKTQQNRLFPLLASAYAFRFVGEWLKWLYTDVTERLAASDFATLPEAHACTAGLKSLTTTATADAIEECRKLCGGHGYLWCSGLPELFAVYVPACTYEGDNVVLQLQVARFLMKTVAQLGSGKVPVGTTAYMGRAAHLLQCRSGVQKAEDWLNPDAVLEAFEARALRMAVTCAKNLSKFENQEQGFQELLADLVEAAIAHCQLIVVSKFIAKLEQDIGGKGVKKQLNNLCYIYALYLLHKYLGDFLSTNSITPKQASLANDQLRSLYSQVRPNAVALVDAFNYTDHYLNSVLGRYDGNVYPKLFEEAWKDPLNDSVVPDGYHEYLRPVLKQQLRTARL

SEQ ID NO: 897 - protein, 664 aa, Arabidopsis lyrata; identical to SEQ ID NO: 895

SEQ ID NO: 898 - protein, 664 aa, Arabidopsis lyrata; identical to SEQ ID NO: 896

SEQ ID NO: 899 - protein, 699 aa, Arthroderma otae; identical to SEQ ID NO: 852

SEQ ID NO: 900 - protein, 681 aa, Callithrix jacchus
MGSPVHRVSLGDTWSRQMHPDIESERHMQSFDVERLTNILDGGAQNTALRRKVESIIHSYPEFSRKDDYFMTQNERYKAAMRRAFHIRLTAQRLGWLADGPELGYAYRAISGDVALNIHRVFVKALRSLGTEEQIAKWDPLCKNIQIITTYAQTELGHGTYLQGLETEATYDAATQEFVIHSPTLTATKWWPGDLGRSATHALVQAQLICSGARRGMHAFIVPIRSLQDHTPLPGIIVGDIGPKMDFDQTDNGFLQLNHVRVPRENMLSRFAQVLPDGTYVKLGTAQSNYLPMVVVRVELLLGEILPLLQKACVIAMRYSVIRRQSQLRPSDQEAKVLDYQTQQQKLFPQLAISYAFHFLAVSLLEFFQRSYSAILNRDFSILPELHALSTGMKAMMSDFCTQGAEMCRRACGGHGYSKLSGLPSLVTKVSASCTYEGENTVLYLQVARFLVKNYLQTQMSAGSAQQRSLPPSVAYLTAPVLARCPAQRAADFLCPELYTTAWAHVAARLIKDSVHHLQTLTQSGADQHEAWNQTTVIHLQAAKAHCYYVTVKGFAEALEKLENEPAIQQVLKRLCDLHAIHGILTNSGDFLHDSFLSGAQVDMARTAYLDLLFLIRKDAILLTDAFDFTDQCLNSALGCYDGNVYERLFQWAQRSPTNTQENPAYEEYIRPLLQSWRSKL

SEQ ID NO: 901 - protein, 760 aa, Robiginitalea biformata; identical to SEQ ID NO: 772

SEQ ID NO: 902 - protein, 402 aa, Streptomyces sp.; identical to SEQ ID NO: 879

SEQ ID NO: 903 - protein, 682 aa, Paracoccidioides brasiliensis; identical to SEQ ID NO: 808

SEQ ID NO: 904 - protein, 694 aa, Paracoccidioides brasiliensis; identical to SEQ ID NO: 811

SEQ ID NO: 905 - protein, 697 aa, Glossina morsitans
MVAFTNNSSGSQILEDKSIFPDFKNGPLQHYRDKSSFCYKRMNILLEGEDHIRLKHRIWQFMENHADFQHEIETPILDRMRQTATKRCQILQSAELYSFDQYMNRPHLSIAFAQAIFSYDVNFSIKYTLTNAMVPSVIMSLGTEHLHDYVFKGIKGEIRFAFALTEISHGTNARGMRTQATYDKESREFVLHTPDFEAAKCWAGNLGKTCTHAVVYAQLYIPDNYNRGLHAFLVPIRNERTLDAYPGVTVGDLGEKIGLDGVDNGFVMFNHYRIPKENLLSRNDNVDDNGNYHSRIKDNRKRLGASLGALSGGRVNICTLAYISLSKAISIAIRYSASRKQFGPDDSVEEYPVLEYQAQQFRLFPHLAKSYALRIFSLWLCYRNVDMTIKAMNGEDTSLVGMEIHVMSSACKPVCSWIARDGIQECREACGGHGYLKCGRLGDLRNENDANCTYEGENNTLIQQASNWLINLRRQNMNFEENSPLTSVSFLKDMDSLLLEKTKVRTPAEAMKPENLLQALNWLCAYQLEKAVKRSVHLTELGLNSFDSRNEMQVFNAQTLAIIYGERTLYYVFFNFVRELPESAEKRVLQKLLSMFGCNLIVKHAGLFYMGGYFETQQLDLYHQAILLLLPEIKPEAISLVDAIAPPDFVLNSSLGMSDGNVYQHLQNTIMSAPGVFERPDWWREVTYRSDQTKSKL

SEQ ID NO: 906 - protein, 750 aa, Naegleria gruberi
MSSLISNNNTSANRRLAVHLNHLVPSTTSPLAQQASSSNNSSSTIEQQVCAGQIIQANPTLGYTYPNEENDRYSSISYNYNHTFDVKKMQAWLNGSFDKKAMYKFLDNPLLLKRSTNMPKEEARELTLQQVAFLCKSGLYRISDMKKTPELILNRLENTGLIESSSNVKLGVQLVLFAGSILNLGTKKHHDKYLKAAECIELPGMFAMTEIEHGSNVRQLQTTATFDENTNEFIINTPNKGAVKWWLGNAACHGVMATVFARLILKGKDYGVHAFLCPIRDAQTHKLMPGVIAGDCGDKIGLHGIDNGFLEFTNVRVPYDNLLDRFGGIDLNTKSYKSDYENPDRRFAAVLGELITGRVTLISGSINCRRAALMIATRYASQRCQFGPGKDLPEQPILDYKSHKVKLMPIIASAYAYEFTKRKVIKKYCRMHLEKVSDDELQEVHALAAGVKAVITWDTQEYLQTLREMCGGHAYSAYNRLGAVRDDHDVFQTFEGDNTVLIQQLGGFLLKEFSRQFTGEMISDSINYIRKQVGGMLTKRNPVITRFASKKHLRNSEFHLQAFEYRTAKLLQECAIEINGRKKKQGMFHAFNESLPKLIRLGRAYVEQVALQDFLSEIENITDSELKRILKLMADLFALDTMSKNIGEFLDLIKKNKFSAIQNMIEWLCDELRVHAVSLVDAFGFPDFLLDAPIGKRDHGNYVHHILDYALTRNKGNADIVGKMVTAKKVNKKQVVRDERETNDVMEIDL

SEQ ID NO: 907 - protein, 604 aa, Saccoglossus kowalevskii
MEVNLDLQIERDNATFDAVELTYIKDGGAKVTQRRRYIESLVCDDPDFQQEDPNFLSRDELYTSAVRRGVMIEKKILQLNITDAKEYAAIGKRHGTAIELHSKMFVPTLIGQASEKQKRKWLPLEENLHIIGTFAQTELGHGTFVRGLETTSTYDPKAQEFVVHSPTLSSTKLWIGNLGKTVTHAIVMAQLITNGKQYGVHPFIVPLRSLENHMPLPGVTVGDIGPKMRFNSNDNGFLRLDHVRIPRDNMLMKHTRVLADGTYVKPPTNKLVYGTLVYARVGYLLTCTDCLAMACTIVSRYSAVRRQSEMQPGAREAHILDYQSQQLKILPYIATTYAFYTVERRVSGMYDRLQQQMATGNFSHRQKFNAVTAGLKGFVSYVTNSGIETCRLACVGHGYSHATNYKFVKVKQQHWYLIKCAGSTLSGDVLSGQVPYLNEPIIEKCAITSESDLLKLDILVDIYKHRAQRLIVTVSAFVGSVKDTKMSDSLKLVLTSLCQLYALYGIYQDSRDFMMDCYLSGHNITSITHHITSMLATLRPNAVALVDAFDIRDEILCSILGRYDGNVYENMYKWAKKSPLNKNEVHDFCYEYLKPFLRSQPSKL

SEQ ID NO: 908 - protein, 668 aa, Saccoglossus kowalevskii
MSLKESSPIRVNPDLRKEREKASFNISELTYIIDRGEDKTNRRRYLVSLALNDPDFNETNMNFLSRDEQYSSVVRRSVHIVQKLRKMKLTDLKDQFIYKAAALRGHGSIFAIHDLMLIPMLQNFATDEQKKIFLSKALNYEITGTYLQTELGHGTFVRGLETTATYDPEHQEFVINSPTLTSTKWWPGMLGKSANFAVVMAQLYSKGKHCGLQSFLVPLRSFEDHRPLPGVTLGDIGPKFGAESNDNGFCRFDHVRIPRINMLSKYATISPSGIYSAPVSDKIIYGAMVLTRITLVAAAARVLSFGCTIAIRYSAVRRQTELTPGGEEPQIIYYQSQQLKLFPPLATAYAFLFAAHNIRDRCDQIQDDIIAGNMSSIQELHGLSSAMKGFSSLSATSWLETLRLSCGGHGYSHASGFPNLYTNATALVTVEGEYSVMMLQTARYLIKCISMATSGDKLPSLALYLTSPPPAKCSARSSTDFLNLDLLVDAYTHRAFRLVSVAGKTLQSKIVSGKPHHIAWNESHIELLKAAEVHSHYYVVKNYVNSVKQLTMSQPLKSVMISLCQLYALHGIQQSAGDFLQDGYMNGNQIAMATEQMLLLLDVIRPNAVALCDAFDVPDELLGSILGRYDGNVYENMYLWAKSSPLNKTEVHESYYQYLKPMLKGSKL

SEQ ID NO: 909 - protein, 707 aa, Saccoglossus kowalevskii
MSVQLPHPCINAMPDKRTIDELIPDMPVGPIDKYRKSATFDWKQMKMFLEGEDCIRYQNEIWDLLEKDPLFARSVGTVSVNEMRMLVFQRVKRLSEYYFLTQEKLLENPMVYLWFFSAIGLYDWALPTKFLLSTQFFGGTIRSSGSKHHLDLADQSDRMELIGSFSLTELSHGSNVKNMRTTATFDPETKDFILNTPDIEATKIWMGNVGKTATHSIVYAQLYTADGKCHGLHMFVVQIRDTKTLLPLPGIMVGDIGHKLGLNGLDNGFLMFNNVRIPRQSLLNKTGDVTSAGKYTTPFLDPEKKFGASLGTLSGGRVGIVSVCAGNLKICVPIAIRYSAARKQFGPTNDKEIPVLEYQLQQWRLIPYLAAMYAIEIFSKQFMKYYLELNIGTLLKSDAVYLAELGKELHAVACSSKPLTSWLARDAIQECREACGGHGYLSVSRFGEIRGDNDANTTYEGDNNVILQQTSNYLLICRENKQNGVQITAPMKTVNFLNDADTILKWKFQATTAVQCYDAAIALAAYKWLVCYQLKESADKLNKESSSGKDGFEARNDSQAYFARSLALMFIEHTVLQWFYDCVNDPAVPPGLAPVLKKLCALYGLWSLEKHMATLYQGGYMSGRDPARLIREAIVQLCRILKDDAVALVDVIAPRDFILNSALGKADGEIYKNIFSSIMKTPKVMERPDWWREFCNKPVQDSLRGKL

SEQ ID NO: 910 - protein, 750 aa, Naegleria gruberi; identical to SEQ ID NO: 906

SEQ ID NO: 911 - protein, 653 aa, Streptomyces albus; identical to SEQ ID NO: 759

SEQ ID NO: 912 - protein, 827 aa, Trichophyton verrucosum; identical to SEQ ID NO: 885

SEQ ID NO: 913 - protein, 699 aa, Arthroderma benhamiae; identical to SEQ ID NO: 887

SEQ ID NO: 914 - protein, 693 aa, Aspergillus flavus; identical to SEQ ID NO: 867

SEQ ID NO: 915 - protein, 694 aa, Aspergillus flavus; identical to SEQ ID NO: 753

SEQ ID NO: 916 - protein, 669 aa, Polysphondylium pallidum
MDSALERLQTLSCHLESNDTASLIQSVRTAATADWRLPVLDADKVDKLKEVLLGHPKPEEQVRETKQKLYELMKDPIFRPHPYANVPEQRDLTLKRLKMVASLGILKMGEVAEQFKRFVAFQESLVLSDMSLAVKSSVQWGLFAGSIVFLGTDKHKKYYQDTDCLNILGCFALTELGHGSNVKGVETLAEYDHSTREFVIHTPNDSAQKMWIGNAGQHGTYATVFANLVVKGENHGLHPFLVQIRDPKTGQTLAGVTCADCGPKMGLNGVDNGRIWFNRVRIPYDNLLNRFGDVNKKGEYTTMIKNPNVRQNSMLEALIGGRVTVSSMALNASKLGLTIAVRYALQRRQFGNPEELLIDYLSHQRRLFPLIAATYAYQISVHYVISRFSNRTEKDARDVFLLACGFKAASTWHRSDTLQICREACGGFGFAASSRIGIYKSDADVDLTYEGDNTVLMQAVAKALLVEFKSYFTGTKAITGMLSYTYSKGHIGIFLRNKNFFVKRLHTESHLLDAEMLLDAFIYREFKLLRQLVKSLRTKVKNEKMSGAKAWNSCLDLVHKLAISYVERVTIEKFLEEIQKSDEGIKPILSLLCILFALTKIEGDMGWFLSNKYFAPVKAQAIENAINKVCGALREHALPLVNAFDIPEHLISAPIAGDYVAHFSDPKNY

SEQ ID NO: 917 - protein, 421 aa, Polysphondylium pallidum
MEDQINRRLSVLSDHLQTNQVSSNTESNDVDSLDYYSITQLLSNDQLDIRNKAKQFAEQHIQPIVNEYYEKAEFPMHLLPKLKELNWAGSNIKGYSCPGIDAVSCGLIAFEFAKKSADIATFFGILQTISMLPIYYCGSEKQKQYYLPKMASMEKIGAFGLTEPNAGSDAAGLFCEAKQNSDGTWTLNGEKRWIGNAPFADVVIIWARNTDTKLINGFVIEKNTPGMTVETINNKIALRMVQNGHIYLKNCILSDENRLPLAKDFGSGPGKSLFLTRIVASWIALGIACSAYESCIKYVKERKQFGQSLAKYQLVQERLVKMLGIIQSMSLMTLRISHLFDQNKLTYGQVGLLKAHNTSHGRQVVSMARELLGGNGIVTDFGVARSFVDMEAVHTFEGTYDINTLITGREITGFPAFKTGK

SEQ ID NO: 918 - protein, 664 aa, Solanum cheesmaniae
MEGVDYLADERKKAGFDVDEMKIVWAGSRHDFELTDRISKLVASDPGFSKEGRTMLPRKELFKNTLRKAAYAWKRIIELRLSQEEATMLRRYVDEPAFTDLHWGMFIPAIKGQGTDKQQEKWLPLAYKMQIIGCYAQTELGHGSNVQGLETTATFDPQTDEFVIHSPTLTSSKWWPGGLGKVSTHAVVYARLITDGKDYGVNGFIVQLRSLEDHKPLPGVTVGDIGMKFGNGAYNSMDNGVLSFDHVRIPRDQMLMRVSQVTKEGKYIQSDIPRQLLYGTMVYVRQSIVADASLAMSRAVCIATRYSAVRRQFGSQNGGQETQVIDYKTQQNRLFPLLASAYAFRFVGEWLKWLYTDVTQRLAANDFSTLPEAHACTAGLKSLTTSATADGIEECRKLCGGHGYLCSSGLPELFAVYVPACTYEGDNVVLQLQVARFLMKTISQLGTGKKPVGTVSYMGRIEHLMQCRSDVKQAEDWLKPSAVLEAFEARSARMSVACAKNLSKFENQEEGFAELAADLVEAAVAHCQLIVVSKYIEKLQQNIPGKGVKQQLEVLCGIYSLFILHKHQGDFLGTGYITSKQGSLANDQLRALYSQLRPNAVSLVDAFNYTDHYLGSILGRYDGNVYPKLYEAAWKDPLNKSDIADGFHEYIRPLLKQQLRTAKL

SEQ ID NO: 919 - protein, 649 aa, Solanum lycopersicum; identical to SEQ ID NO: 570

SEQ ID NO: 920 - protein, 664 aa, Solanum lycopersicum; identical to SEQ ID NO: 569

SEQ ID NO: 921 - protein, 709 aa, Candida dubliniensis
MSFTKKNVSLAQGPDPRSSIQTERANSKFNPEKMNYFLEGSKERSELFKGLAQQMERDPVLFTDGSYYDLTKDQQRELTAVKINRLARYRETDSIDTFNKRLSLVGVFDPQVGTRIGVNLGLFLSCIRGNGTAEQLKYWAFDKETSNIKGIYGCFGMTELAHGSNVAGLETTATFDKENDEFVINTPHVGATKWWIGGAAHSATHCSVYARLIVDGEDYGVKTFVVPLRDSNHDLMPGVTVGDIGAKMGRDGIDNGWIQFSNVRIPRFFMLQKFCKVSADGEVVLPPLEQLSYSALLGGRVMMVLDSYRMLARMSTIALRYAIGRRQFKGDNVDQNDPNALETQLIDYPLHQKRLFPYLAAAYVISAGALKIEHTIETTLEELDQAVAKGDQRAIFKSIDDMKSLFVDSGSLKSTATWLAAEAIDQCRQACGGHGYSSYNGFGKAYNDWVVQCTWEGDNNVLGMSVGKPIVREVINLEDKGKKVRGSTAFLNQLKEYTGSNSSKVVLDSVADLDDVNKVIKAIEVAIIRLAQEAATTVRKESLDFVGAELVQLSKLKAHHYSLTEYVRRVNEFDQKDLVPYLLTIAKLYGATVVLDKFAGVFLTFNVASTKAITDLASVQIPKLCAEVRPNVVAYTDSFQQSDMIVNSAIGRYDGDIYENYFDLVKAQNPPSKTKAPYSAALEAMLNRPSLEARERFEKTDETAEILSK

SEQ ID NO: 922 - protein, 703 aa, Culex quinquefasciatus
MSEFNTISRPSQRPDLLNNTTHFPELPKSGPLTEYRRRATIDWRKVKLAFNDEASLELQQKVWNFFQNNPLFARPSQTLSLDESRRLATKRMYAIKEENIFGIDALLERPDFMGYFSHLLMAYDPSFSIKFSLGFGMFPSVIQALDVGRLSHLVEQNQRGEILGSFGLTEISHGTNAKGMRTTATYDVKSKEYILHTPDFEAAKCWIGNLGKTCTHMVCYAQLYSADGKHHGLNAFVVPIRDPKTLNAYPGVIVGDLGEKAGLQGLDNGFVMFRNYRISRDYLLARTGDVNEEGVFVSPYKDENKRFGASLGALSGGRVGICGIANMYLMKAISIAIRYSASRKQFGPDDKSEEWPVLEYQSQQYRLYPHLANAFTIKMFTLWFAKIYGEIFLKTLTGERVEHVGMEIHALSSAAKAICTWAARDGIQESREACGGHGFLKLSTLGDLRGDNDPNCTYEGENNVLIQQTSNWLLNVRFSGYENFKVASPLGSAQFLKDYANHNDFRASWKTPSEATDINVIMEALNWLVAYLLDTTAQKVANLKKQGKSSFTARNESQSFYARTLSMAYGERVIMFAAMKFLRNLEDGPEKVALTRLVSLFGANVVIKHVGVFYQGGYFAKTANALELLQQGVLDLLPLITVDSVALIDAIAPPDFVLNSPLGMSDGEVYKHMESAILQAPEALERPKWWREVVYRDYVKPKL

SEQ ID NO: 923 - protein, 664 aa, Arabidopsis thaliana; identical to SEQ ID NO: 68

SEQ ID NO: 924 - protein, 664 aa, Arabidopsis thaliana; identical to SEQ ID NO: 68

SEQ ID NO: 925 - protein, 664 aa, Arabidopsis thaliana; identical to SEQ ID NO: 68

SEQ ID NO: 926 - protein, 664 aa, Phytophthora infestans; identical to SEQ ID NO: 889

SEQ ID NO: 927 - protein, 660 aa, Phytophthora infestans; identical to SEQ ID NO: 890

SEQ ID NO: 928 - protein, 640 aa, Phytophthora infestans; identical to SEQ ID NO: 891

SEQ ID NO: 929 - protein, 676 aa, Phytophthora infestans; identical to SEQ ID NO: 892

SEQ ID NO: 930 - protein, 622 aa, Phytophthora infestans; identical to SEQ ID NO: 893

SEQ ID NO: 931 - protein, 663 aa, Candida albicans
MTTELQKEREQIKFNPKEVNYFLEGSKERSDIVSNLVEQMEKDPVLKVDASYYNLTKEEQREDTAKKIDRISRYFENEFPDQQAQRLSILGVFDPQVFTRIGVNLGLFVSCIRGSGTNSQFFYWTINKGVDKLRGIYGCFGMTELAHGSNVQGIETTATFDKETDEFVINTPHIGATKWWIGGAAHSATHCTVYARLKVNGKDYGVKTFVVPLRDSNHDLMPGVTVGDIGAKMGRDGIDNGWIQFSNVRIPRFNMLQKYAKVSREGEVTMPPSEQLGYSALIGGRVTMMMDSYRMTSRFVTIALRYAIFRRQFKSKISGGDQETKLIDYPLHQKRLFPYLAAAYLFSQGALYLEQTMNETNERLDDAVSEGDKKKIDEAIVASKKLFVASGCLKSTCTWLTADAIDQARQACGGHGYSSYNGFGKAYSDWVVQCTWEGDNNMLAINVAKPMVKEILQEPEQKGLVIANVSDLNDPAKLDKAFEHALSGLARDIGAVAKDQGYDVTGPSLVLVSKLNAHKFLIDGFFKRITPEFAPILKPLGFLYADWIIETFSSVFLSYGVIAPEVIKKISSEHFPALAKQIRPNVAGLTDAFNLSDMLINAAIGRADGNVYDHYFETVKKLNPPENTKAPYSQALQDMLNRPSVEERQRGERSEEAAEILSS

SEQ ID NO: 932 - protein, 709 aa, Candida albicans; identical to SEQ ID NO: 641

SEQ ID NO: 933 - protein, 724 aa, Candida albicans; identical to SEQ ID NO: 640

SEQ ID NO: 934 - protein, 683 aa, Homo sapiens [sequence omitted]

SEQ ID NO: 935 - protein, 681 aa, Homo sapiens; identical to SEQ ID NO: 342

SEQ ID NO: 936 - protein, 662 aa, Candida tropicalis
MPTELQKERETIKFNPKELNYFLEGSQERSEIISNMVEQMEKDPILRVDASYYDLTKDQQREVTAKKINRISRYFENEFPDQQAQRLSILGVFDPQVFTRIGVNLGLFVSCVRGNGTNSQFFYWTINKGIDKLRGIYGCFGMTELAHGSNVQGIETTATFDEDTDEFVINTPHIGATKWWIGGAAHSATHCSVYARLKVKGKDYGVKTFVVPLRDSNHDLEPGISVGDIGAKMGRDGIDNGWIQFSNVRIPRYFMLQKYCKVSREGEVTMPPSEQLSYSALITGRVTMMMDSYRMTSRFITIALRYAIHRRQFKSKDSATEETKLIDYPLHQKRLFPYLAAAYLFSQGALYLEQTMNKTNDKLDEAVAGGDKAEIDAAIVESKKLFVASGCLKSTCTWMTAEAIDEARQSCGGHGYSAYNGFGKAYSDWVVQCTWEGDNNILAMNVAKSMVRDLLQQPEQKGLVLSSVEDLNDPAKLVKAFDHALSGLARDIGAVADEKGFDITGPSLVLVSKLNAHRFLIDGFFKRITPEWSDILKPLGYLYADWILTNFGATFLSYGIISPEVSRKISSEHFPSMCAKVRPNVVGLTDGFNLTDMMVNAAIGRYDGNVYDNYFETVKSLNPPENTKAPYSKALEDMLNRPDLEVRQRGEKSDETAEILSS

SEQ ID NO: 937 - protein, 709 aa, Candida tropicalis
MTFTKKNVSVSQGPDPRNSIQTERANSKFDPQVMNYFLEGSVERSELMKSLAQQMERDPILFTDGSYYDLTKEQQRELTAVKINRISRYREQESIDTFNKRLSLIGVFDPQVGTRVGVNLGLFLSCIRGNGTAAQLKYWAGDKETANIKGLYGCFGMTELAHGSNVAGLETTATFDKETDEFVINTPHIGATKWWIGGAAHSATHCSVYARLIVDGEDYGVKTFVVPLRDSNHDLMPGISVGDIGAKMGRDGIDNGWIQFSNVRIPRFFMLQKFCKVSADGEVILPPLEQLSYSALLGGRVMMVLDSYRMLARMSTIALRYAIGRRQFKGDNVDQKDPNALETQLIDYPLHQKRLFPYLAAAYVISAGAYKIEQTIDSTLAQLDEAVEKNDEKAIFKSIDDMKSLFVDSGSLKSTATWLGAEAIDQCRQACGGHGYSSYNGFGKAYNDWVVQCTWEGDNNVLAMSVGKPIVRQVISIEDSGKPVRGSTSFLNQLKEYTGSNASKVVLNNVADLDDVEKVIKAIEVAIIRLSQEAASIVRKESFDYVGAELVQISKLKAHHYLLTEYTRRINEFDQKDLVPYLRTLAKLYAATIVLDRFAGVFLTFNVASPAAISSLASVQIPKLCAEVRPNVVAYTDSFQQSDMFVNSAIGRYDGDVYENYFDLVKTLNPPSKTKAPYSAALEGMLNRPSLDERERFEKSDETAAILSK

SEQ ID NO: 938 - protein, 725 aa, Candida tropicalis
MAMLTKSKSDGLDHPEKKDPDTNPKVVANVISSREPPQPAKDVAEERNRTDWDLKEMHEFLEGDEAKSEQILRLYQSIERDPILQTRPEQFDNTQKQEREMVANRINQMSKYLETEPYGKFRRRLQLMTVIDPSLGIRMLVNIGLFLNCVRGNGTQKQFDFWSKKKEAGIVKQLYGCFGMTELGHGSNVAGCETTATFDEETDEFIIDTPHIGATKWWIGGAAHSATHTVCYARLIVKDIDYGVKTFIVPLRDSGHNLLPGVAIGDIGAKMGRQGVDNGWIQFTEVRIPRFFMLQRWCKVDRQGNVTLPPLEQLSYISLLEGRVGMATDSYRIGARYTTIALRYAVGRRQFAKKEGEPETKLIDYTLHQRRLLPYLALTYAAAVGTDRLERQHEELLSNLDIALAKKDKLLLKNTITGTKSMFVDSGSLKSTLTWLAADLINETRQACGGHGYSAYNGFGKTYDDWVVQCTWEGDNNVLAMSAGKTIIKTVQQVLNGKPLQDSTLEFLNDAPELSKAKKAVIRIKDHVDDVDRVLKAIAGLISKLSKDLIPVSYQSWDSIAPQRVILSKLRCHYYLLETFSERLNDRIKAKSPARPHLENIIKLYYVTNILGPFIDEFLRFGVISPQVAKYITLEYPQKLCANVRPYVIGLTDSFQQPDNFINSLIGKYDGNIYTNYLESVKDVNSPFNYKAPYSEALEAMLARSSIEERERFERSKEAANILSK

SEQ ID NO: 939 - protein, 664 aa, Ricinus communis
MEGVDHLAEERNKAQFDVDEMKIVWAGSRHAFDVADRMARLVASDPAFRKDNRAMLSRKELFKNTLRKAAHAWKRIIELRLSEEEASKLRTFVDEPAYTDLHWGMFVPAIKGQGTEEQQKKWLPLAHKMQIIGCYAQTELGHGSNVQGLETTATFDLETDEFVIHSPTLTSSKWWPGGLGKVSTHAVVYARLITEGREHGVHGFIVQLRSLDDHMPLPGITVGDIGMKFGSGAYNTMDNGVLRFDHVRIPRNQMLMRVMQVTREGKCVQSKVPRQLIYGTMVYVRQTIVADASAALSRAVCIATRYSAVRRQFGSNDGGVETQVIDYKTQQSRLFPLLASAYAFRFVGEWLKWLYTDVTQRLQANDFSTLPEAHACTAGLKSLTTSFTADAIEECRKLCGGHGYLTASGLPELFAVYVPACTYEGDNVVLLLQVARFLMKTVSQLGSGKKPVGTTAYMARVEHLLQCRCGAQKAEDWLKPNVILEAFEARAARMCVTRAQSLSHYPNPEEGFAELSADLVEAAVAHCQLIVVSKFIEKLQQEIPGKGVKQQLQILCYMYALNLLHKHQGDFLSTGCITPKQASLANDQLRSLYSQVRPNAIALVDAFNYTDHYLGSVLGCYDGNVYPKLYEEAWKDPLNDSVIPDGYNEYVRPMLKQQLRNARL

SEQ ID NO: 940 - protein, 671 aa, Pediculus humanus; identical to SEQ ID NO: 755

SEQ ID NO: 941 - protein, 703 aa, Komagataella pastoris; identical to SEQ ID NO: 110

SEQ ID NO: 942 - protein, 703 aa, Komagataella pastoris; identical to SEQ ID NO: 110

SEQ ID NO: 943 - protein, 709 aa, Candida dubliniensis; identical to SEQ ID NO: 921

SEQ ID NO: 944 - protein, 661 aa, Ixodes scapularis
MATGGVCEELRRERSGATFDIAELTHLLDGGRDKTERRKELEKLFHEDPEFQSDVPYCYLTYSEAYSDALQKCLKIYQKAMVLSDPREILTVADAILHDSTPVHVHFVMFVPALMGHANEEQQAKWLSDALMMKIVGSYAQTELGHGTFIRGLETKATYDPATEEFVLHTPNLSSIKWWPGSLGKTANHAIVLAQLHTKGKCYGIHPFMVQIRSMENHEPLPGITVGEIGPKMGMRAADNGFLKLDHVRIPRENMLMKNAQVTKEGDYIKPASDKLNYGTMVFVRVLLLDMFAFNIARACTIAIRYSAVRRQSEITPGQGENQIMDYQAQQYKLFPLLGLCHSLRAMFANLMELYKQANQDMEQGNLEMLPELHAISSGLKAFCSDMAAKGIETCRLACGGHGFLLISGLPRLYATTVAACTYEGENTVMYLQAARYMIKCLAQPQQLSRNSTFRFLLEPGTLHVPPFNARLKGREAIRQLVPFYRAAAYKQVHRADAKVKSLIKSGLTPEIAWNHSQVDLIIASKVTTLYKAVLETLLSECDTVKPLSASEWRLMAAVVQVLQPLKQATAELSGDSYPTLSQVIPLLDIITELLKRLRPNAVPLVDAFDHHDMVLSSALGSYDGRVYERMYESALKAPLNKTQVHESYHNFLEPLMKSKL

SEQ ID NO: 945 - protein, 693 aa, Coccidioides posadasii; identical to SEQ ID NO: 218

SEQ ID NO: 946 - protein, 651 aa, Coccidioides posadasii; identical to SEQ ID NO: 884

SEQ ID NO: 947 - protein, 662 aa, Candida tropicalis; identical to SEQ ID NO: 936

SEQ ID NO: 948 - protein, 709 aa, Candida tropicalis; identical to SEQ ID NO: 937

SEQ ID NO: 949 - protein, 725 aa, Candida tropicalis; identical to SEQ ID NO: 938

SEQ ID NO: 950 - protein, 710 aa, Lodderomyces elongisporus
MVFTQKTVSLSQGPDPRTSIQKERAEQKFDPQEMQIFLEGSKERAELIKSLVQQMERDPILWTDGSYYDMTKEQLREQTALKINRVSRYLETDSIDVFNRRLSIIGVFDPSVTTRIGVNLGLFISCIRGNGTYEQLKYWALDKETAHIKGIYGCFGMTELAHGSNVMGLETTATFDKDNDEFIINTPHIGATKWWIGGAAHSATHCTVYARLIVDGEDYGVKTFVVPLRDSNHDLMPGVTVGDIGAKMGRDGIDNGWIQFSSVRIPRFFMLQKFCKVDRDGDVILPPLEQLSYSALLGGRVMMVMDSYRMLARVSTIALRYAIGRRQFKGDNVDPDDEEALETQLLDYPLHQKRLLPYLAAAYVVSAGALEVERTIEATLLELDDAVDENDEAGIMKAIDAMKSLFIDSGSLKSTCTWLAAEAIDQCRQACGGHGYSAYNGFGKAYNDWVVQCTWEGDNNVLGINIGKPLVKHVIAIEDDGKVVKGSSDFLNQLKEFTGKEGSEKVILDNAADIEDVKKVIKAIEVAIIRASYTAGKTVREKSFDYVGAELVIISKLKAHHYLLTEYVKRIDEFDQEDKKPYLYQLAQLYGATIVLDKFAGTFLAYNVISTKATAELASQVIPKLCSAIRPNVVGLTDSFQQSDMMINAPIGRYDGDIYENYFDLVKVLNPPKNHKAPYSAALEAMLNRPSLSERERFEKSLETGEILSK

SEQ ID NO: 951 - protein, 723 aa, Lodderomyces elongisporus
MALLPNSKLFHKNNKVDPEKNPKIVENVISSRPPPTPAKDIADERARTNWDLKEMHEFLEGSEAKSTEVIRLYQSIERDPILQTRPEQFDLTQKEERQVVAERIDQMSKYIETESYSKFRRRLQLMTVIDPSMGIRILVNLGLFLNCIKGNGTQKQYDFWAKKKEAGSLKQMYGCFGMTELGHGSNVAGCETTATFDEESDTFIIDTPHIGATKWWIGGAAHSATHTVCYARLIVKDVDYGVKTFVVPLRDSQHNLLPGIAVGDIGAKMGRQGVDNGWIQFTEVRIPRFFMLQRWCKVSRQGNVTLPPLEQLSYISLIEGRVGMAADSYRIGARFTTIALRYAVGRRQFAKNGAQQELQLIDYTLHQRRLLPYLALTYAAAVGTDRLEVEHNELLANLDKGLATNDKLLLKNTINSTKSMFVDSGSLKSTLTWEASDLIAECRQSCGGHGYSSYNAFGKTWNDWSVQTTWEGDNNVLAMSAGKTIIKNVQQILNGKKLKNSSLEFLNDAPTLSKAKKAVIRIKEHVDEPQRVLKAIAALISKFAVDLIPISHQSWDAIGAQRVTLSKLRCHYYLLETFIERLENQVKANSPIRPQLENLLKLYYVTNILGPFLAEFIRFGVIQPKVAQYITSIYPQELCLRVRPYVIGLTDSFEQPDNFIHSLIGKYDGDIYNNYLSAVKITNSPRNHKAPYSEALEQMLNRVSIDERARFERSKEVEALLSK

SEQ ID NO: 952 - protein, 662 aa, Tetrahymena thermophila
MNPNLEEERKKCSINVFELASFLHSNTDSLDQFLLIQKMFEEDPLLKFKPEDIGASTERTHILIAQRNACISKILKAEKNIWIENYINCMVDLPVSSSVHSSVCIPYLKLLASDEQLATILPKAEAFQIQICYCSAELAHGSDLNSVQTEAHYDEQTDEFIINTPHHGATKWWIGDYGKLATHGIVFSQLFVNKVKQGVAAFLIPIRNTSQQAQLLPGIVVGDVETKHAGAQNDNGFVRFNQLRVTKESLLQRYITLNKKGQVQLQENKKILLSNMIQKRIGHVLELGLLLAQASTIAVRFSLVQDRYYNDQFGTKYIKNLDYQVIQQKVLPQLSQSYLILLTWFEMKNLSQRNIELCQKGDFSISSEVKAISNGLKALTSRLSYIGVENLRQACGNVGLSQYSGFNQILSKISSFPLYEADSVSLQEYTAKFLQKKLKDKNDESPFTKFLNHQRVQSKCNLLSEHEYEDLTNLLFILEQRAQFLALTLQKKIEQQEIANKTKQTSLESTESLTAELSDAFTDTVLLRSFKKRITKINQGQFDIIESFKSMGIIYALGRIINTVSDYIQYEYISVKQLKLINQVYKKHLLKLRANAIGLVDSFSLSDNSIKSAIGVFSGQAYETLNDWVQNKNPNNSEDEKRIVNSAIVQARSQLIQQQPKF

SEQ ID NO: 953 - protein, 704 aa, Kocuria rhizophila; identical to SEQ ID NO: 767

SEQ ID NO: 954 - protein, 672 aa, Tetrahymena thermophila
MGRTQHIQDSSNDFYAQERSKASFEVNDLSLVIWGSQEKIDRINKLQRICEEDPLIRYDPKHLGASREEIFILMAQRTRRMHELLGFHNTEDFNYVLSSHIDNQPFCGLHWKMFIPTIKYLGTDKQVKYWIPLAESHQIFGTYAQTELGHGSDVQSLETTATFDIDNQEFIINSPTLSSTKWWPGELGITSTHVVAFAQLLIDGKNYGVQAFIVQIRDTENHEPLPGITVGDLGVKMGYNAKDNGYLRMNNVRIPRENMLMRYAKVSKSGIFSKPKNEKVGYACMMEIRTDIITSCSLIMARTLTIGTRYSLFRTQFKDSNGIEKKVLDYQLQQEKIIPYIAETYALLAGGRKITRLHQQNIKNIFEREDFSLFKDYHAIASGCKAVYTARMLEAIEKVRQACGGHGFSAFSRFVDIYHEFSPFVTYEGENTVLSLQTASYLVKGLNKSLKGEKIPPFIEYLKCVVGIENEKFTAQSKREVLNIDLIRKCLRYKAAYLVSIASQKIMEGLEKGLSMKETWDSYAGINLVDASTAHVEYFTYTSFLEMIVEASNERVKEVLIKLCLLYGIQKLITNPSCFFENGYMAGEQFKMIKSAKEDLLYELRNEALSLVEAFCYSDGCLGALGRSDGKVYETLYEWASNQNRLNDIPVQKAIQAELRKIRDVSYMKPSL

SEQ ID NO: 955 - protein, 688 aa, Tetrahymena thermophila
MSQANERIETLTKQVKESTLIADELNPKKSLEFYRQKSTICPKQVENTIYGYNSHYMKRVYEVIKNSPQIFRHPHLEEWSREVYRYMSFRQLVQFDKEKNMSYEDYKKDPHIATIMGTALYQWNASHCIKHGVHFYLYAKTIINLGTQKHEKYVQRSIDLSDVGSFSLTELGHGSNVRSILTTATYDTATNEFIINTPNDLALKWWIGATAQLANQTVVWAQLLLNGENHGVHAFLVPIRSLEDHQPMPGVVIGDCGSKVGLDGIDNGFLQFTNYRVPYDSLLDKFSQIEDGKFKTSIPSADRRFGLQLGSLSGGRIVISMHAGSNAMMALTIATRYACIRKQFGLPGQPENSIIEYPLVQYRLMSSLAKYAVQQVAALNLNQLWDHNQENVLDLKNNLINQLHAQSSVMKAICSWQAKDIIQISREILGGHGYSSYNRIGMLYRDNDINITWEGDNNVLLQQTSKFLLDAARTLMKGKEIKYPTIKFLTVEPVEGQKWDAKEVAQFRNPENILRAMEWRVNLLLQRSGLKLQENLGSHPDPFAAWNGTQVFYLNSLALAYGEVYQAQEFISALNKIHHEQTKEFMLNLFELWGLNIIINDLGTFREGDFVESDTAKQMKDRVVELIKALKDEAIGFLDVVCPPDHILGSPFGAKDGDIYNKYLTYVRGAKNSYSRVDWWNEIHPKKQ

SEQ ID NO: 956 - protein, 676 aa, Tetrahymena thermophila
MAEIFEQEKKKINFNPKELQRFFYFNSEQIVKDVTQGFQDFSANPKLTIQPNFHSMSRIDQIKLSGETLKEINSYKDQKYNYNTSLGKMIGEFQFPFVIPSGVHQMMFIPTIKYLGTEEQQKKWLPRIYSYEIVGCYCQTELGHGSDVQSLETTAEYDVSTQEFVINSPSLTSTKWWVGELGVWANHALVFAQLHIKGKKHGVHPILVQIRDLKTHQPLPGIVVGDIGPKVGYNVKDNGFIRFNNIVIKQIINKKRVPRENMLMKYSKVSKDGLFTQRGNPKIAYAGMLETRLGISCLFHRSLGRALAIGVRYSLFRKQFKTSDGVERQVIDYQTQQEKLFIPLADSYAFCASSSQIMSRFAEFQKEIEGGDFSNLNEMHIICSGAKAYHTEYPLAHMENIRLSCGGHGFSHYSGLPSIVEGFKPLVTLEGENTIMYLQVARFLIKGLTATLKGAERVPSSIQYLKAGLDFVETKLEADTISQILDLDVLKKILVVNATYQIKNVGMKMQKLSLEGKTNQQIWDTLIGIQLVDAAKAHMLYYTFINFYQQIVTNDYLSENSKTILKQLCRLFAIAKINEKPHGLIESGFINPSQISLLKQAQHSLYPSIREQALGLVDAFGFKDEQLRSALSISDGKVYETLLDWAKNQNPLNESYFAPGYENIQKMGQITPKPLL

SEQ ID NO: 957 - protein, 723 aa, Tetrahymena thermophila
MSNDNKSNASSRLSALNSQMPGTFPQSHNRFVLRICLTQKVKLLLIYSQVNPTQILSPSQLLHSYRNRSKVDRQGLYETFYGPKWEFRNKVYDIICNNSEKFSAPYIDEHDRERTRYAAFKELHFIQKSLNMGYAEYQKDPHAFSMTSNAVYSWSPAICVKYGVHFSLYGKTLMNLGTEKHLPYIYRMMKLEDIGSFGLTEMGHGSNVRGIKTTAIYDPQSNEFIINTPEEVDMKFWIGATAQLANMTVCWAQLYVEGKCHGVHAFLVPIRNKDTHRVMPGITVGDCGPKNGLDGIDNGFMIFHNVRIPYDNLLDKFSQIENGKFKTWIESDDKRFGFQMASLSGGRVQVACNSNQNSIIAVAIAGRYSTIRKQFGAPGKPEQPIIEYPLTQYRIIPNVATAIVLQLSTITLSILWDENQKHLLDVKNTLINELHAISSAIKAISTWTAQRIITESRQILGGHGFSTFNRFGQLYNDNDVNVTWEGDNNVLLQQTGKFLLDSAKKLMKGKKLPFKCTSYISLDPAEGQQSELNSNEDFFNQGKLLKALQWRVNLTGLKMQEYMQVSKNGWDAFNNAQPFYSVELAKAFGDTWSAEQAIETISKVQNPENKRVLSDFVTLYLLETINKDIGNFRFGGYINCQQYEQIRSSILKLCNKLKDEFIAVLDALAPPDFILQAPFGASDGDIYNRYIGLIYSAKSTFKRPDWWKEVHKAHKKYHFEIDA

SEQ ID NO: 958 - protein, 690 aa, Tetrahymena thermophila
MDPEFLRELERASVKIEDLEEVAYKNKEQARHIKNDYLIIQNNKELQLDPNYYNLSRIEQIKYSARKFVEFITFDNQRQNVNEPQTIMNMFIQFPFSFPSGVHQVMFVPCIKYLASDKQCKDWLPRIYSYEIVGCYCQTELGHGSDVQSLETTATYDPETQEFIINSPTPTSTKWWVGELGIWCTHAMVFAQLNLLGKNYGVHSFLVPIRDIKTRKPLPGITVGDIGPKVGFNVKDNGFVRFNNVRIPRENMLMRYAKVSKAGIFSQPGNAKIGYAVMLQTRLAISCFFPRTLTQALNVAIRYSILRKQFNDSSNQERYCFIWLQQELNSPYYFLFTISQKNKYIKKILDYQTQQEKLLIPLAEIYGILISSYTIWDLNDDLLNRVQKDDFSTLNEMHVVVSGAKATWTETTLYYLEQCRLACGGHGFHHYSGIPGMIQEWKPMVTLEGENTVLHMQVARFLLKQYEKAMKGLNIGFSVQYLKQASEFLGSKLENVNSVGELRNIEVLRKIMIASAVFAIQNAADKMLKHVSDGKPPKQAWDEYAGIDLVEASKAHINLFTMNNYVEFVHRQTKENVKNLVMKLCILNAVSRITQKPYLLIENNYLEPKHFTFLTQLRDEMLLEVRRDALPLVEAFGFQDSQLRSAIALTSGKPYETLYDWAKNKNEMNNSYFAEGYEWIQKMQNLHPKL

SEQ ID NO: 959 - protein, 665 aa, Tetrahymena thermophila
MSTNPFKQEREKVSFSQEAMAELLYDGPEELQKFRKYQQVFADDPILKFDPSKIDISRKELFAEYCKKTYRYHELFNQSSNPINKYCGLMFDEPLIGAVHHSMFVPSLQLLADDEQQKRWLQDALQMKIIGCYAQTELAHGSDVQNLQTTSTYDQATDSFILNTPEVGAAKWWVGELGLVANHAIVYAQLIINGQRYGPQPFVVQLRDLKTHKPLPGIDVGDIGPKYGYNSKDNGFLILNNIRIPRTNMLSRYVKVTDKGEFIPAGNPKIVYATMMKVRLGILYESYYFLAAQLTIATRYSLIRKQFKDENGIERTILDYQTQQDKLLPYMADAYAMAFSFKKTINMFQENLERCSKNDFSLLQDLHGLLSAHKSVSTHTTLVGMEKIRQSCGGHGFSSYSGLVGRLKLWYPYSTFEGENTIMLLQTARYLIKKFRKSVRPESRNILPPQCEYLRDHTLLLSTKCTAEHMREFLLLEPLRKMMRFTACFRVVKAANQLEDSVKIKKMHPKEAFDTAAGSLLCDAATSHTHYYIFNSFFEKIIQVNDESIREVLSRLCALYALTKIVERPDALYEGGHINGEQLKLMREAREQLLVELRPEAIGLAEAWSFHDNTLRSAIGSSKGDVYETLLDWVQNKNPVNKPEVQSALHETIAPIVGKVHAPRL

SEQ ID NO: 960 - protein, 401 aa, Corynebacterium lipophiloflavum; identical to SEQ ID NO: 823

SEQ ID NO: 961 - protein, 662 aa, Tetrahymena thermophila; identical to SEQ ID NO: 952

SEQ ID NO: 962 - protein, 672 aa, Tetrahymena thermophila; identical to SEQ ID NO: 954

SEQ ID NO: 963 - protein, 688 aa, Tetrahymena thermophila; identical to SEQ ID NO: 955

SEQ ID NO: 964 - protein, 676 aa, Tetrahymena thermophila; identical to SEQ ID NO: 956

SEQ ID NO: 965 - protein, 723 aa, Tetrahymena thermophila; identical to SEQ ID NO: 957

SEQ ID NO: 966 - protein, 690 aa, Tetrahymena thermophila; identical to SEQ ID NO: 958

SEQ ID NO: 967 - protein, 665 aa, Tetrahymena thermophila; identical to SEQ ID NO: 959

SEQ ID NO: 968 - protein, 664 aa, Ricinus communis; identical to SEQ ID NO: 939

SEQ ID NO: 969 - protein, 696 aa, Toxoplasma gondii
MSETATTEFDGSVVHPDLEYERKRCSFRIPDFTYALYGREGFAVLTKLRLALARNPAFDLRYLWSADGTTQQYVRGCWLAEEVVKVIRQLELIDRDDAIGPLQILAGEDMFVMLHLTMFLPTLKNMCDEEQARYWVPLAEDFRIIGTYCQTELAHGSNVSGLETTADFDDKTDEWVLNTPSLQSTKWWPGGLAKSCTHCVCMARLRIHDKDYGVHPFILQVRDLNTHESLPGVKLFHIGKKLGYNSMDNGGVQLHNVRIPRRNLLMKYCHVDRQGTYKPLGSKKLMYGTMTFTRKQIIMAAGPQLAKSVVIAIRYSAVRRQFPMTMKKHETKDSSRDAEVQILDYSTQQITLFPLLAAAVAYTVTGIWMDAFYNSFIEDAKKDDFSKLEEIHAVTSCLKAMMSLSVADGMEKCRKACGGHGFLLASGIPIQFVNFVPVATYEGDRVVLSVQTARVLLKIVQRKMMSRDPKHTLAGTTLEYIHNFDPFGDHQPPAIENTPWFDPDWLMEIHRRRSCGLVYKAAQQYAAETSSGKDMMEALDLVKVEFTRLGTAHAQVLVLHFFLEAVKRVELVEVREVWVDLWLCLALSWCDEHFGEFVITRALGPDHHDGLMTAFKTILRKIRPNAVAIADAFWIPDQLLNSALGRYDGRVYEALMESTKMEPLNRLDVPPGYLEHIQYILHPERKKRSSPVHSKL

SEQ ID NO: 970 - protein, 696 aa, Toxoplasma gondii; identical to SEQ ID NO: 608

SEQ ID NO: 971 - protein, 661 aa, Ixodes scapularis; identical to SEQ ID NO: 944

SEQ ID NO: 972 - protein, 644 aa, Ciona intestinalis
MSERINPDLQKERDAATFDVEELSVLLHNGAHELEKKRKLEELVRNDPDYKSLPFDFLSREAQYEEGVRRSTIAVAKKDQLGSLIENHGDLITYNTHVGRGKAGPFNLHTGMFIPTLVKQGSPEQVAKWLPLSENYQIVGTYAQTEMGHGTFLRGLETTAHYDPHTQEFVLNSPTTTSIKWWPGALGKTSTHAVVLAQLYTLGKCHGIHAFVVQLRSLEDHKSLPGIMVGDIGPKFGYGANDNGFLKLSNHRIPRENMLMKYSKVAPDGSYSKPPKSTLTYGTMTFVRAMIVRGSAQAIAQGATIAIRYSAVRRQSEMRPGEPEPQVLSYPTQQYKLFPLLCAAYAFHFVQVKMIEAYSEVTELVNKGDFSRTQELHALSSGLKAYTSAISNTGLEVCRTSCGGHGYSCASGFPALYTNFTPSVTYEGENTVLLLQCARYLVKCTRDLRSGAKLPGSVAYLSCGCDPSSIGKDFTNVKTLDSLYKQRALGLIRFASGKVDASMDGGMDLVGALNESSVHLVRAAVAHSHYFVVRNFFEKLSKLTSTSQLLMEVLHQLSLFYALDGVAQHSGEFLEDGLLSGEDVKQIRQLTVEMLPKIRVNAVALVDAFEFGDDVLGSVLGRYDGNVYENLFKWAQDSPLNKTD

SEQ ID NO: 973 - protein, 684 aa, Tribolium castaneum
MSHLLKNFPPGPLDLYRRRASFDWKKLKVFLETEDIVKYQNELFEVLRTHPEYQHDLLSHSFEEQRRIAVRRALAYADIDLLSVPKIVENVKTGAVMTRTMMQLSPSSTVKYSVGNGLFTNVIRSQGTERHYDILDLADRGEIHGCFCLTEIGHGTNTKGMRTSATYDKNTQQFVLHTPDFEAAKCWAGSLGQMASYAVVYAQLYVEGVHHGLHTFVVPIRDPKTLLPYPGIVVGDMGEKIGLNGIDNGFLIFDNYRIPRENLLSKNADVTPEGKYVTRFKNPKDRHGAALGALSIGRVSITGICESYATKALTIAIRYAAVRKQFGPEGGEEVPILEYQSHQHRLLPYLAAIYVLRVFSTFISETNYSFTIETVLNQNKESLADLGMEIHVISSACKPVASWLARDAIQECREACGGHGYLKVAGIGDIRNDNDANCTYEGENHVLIQQTSNWLIKLCSEIERGAKIDTPLQSANFLSNASQILKHKFTANSLDEVYRPEAIIDAYQWLVCYLLKQTKDKLDHLTKKEGEFWAKNNTQVYYAKSLAIVFIQHFFLQRMLVVINQATDADNKRVLSKLFSLYGLWTLEKYLATLYEGGYTQGPKATHLIHEGILTLCHDIKDDAVSLIDAIAPPDFILNSVLGASDGRVYQRLQSAIFRSPHAMSRPKWWRELVHWNADLKNKL

SEQ ID NO: 974 - protein, 665 aa, Tribolium castaneum
MDRKKSVNPDLIKEREKCTFNTLELTHLLDGSATKTEERHSREKFFLEDPELQSNVPLEYLSHKEKYEDAVRKACIIFRKVQELQNQGKGGMDNFREILGGQLGSAILKDGNPLTLHYVMFIPTLMGQGTFDQQAEWIQRAWNCDIIGTYAQTELGHGTFIRGLETTATYDPATEEFVLHSPTLTSYKWWPGGLGHSANYAVVVAQLYTKGTCHGIHPFIVQLRDEETHEPLPGIKIGEIGCKLGMNSTNNGYLGFDNVRIPRINMLMKNSQVLPDGTYVKSPSSKLTYGTMIFVRVVIVQDAAHYLRKAVTIATRYSAVRHQSQIKPDAPEPQIIDFVTQQYKLFPHIATYFAFQYSASWLWDIYNNVTNELESGQLESLPELHAIACCLKAVSSADAAQGVEICRLACGGHGYMTSSNLPSTYGLVTAMCTYEGENTVLLLQTSRFLIKSWQNRNKLDKLATVAYLGRKMSKSNPFEKSVEWIIHALQQTAASKIELANNRINARVRNGKSYEDAWNETSIELVAAAEAHCRCFIVTTFYNTVNGLNVSKELKTVLVQLLNLYGVYTALRLTGDLFRFTNITGQDVETLQDWLEELLALIRPNAVGIVDSFDIRDEVLGSTLGAYDGNVYERLYEEASKSPLNSEPVNKSFKSYLKPFMKSNL

SEQ ID NO: 975 - protein, 703 aa, Culex quinquefasciatus; identical to SEQ ID NO: 922

SEQ ID NO: 976 - protein, 748 aa, Saccharomyces cerevisiae
MTRRTTINPDSVVLNPQKFIQKERADSKIKVDQVNTFLESSPERRTLTHALIDQIVNDPILKTDTDYYDATKLQEREITAKKIARLASYMEHDIKTVRKHFRNTDLMKELQANDPDKASPLTNKDLFIFDKRLSLVANIDPQLGTRVGVHLGLFGNCIKGNGTDEQIRYWLQERGATLMKGIYGCFAMTELGHGSNVAQLQTRAVYDKQNDTFIIDTPDLTATKWWIGGAAHSATHAAVYARLIVEGKDYGVKTFVVPLRDPSTFQLLAGVSIGDIGAKMGRDGIDNGWIQFRNVVIPREFMLSRFTKVVRSPDGSVTVKTEPQLDQISGYSALLSGRVNMVMDSFRFGSKFATIAVRYAVGRQQFAPRKGLSETQLIDYPLHQYRVLPQLCVPYLVSPVAFKLMDNYYSTLDELYNASSSADKAALVTVSKKLKNLFIDSASLKATNTWLIATLIDELRQTCGGHGYSQYNGFGKGYDDWVVQCTWEGDNNVLSLTSAKSILKKFIDSATKGRFDNTLDVDSFSYLKPQYIGSVVSGETKSSLKELGDYTEIWSITLIKLLAHIGTLVEKSRSIDSVSKLLVLVSKFHALRCMLKTYYDKLNSRDSHISDEITKESMWNVYKLFSLYFIDKHSGEFQQFKIFTPDQISKVVQPQLLALLPIVRKDCIGLTDSFELPDAMLNSPIGYFDGDIYHNYFNEVCRNNPVEADGAGKPSYHALLSSMLGRGFEFDQKLGGAANAEILSKINK

SEQ ID NO: 977 - protein, 437 aa, Glycine max
MAINSSKNPDGSVQNAMPSYFYSPPLDVSAAFPQATPASTFPPCASDYFQLDNLLTTEEQAIRKKVRECMEKEIAPIMTEYWEKAKFPFHVIPKLGALRIAGGTIKDYGCPGLSITGSAIAVAEVARVDASCSTFILVHSSLAMLTIALCGSEAQKQKYLPSLAQLQTVACWALTEPDYGSDASALKTTATKVEGGWILYGQKAEYMKQNYADVRVVYARNASANQINGFIIKKDAPGLTVTKIENKIGLRIVQNGDIVMRKVFVPDEDRIAGVNSFQDTNKVLAVSRVMVAWQPIGISMGIYDMCHRYLKERKQFGAPLAAFQISQQKLVQMLGNIQAMILVGWRLCKLYESGKMTPGQASLGKSWITLRARETAALGRELLGGNGILADFLVAKAFCDLEPIYTYEGTYDINTLVTGREVTGFASFKPVAQRSRL

SEQ ID NO: 978 - protein, 687 aa, Pyrenophora tritici-repentis
MVQTAQVISMRKARSRSDVNTYALTCLLWGGERIVKERRAAFERVEKVLDTYDISKLPRCYAENNREALFEQGLQMSKACLDDMLKYQHEHFVWITPRYNLVNSSPFGHKAILFEPGMEHNGTEEQKAKWLPLARAGKILGTYAQTELGHGSFVRGIETTATFDKDTDEFIVHTPTISSTKFWPAGLGFSTTHGTVMARLIVGDGDHGPHIFLVQLRSVEDGKPMPGIKMGDVGLKLGYNEADNGFASFDSVRIPRSQMLMAHSQLTREGKFTKDSLRAKLSYSVMLLVRAKMPGVFSVQLAQALTIATRYSVVRQQGLGPADAFSTEASILHYKHQHFRLLSMIAKSYAMFFASRVCDMHYNKLREMQSKNDHSLLPSVHALTAGLKAYVTSEAADGAEDTRKLCGGHGYMVLSGLPDIIGALAGGAMFEGENYVLWQQLGRHLLKQLDRLQDGEPMEPQVRYLAELNLNDTCVAQGEEFLEFDVQLSIYRDRAHRLIVKAHKAIRATDKETAKAWNEYMMLLISASRAHIEYFILKSFNDTIHSLPYNPTAPELRMILCWMQDLFALSTTINPRSVDVLSFAETADTRPPYLSSAQLDTIRSLVNKRLNELPPHIIALTDAWDFSDASLCSAIGMHDGNVYENIMRWVEQLPINQNAQKNGGVQQGWRDWVDPILKRQVKVQAKL

SEQ ID NO: 979 - protein, 694 aa, Pyrenophora tritici-repentis
MKPTPDWVKQLKPSGVQGHELLKAERKNSNVPVQELEVLLHTQDAIDRREKILKILKAEKVFDKSQNYFMGRIDKFERALAREKRLRNLKKQHNWTTEEFRTAADLVGEPGPYGLHDTMFKVTLEGQATPEQQEKWLTKANEYKIIGCYAQTELGHGSNVRGLETTATWNKEDKTFTIHSPHLTASKWWIGSLGRTANHAVVMAQLIIDGKSYGPTPFCVQIRDLKTHEPLENIHIGDIGPKFGYNTMDNGFLLFNQVKVPHISMLARYTFVDPNTNKYGRRGAPSLVYGTLTWVRSTIVMQAGSVLARGVTIATRYCAVRRQFQDRDAPAGEAETPVLNYTMVQIRLLPLLAATFALHFTGKSMMDMYQENQKKIAQGTASNAPSKRGAGPEEVQSGSDMLADLHASSCALKSLSSSIAAEGLEVCRRACGGHGYSNFSGIGPWYSDYLPTTTWEGDNYMLTQQVARYMLKSARSVLQGQKPTNDTTQILSDFHARRNIGCAFDVIGSDDDLVSAFAWRVAFLTFEASKHRDEQKKPWNDLLVDFYRLSKAQAQYMVVKTNLSALRTIEKEGKVDKNILDVLMKLFRLFAMHTLEQEGAEFYASGACSKNQISLARTNTVMNLLKEIRPHAVRLVDAWGFDDWVLDSSLGRADGKVYEDLFHRASELNPLNDITVDPYPDSDVLFKRIEKSKL

SEQ ID NO: 980 - protein, 687 aa, Pyrenophora tritici-repentis; identical to SEQ ID NO: 978

SEQ ID NO: 981 - protein, 694 aa, Pyrenophora tritici-repentis; identical to SEQ ID NO: 979

SEQ ID NO: 982 - protein, 643 aa, Nocardia farcinica; identical to SEQ ID NO: 187

SEQ ID NO: 983 - protein, 670 aa, Brugia malayi; identical to SEQ ID NO: 873

SEQ ID NO: 984 - protein, 444 aa, Aspergillus fumigatus; identical to SEQ ID NO: 800

SEQ ID NO: 985 - protein, 710 aa, Lodderomyces elongisporus; identical to SEQ ID NO: 950

SEQ ID NO: 986 - protein, 723 aa, Lodderomyces elongisporus; identical to SEQ ID NO: 951

SEQ ID NO: 987 - protein, 669 aa, Oryza sativa
MEGGVGGEVDHLAGERATAQFDVEHMKVAWAGSRHAVDVADRMARLVASDPVFRKDNRTMLPRKELFKDTLRKAAHAWKRIVELRLTEEEANLLRLYVDQPGYVDLHWGMFVPAIKGQGTEEQQKKWLPLAYRFQIIGCYAQTELGHGSNVQGLETTATFDPKTDEFVIHSPTLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTKEGKYVHSDVPKQLLYGTMVFVRQTIVADASKALSRATCIAVRYSAIRKQFGPQTGGPETQVLNYKTQQSRLFPLLASAYAFRFVGEWLKWLYTDVTHKLEAKDFSTLQEAHACTAGLKAVTTSATADGIEECRKLCGGHGYLNSSGLPELFAIYVPACTYEGDNVVLLLQVARFLMKTVSQLASGKQPVGTTAYMGNIQYLMQCKCGVNTAEDWLNPAAIREVFEARALRMAVNCAQNINKAPSQEEGFYELSPDLLEVAVAHIQLIIVTKFIEKLEQDIPGEGVKEQLCILCNVYALYLVHKHLGDFLSTGSITARQGALANEQLGKLYAQVRPNAVALVDAFNYTDHYLGSVLGRYDGNVYPALYEEAWKDPLNDTDVPDGYQEHLRPLLKQQLKLSRL

SEQ ID NO: 988 - protein, 682 aa, Strongylocentrotus purpuratus
MANLSVRDGKRNARSPPTENINPDIAEERENAKFDPIELTYVIDGGKEKTERRRFLESEALNDPVFDDPADIAFLTDEQRHTNSVRKSLHMVRRLQEMEITNHMESHWFRVAVHKVEEAALLLHPTMFSHAIYSQMSDEQHVKWLDAAFSFTLLGTYAQTELGHGTFLRGLETTATYDPTTQEFEIHSPTLTSMKWWPGNLGKTATHAIVAAQLYTKGSRMGVHMFMVPLRSLETHLPHPGVELGDIGPKLGYNNIDNGFLRFNHYRIPIENMCMRHSKVMPDGTYVPPPHKKISYGSMLPIRSGIVGNTGWYLSKGSTIATRYSVVRRQSELIPGTKEAKILDYQSQQLKIFPNLATAFAFIFTGREMMKHYFESLAEMDEGNYSSLPELHATSAGLKAFTSSVMASGLEELRTSCGGHGYSKASGFPELYGTAAPASTYEGENTVMFLQTARYLMKVARQAGSKDKLVGCAAYLQADLPPRCLAKRQIDFLRQDILVDAYKHRAKSVVMLAARRLGEELKKGHSQPIAWNNCHMYLVKAAMAHCHLYCVESFFDGVNTSETSQPALDALMTLCQFYAIFGISQNKGDLLQDGYMNGEQLNMLERQLIDLLAVIRPIAVTLVDAFDVPDKMLSSVLGRYDGNVYENLYEWAKSSPLNKKEVPDAYKYIGPFLRENIANSKL

SEQ ID NO: 989 - protein, 740 aa, Strongylocentrotus purpuratus
MSKVRLLDKLVQERAGVDGASSRNAPGVADQVLSGSASSNDEDTTPDEKHIFEVLPDLPAGPLDVYRKNATFDWKAMKVAFEGEECIRYHYKIWKTLEKDPLFQHSQRPLTMEESRALVFRQVQQLVRYNFLSMEGILANPDTISWFNSAVCLYDAALSTKFNLNKNLFGQTLRASGSMKYEDIVTKSDALEIIGCFALTELAHGSNTRAMRTTAKYDPSTREFVVNTPDIEAAKVWVGNLGKSATHAIVYAQLYTHDGICHGLNSFIVPIRDPKTLLPLPGVFVGDLGEKLGLHGLDNGFVSFHNFRIPRENLINRTGDVTESGQFVTPFKDPNKRFGASVGALSSGRVGITNIGVGNLKLAVTIAVRYSAVRRQFGPTADEELPVLEYQMQQWRLLPYVAGAFVLHYFSDKLFKHLVECQVSLMLGDKSERQAELGKEMHALSSASKPLSSWLARDCIQECREACGGHGYLWVNRFGVLRDDHDPNCTYEGDNNVLLQQTSNYLLALFAAKKRGETISSPIGTFDFLDSMFEIIKQKFTVRKLEDVIKPQVILGAYRWLVVYLLQESSHKLQQELMNGKDAFSARNDSQVYFCRTLAIAFMEHTLLEQFWNYLQTGDFIPEQTAVLTKLCSLYGLWSLEKHMATLYQGGYFSGAETARLIRDAILHLCRDVKNDAVSLVDVLAPPDFILNSPIGCADGQVYKRLYNAILQTPKCLERPDWWKEFLDTPIVGSAPPAKL

SEQ ID NO: 990 - protein, 682 aa, Strongylocentrotus purpuratus; identical to SEQ ID NO: 988

SEQ ID NO: 991 - protein, 740 aa, Strongylocentrotus purpuratus; identical to SEQ ID NO: 989

SEQ ID NO: 992 - protein, 670 aa, Xenopus tropicalis; identical to SEQ ID NO: 536

SEQ ID NO: 993 - protein, 777 aa, Stigmatella aurantiaca; identical to SEQ ID NO: 876

SEQ ID NO: 994 - protein, 699 aa, Yarrowia lipolytica
MNNNPTNVILGGKEYDTFTEPPAQMELERAKTQFKVRDVTNFLTGSEQETLLTERIMREIERDPVLNVAGDYDADLPTKRRQAVERIGALARYLPKDSEKEAILRGQLHGIVDMGTRTRIAVHYGLFMGAIRGSGTKEQYDYWVAKGAATLHKFYGCFAMTELGHGSNVAGLETTATLDKDTDEFIINTPNSGATKWWIGGAAHSATHTACLARLIVDGKDYGVKIFIVQLRDLNSHSLLNGIAIGDIGKKMGRDAIDNGWIQFTDVRIPRQNMLMRYDRVSRDGEVTTSELAQLTYGALLSGRVTMIAESHLLSARFLTIALRYACIRRQFGAVPDKPETKLIDYPYHQRRLLPLLAYTYAMKMGADEAQQQYNSSFGALLKLNPVKDAEKFAVATADLKALFASSAGMKAFTTWAAAKIIDECRQACGGHGYSGYNGFGQAYADWVVQCTWEGDNNVLCLSMGRSLIQSCIAMRKKKGHVGKSVEYLQRRDELQNARVDNKPLTDPAVLITAWEKVACEAINRATDSFIKLTQEGLSPDQAFEELSQQRFECARIHTRKHLITSFYARISKAKARVKPHLTVLANLFAVWSIEEDSGLFLREGCFEPAEMDEITALVDELCCEAREQVIGFTDAFNLSDFFINAPIGRFDGDAYKHYMDEVKAANNPRNTHAPYYETKLRPFLFRPDEDEEICDLDE

SEQ ID NO: 995 - protein, 701 aa, Yarrowia lipolytica
MITPNPANDIVHDGKLYDTFTEPPKLMAQERAQLDFDPRDITYFLDGSKEETELLESLMLMYERDPLFNNQNEYDESFETLRERSVKRIFQLSKSIAMDPEPMSFRKIGFLGILDMGTYARLGVHYALFCNSIRGQGTPDQLMYWLDQGAMVIKGFYGCFAMTEMGHGSNLSRLETIATFDKETDEFIINTPHVGATKWWIGGAAHTATHTLAFARLQVDGKDYGVKSFVVPLRNLDDHSLRPGIATGDIGKKMGRDAVDNGWIQFTNVRVPRNYMLMKHTKVLRDGTVKQPPLAQLTYGSLITGRVQMTTDSHNVSKKFLTIALRYATIRRQFSSTPGEPETRLIDYLYHQRRLLPLMAYSYAMKLAGDHVRELFFASQEKAESLKEDDKAGVESYVQDIKELFSVSAGLKAATTWACADIIDKARQACGGHGYSAYNGFGQAFQDWVVQCTWEGDNTVLTLSAGRALIQSALVYRKEGKLGNATKYLSRSKELANAKRNGRSLEDPKLLVEAWEAVSAGAINAATDAYEELSKQGVSVDECFEQVSQERFQAARIHTRRALIEAFYSRIATADEKVKPHLIPLANLFALWSIEEDSALFLAEGYFEPEDIIEVTSLVNKYCGIVRKNVIGYTDAFNLSDYFINAAIGRYDGDVYKNYFEKVKQQYPPEGGKPHYYEDVMKPFLHRERIPDVPMEPEDIQ

SEQ ID NO: 996 - protein, 700 aa, Yarrowia lipolytica; identical to SEQ ID NO: 364

SEQ ID NO: 997 - protein, 689 aa, Yarrowia lipolytica; identical to SEQ ID NO: 369

SEQ ID NO: 998 - protein, 624 aa, Homo sapiens; identical to SEQ ID NO: 434

SEQ ID NO: 999 - protein, 655 aa, Homo sapiens [sequence omitted]

SEQ ID NO: 1000 - protein, 556 aa, Cricetulus griseus
MFLPTLLHQATAEQQERFFMPAWNLEITGTYAQTEMGHGTHLRGLETTATYDPKTQEFILNSPTVTSIKWWPGGLGKTSNHAIVLAQLITQGQCYGLHAFVVPIREIGTHKPLPGITVGDIGPKFGYEEMDNGYLKMDNYRIPRENMLMKYAQVKPDGTYVKPLNDKLTYGTMVFVRSFLVGDAARCLSKACTIAIRYSAVRHQSEIKPGEPEPQILDFQTQQYKLFPLLATAYAFHFVGRYMKETYLRINESIGKGDLSELPELHALTAGLKAFTTWTANAGIEECRMACGGHGYSHSSGIPNIYVTFTPACTFEGENTVMMLQTARFLMKTYDQVHSGKLVGGMVSYLNDLPSQRIQPQQVAVWPTLVDINSLDSLTEAYKLRAARLVEIAAKNLHTHMSHRKSKEVAWNLTSVYLVRASEAHCHYVAVKLFSDKLPKIQDKAVQAVLRNLCFLYSLYGISQKGGDFLEGNIITAAQMSQVNSRILELLTLIRPNAVALVDAFDFKDMALGSVLGRYDGNVYENLFEWAKKSPLNKTEVHESYYKHLKPLQSKL

SEQ ID NO: 1001 - protein, 436 aa, Arabidopsis lyrata
MTVLSSADRASTEKKVKSSYFDLPPMEMSVAFPQATPASTFPPCTSDYYHFNDLLTPEEQAIRKKVRECMEKEVAPIMTEYWEKAEFPFHITPKLGAMGVAGGSIKGYGCPGLSITANAVATAEIARVDASCSTFILVHSSLGMLTIALCGSEAQKEKYLPSLAQLNTVACWALTEPDNGSDASGLGTTATKVEGGWKIKGQKRWIGNSTFADLLIIFARNTTTNQINGFIVKKDAPGLKATKIPNKIGLRMVQNGDILLQNVFVPDEDRLPGVNSFQDTSKVLAVSRVMVAWQPIGISMGIYDMCHRYLKERKQFGAPLAAFQLNQQKLVQMLGNVQAMFLMGWRLCKLYETGQMTPGQASLGKAWITSKARETASLGRELLGGNGILADFLVAKAFCDLEPIYTYEGTYDINTLVTGREVTGLASFKPATRSRL

SEQ ID NO: 1002 - protein, 436 aa, Arabidopsis lyrata; identical to SEQ ID NO: 1001

SEQ ID NO: 1003 - protein, 625 aa, Mus musculus
TTYGQFCGTCWPQLLHVYPYLAESGHHCSAGEMDAPVPRTPDNWHLRPDGDGPRSVHRGHPEPLDLHLGMFLPTLLHQATEEQQERFFMPAWNLEITGTYAQTEMGHGTHLRGLETTATYDPKTQEFILNSPTVTSIKWWPGGLGKTSNHAIVLAQLITRGECYGLHAFVVPIREIGTHKPLPGITVGDIGPKFGYEEMDNGYLKMDNYRIPRENMLMKYAQVKPDGTYVKPLSNKLTYGTMVFVRSFLVGSAAQSLSKACTIAIRYSAVRRQSEIKRSEPEPQILDFQTQQYKLFPLLATAYAFHFLGRYIKETYMRINESIGQGDLSELPELHALTAGLKAFTTWTANAGIEECRMACGGHGYSHSSGIPNIYVTFTPACTFEGENTVMMLQTARFLMKIYDQVQSGKLVGGMVSYLNDLPSQRIQPQQVAVWPTLVDINSLDSLTEAYKLRAARLVEIAAKNLQAQVSHRKSKEVAWNLTSVDLVRASEAHCHYVTVKVFADKLPKIQDRAVQAVLRNLCLLYSLYGISQKGGDFLEGNIITGAQMSQVNSRILELLTVTRPNAVALVDAFDFKDVTLGSVLGRYDGNVYENLFEWAKKSPLNKTEVHESYYKHLKPLQSKL

SEQ ID NO: 1004 - protein, 625 aa, Mus musculus; identical to SEQ ID NO: 1003

SEQ ID NO: 1005 - protein, 592 aa, Rattus norvegicus
MNPDLRKERASATFNPELITHILDGSPENTRRRREIENLILNDPDFQHEDYNFLTRSQRYEVAVKKSATMVKKMREYGISDPEEIMWFKKLYLANFVEPVGLNYSMFIPTLLNQGTTAQQEKWMRPSQELQIIGTYAQTEMGHGTHLRGLETTATYDPKTQEFILNSPTVTSIKWWPGGLGKTSNHAIVLAQLITQGECYGLHAFVVPIREIGTHKPLPGITVGDIGPKFGYEEMDNGYLKMDNYRIPRENMLMKYAQVKPDGTYVKPLSNKLTYGTMVFVRSFLVGNAAQSLSKACTIAIRYSAVRRQSEIKQSEPEPQILDFQTQQYKLFPLLATAYAFHFVGRYMKETYLRINESIGQGDLSELPELHALTAGLKAFTTWTANAGIEECRMACGGHGYSHSSGIPNIYVTFTPACTFEGENTVMMLQTARFLMKIYDQVRSGKLVGGMVSYLNDLPSQRIQPQQVAVWPTMVDINSLEGLTEAYKLRAARLVEIAAKNLQTHVSHRKSKEVAWNLTSVDLVRASEAHCHYVVVKVFSDKLPKIQDKAVQAVLRNLCLLYSLYGISQKGGDFLEVHESYHKHLKPLQSKL

SEQ ID NO: 1006 - protein, 592 aa, Rattus norvegicus
MNPDLRKERASATFNPELITHILDGSPENTRRRREIENLILNDPDFQHEDYNFLTRSQRYEVAVKKSATMVKKMREYGISDPEEIMWFKNSVHRGHPEPLDLHLGMFLPTLLHQATAEQQERFFMPAWNLEITGTYAQTEMGHGTHLRGLETTATYDPKTQEFILNSPTVTSIKWWPGGLGKTSNHAIVLAQLITQGECYGLHAFVVPIREIGTHKPLPGITVGDIGPKFGYEEMDNGYLKMDNYRIPRENMLMKYAQVKPDGTYVKPLSNKLTYGTMVFVRSFLVGNAAQSLSKACTIAIRYSAVRRQSEIKQSEPEPQILDFQTQQYKLFPLLATAYAFHFVGRYMKETYLRINESIGQGDLSELPELHALTAGLKAFTTWTANAGIEECRMACGGHGYSHSSGIPNIYVTFTPACTFEGENTVMMLQTARFLMKIYDQVRSGKLVGGMVSYLNDLPSQRIQPQQVAVWPTMVDINSLEGLTEAYKLRAARLVEIAAKNLQTHVSHRKSKEVAWNLTSVDLVRASEAHCHYVVVKVFSDKLPKIQDKAVQAVLRNLCLLYSLYGISQKGGDFLEVHESYHKHLKPLQSKL

SEQ ID NO: 1007 - protein, 629 aa, Amycolatopsis sp.
MNPDALTAVLDGQWAQLRREIRAQYAGYDLDEPYDLSTEEYRAWVLERLRELAKSGWHRLGFSREYGGGGDIGGSVVSFEMLGYGDLSLMVKSGVQWGLFGGAIQLLGTAPHHQRYLARIMDLDLLGCFAMTETGHGSDVQHLRTTATYDPATREFVIDTPDEQARKDYIGNAARHGQMAVVFAQLVTGGESRGVHAFVVPIRDETGAPMPGVEIGDDGRKAGLNGVDNGRLTFHSVRVPRDALLNRYGDVTEDGTYTSPIESDNRRFFTMLGTLIRGRISVAGGAIHATERALAIATRYAEKRRQFGRPGADGETVLLDYRAHQRKLLPAIARTYALHFAHEELTRALHDIQGTADAEERAQRELESRAAGIKAIATWHATRSIQTAREACGGAGYLSENLLPALKADTDVFTTFEGDNTVLLQLVAKGLLTSYRDHFADLSPLATARFVAEQFVGAVIERTAARKVIERLVDAAPGRDDDDVLFDRGWQVKLFEDREQHVLEGCARRLRRAAEADPFEVFNDAQDHVLRAAKVHVERIVLEAFVAAIDRCADDEARALLERVCDLYVLSNVEEDRAWFLEHGRLTSARAKAVVAAVNDLCAELRPHARLLADGFAVPEPFLRPAMLR

SEQ ID NO: 1008 - protein, 761 aa, Gordonia effusa
MTGLRGRTPGYDDREGGEYHQLTSAHVPDGTEVTIRYARTCKPLLTCAHFSNRHDDTAQLDAARTPKGSLDLNFSWRGHTLAASRLRTVRAMAASADSAGPSTTISPDETPVPDDTVIEDGLRAALDGRWRATREDLRAGLDRADLLPDPSRTLAEARTNILAEMRELSSLNFAAAGFRTEHGGTGDVGASISAIEMLGYADLSLMVKSGVQWGLFGGAVENLGTKRHHDRYVADLISLDLLGCFAMTETGHGSNVQALETTATYDAAAREFVIHSPTPSARKDYIGGAAEHARVAAVFAQLITGGPGEEPTGHGVHCFIVPIRDENGADLPGVTTGDCGYKGGLSAVDNGRISFDQVRIPAENLLNKYGDVAADGTYSSPIENINRRFFTMLGTLIRGRVSVGATGGAAGRKALTLATRYALLRKQFDAPGEEDEITILDYRAHQRKLLPLIAKSYAITFAQNDLTSELHDVQTADLSIAELTDEDAERQRHLEGWAAGLKAYATWHASHAINVSREACGGAGYLDENQLPIIRGDIDVFTTFEGDNTVLTQLVGKELLSAYSDDVRGLNAGGWVRFVAGMARDVVAEKTAVRQVIQTILDNSDEETEDSALSERATQIRLFRNREDHLLRTCAQRLRRATEDDADPFEVFNNAQDHLLKVGQAHVERIVLESFISGIAECDSRSAAEVLDKVCDLFVYSALEADLSWFLMHRHVSVERAKAIRRGVNDLCEDLRPHARTLVDAFGIPEALLRAPMLEHG

SEQ ID NO: 1009 - protein, 569 aa, Ajellomyces dermatitidis
MSTTLHFPSFCGVEGRIEGRKQLLKALTSNPIFSKTAVTIPSLARKDAWKRAVSQARKLVVLKHKEKWTGPQFRDAVRMLDYFLPVQPQFRTSDGQVVFISNLERQMTDEQKAVWIPKAERFEILGSYAQTELGHGSNVRGLETTATFDRATDEFIINSPTVSSAEYWIGATGIWATHSILRDLETHKLLPGVEIYELGPKVFQGMVGVHNGAMQVHNVRIPRDHMLARNAQVLRDGTDIPPKNTKHSYGSMITVRAIMAEITGYDLLRAVAVAYHYTTFRKQFWIKGQKEENTVFNYASVKYRLLPLLAKGTALVLVGQDINRAFDEYSELVIKTGNTSQLEDLHLQTVGAKVYSTDITANGVETCRIACGGHGYSALSGFGQMYAHTVNAVTYEGDNYVIAQQAPRVILKHYKAILRRPESSSKLNVSSESDWFEPDNQQWVLERRLPTLVKAHMEASDVMLVEIPVSLFTSSPWHIAISSTGEDSGILTSAYDKAIQTLSDFSKAIIDAYGFAEFEMDSALARAEMNPYEALVAGPKNSDMNNMRDVWPVDSRRIWAKLDVEEKAK

SEQ ID NO: 1010 - protein, 465 aa, Ostreococcus tauri
MSPARSSRALRALVRADAVRGEDVERNPELFFAAHRAMALRANDLGPGFWIRFTVHYNLCAGTVVALGSRAQRARLRGMATRGELGCFALTERLAGVNSGLVVRTTADWDHARKVFVINSGGGDGGVKNWISQGLVADVAVVVADLRVGGKSRGPHGFLVRLRQGMTRRLTRGVSVGDMGKKTTGNDLDNAWIRFDDVAVPHDALLSKYGGVDRKTGEYVTKKEGVRTMDMIGQRLYTGRVAVAQAALVFVRRLLDDTKRYSDQKMCTMRGASPALSDVPQLRALYQEGYATLDRLDAYVAGCEKELCTHLRAKTIPSAALTQAIAVAKIKAVETAIDLAFRLKQEVGSYALMSGTGFDNTDFLQCCKFAEGDSRILSQKLARDCFTAFQQNDLESATGVKSEIELDLCQRIDEVIKDARRANPRIDKIEAWDCAWRDVYRLAEVMCERIMHERAFKAETHRSKL

SEQ ID NO: 1011 - protein, 582 aa, Nocardia cyriacigeorgica
MARTALAELIRHGNPEIHQLLQEILSNPDFAVTEQQSQEQRRLNAYDQLRYLVGKLGSSKAIATDLPSLFAVFDWSAVLATDLIPLISGHYNLASGSLATLTDAESAAPYLQDLDDASSIGVMLLTEYGCGSNIGFMETTATWDGDGFVINTPHPRARKFMPSVGIPVSRVCVVGARYIDGAGVDQGVHLFTARLRDANGDPAPGVSITQLDHQPLVIMDNSIISFDNLRVERSAWLSNDLATIDDNGVLTWRDEKSQKRAFPSAISQLTVGRMALSSCLNATARSALYIALSYAGKRVVPMTAVDRPLMFDLPHVRDTLLTDLAGTVARTIYGNEIKTFLAGSDLTDRDTVVTVMLAKYFIQPHALATVTHSRIKMGAQGMFSANRVADYLGVCHAAITGEGDCHVLGSVGGRVLAKQLAGSPPAEPRLHDPADQQDRARLLNARTLTIAQEAQPQLNNPGLENRLAVIPDALAVADAHCAEQAMRMLDTHAEHPEIAAVRDVFALQYLDEHSTWYLTHGLLDLDGVKALQRLLGQAIDNLATHTPALLDSFGFDDEILGAPVLAQDLVSAWDHRCEEVRR

SEQ ID NO: 1012 - protein, 598 aa, Macaca mulatta
AFHIRLIAQRLGWLEDGRELGYAYRALSGDVALNIHRVFLKALRSLGSEEQIAKWDPLCKNIQIIATYAQTELGHGTYLQGLETEATYDAATQEFVIHSPTLTATKWWPGDLGRSATHALVQAQLVCSGARRGMHAFIVPIRSLRDHTPLPGIIVGDIGPKMDFDQMDNGFLRLNHVRVPRENMLSRFAQVLPDGTYIKLGTAQSNYLPMVVVRVELLLGEVLPTLQKACVIATRYSVIRRQSQLRPSDPEAKVLDYQTQQQKLFPQLAISYAFHFLAVSLLEFFQHAYTAILNRDFSLLPELHALSTGMKAMMSEFCTQGAEMCRRACGGHGYSKLSGLPSLVTKLSASCTYEGENTVLYLQVARFLVKSYLQTQMSPGSTPQRSLPPSVAYLATPDLARCPAQRAADFLCPELYTTAWAHVAARLIKDSVHHLQTLTQSGADQHEAWNQTTVIHLQAAKAHCYYVTVKGFTEALEKLENESAIQQVLKRLCDLHAIHGILTNSGDFLHDAFLSGAQVDMARTAYLDLLRLIRKDAILLTDAFDFTDECLNSALGCYDGNVYERLFQWAQKSPTNTQENPAYEEYIRPLLQSWRSKL

SEQ ID NO: 1013 - protein, 617 aa, Streptomyces cattleya; identical to SEQ ID NO: 340

SEQ ID NO: 1014 - protein, 582 aa, Xenorhabdus nematophila
MNRSAPSSPLKISNYLGIGNIKLPDGITKILKTNSNTYQASVKKFIKLLCYIKNNNIDITSFDKLAELHEFVAIHDSAVASMLSIHFNLTIGTIANLNKQTPYIEELYQKLCSGNAIGVYLATELAYGNNLISLETQATYLPEKGIFILNSPNPNAYKFMPNTVSCELPKIAVVYAQLNVANRKYGIFPFVLPLSINGKLTKGVKITPLSDKPGFYLDNAITSFDNVEIPFEGLLAGNLMTLDRNGQISLHVKKLKERFALITNRIHTGKICMSICSVGAAKSALYITSTYGSKRQTFGYSGAMPALNYCHFKESIAWDTLTTIAHTLYLRKLTKKISILLSESTNNFKISDELLVEIISIKSLFTWRTQEILINCRERCGAHGLFSINKIPQYLISNFGSITAEGDNLVLSLKAGEMILTNGLKKSGANIEHDLLSILTDYANHLLDKLKKLTGHDNKKITFDIINKNSNDFLTLSQTYAILAVVTTITDSYNTDDIGMILEGYLLDWIHRSMRDLLISEIINIQESKKLNERHITYIRDHAEIINGYIYDFEMDKSGIETPISSNDYIGWYAGNHDQLKN

SEQ ID NO: 1015 - protein, 659 aa, Gordonia araii
MAAETDTTTPDQTTDDTVDQTTVDGVRAALDGPWKATRDELREALARTDLLPDPSLDLGPSRAKILAEMKELAANNFAAAGFRTEHGGTGDVGQAIVGIEMLGYADLSLMVKAGVQWGLFGGAVENLGTQRHHDRYVKDLINLDLLGSFGMTETGHGSNVQALETVATYDPETQEFVINSTTELARKDYIGGAAEHATVSAVFAQLVTGGPGEEPHSRGVHCFFVPLRDEKGNDLPGVTTSDCGYKGGLRGVDNGRIIFDNVRIPAENLLNRYADVAPDGTYSSPIESDNRRFFTMLGTLIRGRVSVGATAGAAARKALTLAIRYGLIRRQFEAPDGTHEIAILDYRAHQRKLLPLLAKSYALAFAQNELTAELHDVQSQDPDGVDPHRQRLLESWAAGLKSYGSGHASHTINVCREACGGAGYMDENQLPILRGDIDVFTTFEGDNTVLTQLVGKELLGVYSEEMRGLNAAGWVKFVAGMVGDVVAEKTAVRQVVQTLLDSSDENPDSSELTERSTQIRLFRNREEHLRRTCAQRLRKAADADDPFTVFNDAQDHLLKAATAHIERQVLESFIQAIEDTDSRSAAELLGKVCDLFVYSALEADLSWFLMHRHVSVERAKAIRRGVNELCEDLRPHARTLVDAFGIPEELLTAPMLVHG

SEQ ID NO: 1016 - protein, 620 aa, Streptomyces hygroscopicus
MLIITVCGVINSTIFPSVATTQIVHEQHISAELARILLGPRAEQIHEPWRRLFSGHRFAFQEGLSPQDRTALSYERLRTIAEAVPVPVGLASDIELLAAMHEWAGVVDAGMATIASIHWNLHIGSLLDHDHGGRDLSVYSSTERIGTFLCTELDHGNDAAALETTARFDFATGGFILDTPTPGSCKWMPNTSGTGGAKNALVAARLVVGDVDHGVFLFLTPLTDSEGRHYPGVEVRPLPQTASAPVDHCATYFHGVRLPYEAMLQGEQGRLSPDGTFTSTLGNPRKRFLRSVRRVHAGKLCMSAYSLGVTRHALAVAMRHSHRRLTSGMTTGRKVSLIEHRSHHAPLLSAVATTYAATLLHRHVVQRWTSGTDADQDEVERLAAVAKAWITWQARAVMTECRERCGAQGLLLSNGIAYQLAANEGTVTAEGDNQVIWVKAAGEMLMGGFTPMPPSEVPPAGRSLHDAEYLMELLADVERIWHGRARSRLRTGRRGDPLARWNGTVRPALQLVEAHVHRLAAEALLREGGETADPQARALLGQLHRLFALRQVRAHAGDLLADGRLTPEHVRQLPDVEEALIEMLVPYSLQLTEGFAALDSVVEGHPMLQARTAEAEMTPA

SEQ ID NO: 1017 - protein, 401 aa, Mustela putorius
LGMYDWSLGIKFLLHMLTFGSAIYSSGSERHLKYLPKIFNMEIFGCFAVTELSHGSNAKAVRTTAHYDPTTEEFIIHTPDFEAAKFWVGNMGKTATHAVVFAQLYTPGGQCHGLHSFVVQIRDPKTLLPMPGVMVGDMGKKLGLNGVDNGFAMFHKVRIPRQDLLNRTGDVTPEGTYVTPFKDDKQRFGASLGTLSFGRVTIVGMSIVNLKLAVSIALRFSATRCQFGPTDGEEVPVLEYQMQQWRLLPYLAAIYALDHFSKLLFLDLAELQQGLAGTDHSARQAELGREIHALASAGKPLASWTAQRGIQECREACGGHGYLAVNRLGDLRNDNDPNCTYEGDNNVLLQQTSSYLLSLLARHIQGGARIESPLRTVDFLEAYPDILGRRFTCPSVDSCLD

SEQ ID NO: 1018 - protein, 470 aa, Mustela putorius
MNQDLRREREAASFFNPELLTHVLDGSPENTRRRREIENLILNDPDFQHEDLNFLTRSQRYEVAVRKSANMVRKMREFGIADPEEIMWFKNFVHRGRPEPLDLHLGMFLPTLLHQATAEQQERFFIPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEMDNGYLKMDNYRIPRENMLMKYAQVKPDGTYVKPVSNKLTYGTMVFVRSFLVGEAARSLSKACTIAIRYSAVRHQSEIKPGEPEPQILDFQTQQYKLFPLLATAYAFQFVGAYVKETYHRINEGIGQGDLSELPELHALVAGLKAFTSWTTNAAIEACRMACGGHGYSHCSGLPNIYVTFTPTCTFEGENTVMMLQTARFLMKSYDQVHSGKLVGGMVSYLNDLPTQRVQPRQGA

SEQ ID NO: 1019 - protein, 592 aa, Streptomyces sp.
MTASQIPDSAYVSTALADVLFAGQLGTTHDRWRRLFSSAPFRFQEGLTHRERIDLSYDRLRLVNETVEAPQVLANDPVELTAVHEWAGAVDPGMATIVAIHYNLFFGSLVDHEPAGRDLGEYVRADRIGTFLCTEVARGNDAAHMKTTATFDRAAPGFVLNTPTPAAAKFMPNTSPAGGAKGAVVAARLIVDGTDHGVFLFLTPLSDNEGNPLPGVEVRPLPQTASSPVDHCATTFHDVRLPFSALLQGDHGHLTPDGEFTSALGSPRKRFLQSIGRVTMGKLCMTAHSLGVMRHALDVAMRYAHTRVTSGMTNGQRVPLIAHRGHHTPLLDAAATTYAATLLQRSVVRQWDRATGEEREAYERLTAISKAWITWRARAVTTECRERCGAQGLIQANGIALQLASIEGTITAEGDNQVIMQKAGGEMLLGGVDLKPESEIAPEHRELTDPQHLQDLLADIERISHTRAKARLRQRAASPLARWNATVTPAVALADAHVHRLAAESLLIAADQVPSGLPADLLRGLHALFALRQIAAHSGDLLARGRVTADQVEHLPDAVDAVLGLLEPHALTLTRAFAIPEALLETHPMLST

SEQ ID NO: 1020 - protein, 684 aa, Streptomyces sp.
MSSPFLDRYCVVTVIMNDAAPPSTNDLLTAVLFGPNFRREHGFWRRLLTTEPFRRPDGGTPDERLALSYHRLRILNNALDSGARLAADPRALAALHEWLGPVDPALTTVAGIHYNLFLGSLLDHDAGTLRDLSDFLALRRVGTFLCTEVAHGNDAAAIETTATYDRERDGFVLHTPHAGAQKFMPNTSPAGGPKSGVVAARLLVDGADHGVFLFLVPLTDAHRALPGVRVRRLPARMGSPVDHCLTSFDRRFVPRDALLAGQQGRIGDDGRFRSEVPNRRRRFLVSIGRVTPGKLSMSACAVGSARVTLAIAVRYAGHRMISGSRAARRIPVYAHRTHHGPLAGAMATVYAMSLLHRRALDRWESAPESDRVEAERLVAVAKGWITWQARAVIVECRERCGAQGLLENNGMTELFTGIEGAITAEGDNLAVHAKAAAEMLFSATAREPAQEGLGDMGDPAFLGGLFAAVEDLWFARARERMAAAPPGDPLGRWNAASSAALRGVEAHAYRQADEAYAEAVAALPDGAARERLAELRRLFALRWIARNSGDLLASGRLTADQVTFLPDAVEDAVAVVAEHTPALVESFALPERLMSDWPIAGPGYADVYDDPEGPWHRGRRAGIRGRAAEFRRPVCGSRRRPLREKVAALGTRGVLLAYWGTTSVLSRWFEKPQVSVDESVHPKA

SEQ ID NO: 1021 - protein, 602 aa, Kitasatospora setae
MSTTVHALTALLRGPHPQHHEEFARLVAGPAFDPGPAGEGAAETAARAYGRLALISRHVHPARNLLGDVHRLTALHEWAALVDGTLFTVMTTHLNLALGSIVQQAADRPELADTVEELEELRAVGVFVATELGYGNNLVTLETRARFDPAAGGFVLTTPSARARKYMPNTCLNGIPKVGVVLARALVDGRDCGVFPFLLRLSDGERPTEGVHLAALPDKPGLALDNAVTSFHDVRLPLAAMLAEERLTLARTGTLDAPLHRKVTRFLGAIESIQGGKLCLAAGSAAMARAATALAVRYAHQRLTFAPGRGQVPLAAYRTHQRALVRCVAASYATTFLVGEAKDALARERSAGDRLSDALVRQIAVTKALTTWTAREVLQTCRERCGAQGLFSLNRIADYLAVNEGAITAEGDNEVIMIKAGRQLLAAATDSAAPDAPGTGLLPLLAAREAVLRERTTAALEADERSGGSVFDAWNAGVGAVRDLATAHGRARALAATTRAAAACADPLGLELLGLLAESWALDDLAEHTGWYLGAKLLDAEQAAGLDARQGAVTARLAPHLPLLAEAFALPDQVLRSPLASPDYLRAVEDWVRTTPGAREAR

SEQ ID NO: 1022 - protein, 684 aa, Streptomyces sp.; identical to SEQ ID NO: 1020

SEQ ID NO: 1023 - protein, 592 aa, Streptomyces sp.; identical to SEQ ID NO: 1019

SEQ ID NO: 1024 - protein, 719 aa, Leishmania braziliensis
MPTRLSVPLTPRRHFARCTEPRLFEVNPTRESYVIEAAFEWPTFRFICEGVDIDFNEDVREALAEVLPPSPSNFTQREEGAALQLPQVLQAFRSLCRRQLVSFAQVCSTPRRLASYYETLAGVSPVLAVLAAEHYTFAGIVATHAKKSVRDAVLAGVDSGATIGCIAEQELVAEGPPLNTEARYDIHERCFVLRGTGKFGVVAATCAQWAVVSATLTLNKKEHNGTHLFLVHLREGDVLGAPGQLRQGVSVRPITGENIVMAGCGVAVLHFEDVRIPSDHLLDPYCITSESKIGYVAGQEGHEPATEVLRTRRRIATGAIYIGATKKFLTDVVAYTADKYVVGPDYHRNYPFLGLQHIQSPLVSMVAKSYVYLAAWQRLLPVFTDPSGLPSYEDHMRLVGTVHFLQENLLDLQTFADKTMGLHASFTSTGKDAAVTLVHLRQEGLDTSALIREVAFQSITKNIGTTHWGWWLTSLLQSVFPALDRFLKNPLYSPRIADLGRHLIFFSHKHYSLKKRLRQSRELERRKGGSEHQWYDWAMFRHRTVVHCGEAFMEAYYLDVMMKETEKCSDPRGRKILRDIGWIYALTRQMDRLDFLLSSKMLSSGKAETLASHLDNIVTVLAPQCVHLVEAMQVPEVARAPCRSAMYMETYWTIPGTNTHIERGDRLTLHSAANASSSKGGRGAESAKAEQEAIRESTEEFDLFHGLADEPSYARRKAP

SEQ ID NO: 1025 - protein, 659 aa, Gordonia araii; identical to SEQ ID NO: 1015

SEQ ID NO: 1026 - protein, 761 aa, Gordonia effusa; identical to SEQ ID NO: 1008

SEQ ID NO: 1027 - protein, 549 aa, Danaus plexippus
MFMPTIITQANDEQQAKWLPRSWNCNIIGSYAQTELGHGTFVRGLETTATYDPSTKEFDLHSPSLTSYKWWPGGLGHTANYCILIAQLYTKGKCHGIHPFIVQLRDEETHVPLPGIKIGDIGAKLGLNEVNNGFLGFDHVRIPRDQMLMKHAQVLEDGTYIKSLNSKLNYGPMVFTRVVIVFDVANYLCKAATIATRYSAVRRQSQKKPGEPEPQILDYVTQQHKLMIGLASVHAFRTCADWLWQMYNNVTAELEAGDMERLPELHALSCCLKAVSTSDAAQCVERCRLACGGHGYMLSSNLPLTYGLVTAACTYEGENTVMLLQTARFLAKTWQQVGSIKLTPTVEYLKYSANEGCRKWENSVEQIIEAFKIISMKKIQSCVKDMENRVSSGTSFEDAWNMSSVQLVSAAEAHCRVIILSTFNEEIKEKSKSASPELAVVLNQLLELYTVYWALEKSGDLLQYTCISKEDLEGLRWWYEDILIQLRPNAVGVVDAFDIRDDFLHSTLGAYDGRVYERLMEEALKCPLNADVVNVSFHKYLKPFLRGKL

SEQ ID NO: 1028 - protein, 467 aa, Danaus plexippus
MAQLHTKGKCHGMHAFIVQLRDEETHMPLPGIKVGEIGAKLGMNGTNNGFLGFDQVRIPRDYMLMKNAKVLEDGTYVTAPSSKLAYGTMMFVRVMLVNDMCNYMAKAVTIATRYSAVRRQSQPKPNEPEPQILDYVTQQHKLMIGLASVHAFRTCADWLWQMYNNVTAELEAGDMERLPELHALSCCLKAVSTSDAAQCVERCRLACGGHGYMLSSNLPLTYGLVTAACTYEGENTVMLLQTARYLVKAWQQAAGGQTLPPTVSYLREVVAGRRSPPFDNTIDGIIAGFYRVAAGKIGACVAQIEKRQKTGMPYEDAWNMTSVQLTSASEAHCRAIILSTYYKEIERQSNSVSPELSTVLRQLVDLYVVYWALQCIGDLLRFTSISERDIDQLQAWYEDLLTRLRPNAVGLVDAFDIRDEILNSALGAYDGNAYERLMAEAMKSPLNKEPVNQSFHQYLKPLMQGKL

SEQ ID NO: 1029 - protein, 746 aa, Glycine max
MVSFRMDSTETAWKRTAKKSSSEECILKRVRKIRRKDLEQQFGSSKEFIISTTQALGGSAYSANDITPSNFIESTTQVANCEYEDDTFWDGASTYLIANELHAGANEMLERWEKRSKMKDLLSYNYIVTILAIRHKARLTGPNQFAHKIIGDYFAKGKKKKKCRGGMKSKVDPKDIHWFVTYEKFGGCVLMGNVASFKSFGIGSVQIIMHDSVVRTLIEVHHVLEPKKNLASVGAMDSKDLDARRYVTGYAFMIDNSLVSWKTTLQRIVALSSTEAFRKDDRATLDRKELFKNTLRKAAYAWKRINELRLNEQEAYKLRSFVDQAAFTDLHWGMFVPAIQGQGTDEQQQKWLPLAYRMQIIGCYAQTELGHGSNVQGLETTATFDPKTDEFVIHSPTLTSSKWWPGGLGKISTHAVAYARLIIGGEDHGVHGFIVQLRSLDDHLPLPGITIGDIGMKFGNAAYNTMDNGVLRFDHVRIPRNQMLMRVSQVTREGKYVRSNVPRQLVYGTMVNVRQKIVADASVALSRAVCIATRYSAVRRQFGSHNGGLETQVIDYKTQQARLFPLLASAYAFRFVGGWLKWLYMDVTERLQANDFSTLPEAHACTAGLKSLTTTATADGIEECRKLCGGHGYLCSSGLPELFAVYVPACTYEGDNIVLLLQVARHLVKTVSQLDSGNKPVGTTAYMARVEQLMQYHSNVEKAEDWLKPNVVLEAFEARAARMSVACAQNLSKFANPEQGKCFNLV

SEQ ID NO: 1030 - protein, 653 aa, Paracoccidioides brasiliensis
MSRNISNDVHETPFSVFLWGGKEKFEERKKLLKALTSNPVFSKTDVAVPSLSRKDAWRRALGQARVLIMLKHREKWTGTQFRDAVRMLDYFVPVQPQFRIFLSNLERQMTDEQKAIWIPKAERFEILGSYAQTELGHGSNLRGLETTATFDKATDEFIINSPAVSSTKYWIGATGIWATHSIVVARLIIDGKEYGNHLFLTQLRDLETQELMPGVEIYELGPKVFQGMVGVDNGAMQFHDVRIPRSQMLARNAQVLRDGTYVPPKNTKHSYGSMITVRAIMAEITGYDLLKAVAVAYHYTTFRKQFWIEGQKEENTVFNYASVKYRLLPLLAKGTALVLVGQNIKRAFDEYSEVVIKTGNTSQLEDLHLQTVGAKVYSTDITANGVETCRIACGGHGYSALSGFGQMYAHTVNAVTYEGDNYVIAQQVPRAINKHYKAKTEHTVPSLSYLSFLRKPESGTKLSVFSESDWFKPVAQQWVLERRLATLVKTHMEASEAGKDTSFTVHELTMAHCDFVYWRGFWEVIKEASGAEFIQQLEALAQVFSLSILQSAHKEIYAPYALTESQRKTLSSAYDRAIDTLSGYAKSIIDAYGFTEFEMDSALARADMNPYEALFAGAKNSEMNNMRDIWPTIVDARRIWGRLDAQEKENAKL

SEQ ID NO: 1031 - protein, 653 aa, Paracoccidioides brasiliensis
MSRNISNDVHETPFSVFLWGGKEKFEERKKLLKALTSNPVFSKTDVTIPSLSRKDAWRRALSQARELITLKHREKWTGSQFRDAVRMLDYFVPVQPQFRIFLSNLERQMTDEQKAIWIPKAERFEILGSYAQTELGHGSNLRGLETTATFDKATDEFIINSPAVSSTKYWIGATGIWATHSIVVARLIIDGKEYGNHLFLTQLRDLETQELMPGVEIYELGPKVFQGMVGMDNGAMQFHNVRIPRSQMLARNAQVLRDGTYVPPKNTKHSYGSMITVRAIMAEITGYDLLKAVAVAYHYTTFRKQFWIEGQKEENMVFNYASVKYRLLPLLAKGTALVLVGQNIKRAFDEYSEVVIKTGNTSQLEDLHLQTVGAKVYSTDITANGVEICRIACGGHGYSALSGFGQMYAHTVNAVTYEGDNYVIAQQVPRAINKHYKAKTEHTVPSLSYLSFLRKPESGIKLSVSSESDWFKTEAQQWVLERRLATLVKTHMEASEAGKDTSFAVHELTMAHCDFVYWRGFWEVIKEASGTEFIQQLEALAQVFSLSILQSAHKDIYAPYALTESQRKTLSSAYDRAIDTLSGYAKSIIDAYGFTEFEMDSALARADMDPYEALFAGAKNSEMNNMRDIWPTIVDARRIWGRLDAQKKENAKL

SEQ ID NO: 1032 - protein, 700 aa, Cricetulus griseus
MGSTPEGRDSALWPDTPKGPLSAYRARASFSSKELLLFWDGKDVLHFKKTIFKTLENDPLFARSYGTDLPLEKQRELNFLRCKRVLEYDFFHLEELLKEPLKIPALIHCLGMYDWSLAYKCALHILVFGSAIFNSGSEQRLKYLEKIYSLEIFGCFALTELSHGSNTKAMRTTAHYDPATQEFIIHSPDFEAAKFWVGNMGKTATHAVVFAQLYMPDGKCHGLHSFLVQIRDTKTLLPMPGVMVGDMGKKLGQNGLDNGFAMFHKVRIPRQNLLDRTGNVTSEGTYRTPFKDVRQRLGASLGSLSIGRISIIGFSVVNLKLAVSIALRFSATRCQFGPTDEEEIPVLEYPLQQWRLLPYLAAAYALDHFSKTLFLDLVELQSGLIQGDHSVRQAELGREIHALASAGKPLASWTAQRGIQECREACGGHGYLHINRLGDLRNDNDPNCTYEGDNNVLLQQTSNYLLSLLEHRLQDGAAFTSPLKTVDFLEAYPGILGQKFMGSSKADWLDSAALLAAYHWLVCYLLQGSHQKFCQEKKSRGSDFEARNHSQVYYCRPLALVFLELTVVQRFHVHTHSSSVPPSLQAVLKRLSTLYGLWSLSQHTALLYQGGYISGEQAGRAMEDAILALCMQLKDDAVALVDVIAPSDFVLGSPIGKADGELYKNLWSAILQQDGVLERATWWPEFTANKPVANRLKSQL

SEQ ID NO: 1033 - protein, 579 aa, Bombus impatiens
MAVHKDLQYERNRCTFDPVEVTYFLDGSPEKTKQRRYREQYFLDDLALKENVAMKYKSHKEIYEDSLQIACNVLQKVRELQCSGKEDIDLLLHIFGARLGSALFEGGNPLVLHYAMFLPSILGQANSEQQAYWINRAWAGDVIGTYAQTELGHGTFLRGLETTATYDPETKEFVLNSPTLTSYKWWPGGLGHTANHAIVVAQLYTQGECRGIHPFIVQLRDVETHEPLKDIIIGEIGRKLGMNTANNGFLGFRNFRIPRENMLMKNSKVLEDGTYVKSTNDKLTYGTMVFVRVMLLQDLLHYLMKAVTIAVRYSVVRRQGQINPEQPELQIIDYVTQQYKIFPHIATCFAIHVTASWVLDMYYTVQSQLHQANYEKLPELHSLSCCLKAVVSADTAAGIEQLRLSCGGHGYMTVSNLPTLYGLATAVCTYEGENTVLLLQTARYLVKSWKQATNGEPLPESVEYLNEAAKGVKHRPWSNDLERLIDAYDAVAAGSIRLAAEHLDRRIRDGVPMEEAWNQTGTELTQCAEAHARVFMVKTFAKAVKQLNSKSEEFRQVMFQLCELYIVYWALRNVGNFLR

SEQ ID NO: 1034 - protein, 493 aa, Sus scrofa
  MOD_RES (15)..(23): Any amino acid
MSVVSTSAGGGERAXXXXXXXXXIRDPKTLLPMPGVMVGDVGRKLGQNGLGNGFAMFHQVRIPRQDLLNHTADVTPEGTYVPRLKDARQRFGRALGSLSTSRVFIVALTIINLKLALSIALRFSATRRQFGPADGEEVPVLEYQTQQWRLLPYLAATWALDHFSRCLFLALRELQLGFLKNDQSARQAELGREVHALSSAGKPLASWTAQRGIQECREACGGHGYLAVNRLGDLRDDNDPNCTYEGDNNLLLQQTSNYLLSLWERRSQGGGRIESPLETVDFLDACPDILGQRFEGCSPEDFLDSSVPLAAYKWLVCYLLRESYQKFSQEKQLGSSDFEARNNSQVYYCRSLALAYLELTVVRMFHQFTHQPHVPPPLQPVLRRLSALYALWSLNQHTALLYRGGYFSGEQAGKMVENAILTLCAQLKDDSVALVDVMAPPDFILDSPIGRANGELYKNLWGAVLQGSKVLERASWWSDFVNKPVIGGLKSNL

SEQ ID NO: 1035 - protein, 431 aa, Ascaris suum
MASRYIQDGDNVDLSEERRKAKFCVDSLSELLHGAEHLKRRRAIAKFVEETPELHDVLPTTFMSREQKVENASRKIIALLKHLPSLNISNFEDIFYYQSLVMHLDGHPLSLHSIVFIPTLMQLTDDEQKKKWLSRAINLEIIGTYAQTELGHGTNLRKLETTAIYDINNEQFIINSPTITSTKWWPGNLGKMSNYAIVVAQLYLNGECYGPHQFIVQLRDENTHIPLPGITVGDIGPKFGFNTNDNGFLRFNNVRIPRQQMLMGFSKVTPNGEYVKPIHEKLGYGSMVFIRSVMISQQALFLAMACTIGIRYSCVRRQGEITPGSSEIKVIDYQTQQYRLFPQLARAYAYWFTGNYVRVLYAQVLDELKENKIELLPELHALSSGLKAVVTHQVAIGIEQCRMACGGHGYSDASGLPQFIWHCRWWMYLRG

SEQ ID NO: 1036 - protein, 720 aa, Nasonia vitripennis
MPAPSTMKPSQTRQIFQEDIRWLEDMPPGGELLKYRASASFCWKRLRIVLEDPDKIRLKMRLWKAMEADPEFHPTNGVTPSADEQKRRAARQLSRLHHQKLLPGNISQLNYRIKTGFMMTLNEATCMLDPNLSVKIALGVYLFGNTILSLGTERHHPIFHAVWNKQLLGCFALTEVGHGSNTKMMRTTATYDPKTQSFMLHTPDFQAAKCWVGNLGKTATVAIVFAKLMAQQTCHGLHAFIVPVRDPKTYLTYPGVIIGDLGEKNGLNGIDNGYIMFNSYRIPKENLLNRTGDVTPEGEFESSFSDPQRILGAVLENLSAGRMGICQESTNRLGAAAVIAIRYAAVRKQFSTSHSSANEETPIIEYELHQWRLFPYLAAACVFRLFMSEFTNVYLENVQKSMEGANIPNLSQIVSEIHSIVSAIKPLITWTCRDAIRECREACGGHGYHKAAALGDMAVNHEPTVTYEGDNNVLVQQTSNWILRQWNDLQGGSTIVSPLASVRFLIEGPSIIRNKFDPRRKARLTMEFIREAYEWLITWLVIETQRRYEEEVAKGVSNFTARSKSQVYRAATLSRAYAEMIVLNYCTARINNLLPPSQEARSLKNVLDKLVLMYSLTCLEKHLSTFYQGGYCTGPQMADMVKENILILCDELKPEAVAIADALAPPDFVLNSVLGMSDGKVYERLEEAFRCYPSGSERAGWWKELIEVADKPLDIPLSKL

SEQ ID NO: 1037 - protein, 720 aa, Nasonia vitripennis; identical to SEQ ID NO: 1036

SEQ ID NO: 1038 - protein, 720 aa, Nasonia vitripennis; identical to SEQ ID NO: 1036

SEQ ID NO: 1039 - protein, 613 aa, Loxodonta africana
MGSPVHRVSMGDTWSRQVNPDIERERCKQSFDVERLTHILDRGAQNTALRRKIESIIHSDPEFSLKDIYFMSQNERYENAIRKKVHLQMIAQHLGWSEEGPELAYANRALGGDVGLNLHAVFLKALRSLGSDEQIAKWGVLCKEYQIIATYAQTELGHGTYLQGLETEATYDAATREFVMHSPTLTATKWWPGDLGRTATHALVLAQLICSGARRGMHAFIVPIRSLQDHTPLPGITVGDIGPKMGLEHTDNGFLQLDHVRVPRENMLSRFAEVLPDGTYIMLGTAQSNYLSMVVMRVGMLLTIVLPLLQKACVIAMRYSVIRRQSRLQPSDPEAKILDYQTQQQKLFPQLAMAYAFHFQAVSLLEFFQGSYNAILHGDFSLLPELHALSAGLKAMVSDSCTQGAELCRRACGGHGFSKLSGLPSLVTDVTASCTYEGENMVLYLQMARAETQALRQLFIPHSSAWALRLRGHGPHAHCYYIIVKSFTHALEELENEPAIQQALKRLCDLYTLHSILTNAGDFLHDGFLSGAQADMARTAYLDLLPLIRKDAILLTDAFDFTDQCLNSALGCYDGNAYERLFEWSQRTPSNTQANPAYEKYIRPLLQSWKAKL

SEQ ID NO: 1040 - protein, 700 aa, Cricetulus griseus; identical to SEQ ID NO: 1032

SEQ ID NO: 1041 - protein, 649 aa, Amycolicicoccus subflavus
MTAIVGLMTKTTGEYLRDALDGPWKDMRNQCREYLASDTFTTDPALDIKAARARALEQMQALVDTGYPDHGFRRENGGTGDAGAAVAGFEMLAQADLSLTVKAGVQWGLFGGAIENLGTEHHHEKYIRPLMKLDLLGCYAMTESGHGSDVQHLETTATYDVDTQEFIINSPTPSSRKDYIGGAAQDATVAAVFAQLITEGESHGVHCFVVPIRDENGGDLPGVTTSDCGIKGGLPGVDNGRIVFDNVRIPRENLLNRYADVAPDGTYRSEIENDSRRFFTTLGTLVRGRVSVGGGAASAARLALTIATRYALKRRQFRPAQGEPETVLLDYRMHQRRLLPLIAKSYAYAFAQNDLVRKMHLIQTGQNKDPQGQRALEKRAAGLKAAQTWHATRAIQECREACGGAGYLAENRLTTLKADTDVFTTFEGDNVVLTQLVAKELLTAYSDEVRDYDALDWVKFAATMARDVVRERSGVRQLIQTLFDSSNETVEEGDLSKRAVQLQLLADREDYLVRTAAQRLRNGTKELGTPFKAFNNAQEHILSAGSAHIDRLVLESFIEGLDLVHDDEARAIAELLCDLFVFTTLEQHRDWFIMHRFLSVERAKAVRRGVNELVEKLRPHARTLVDAFGIPDAMLRAEMLNDASVYERE

SEQ ID NO: 1042 - protein, 513 aa, Amphimedon queenslandica
LETTATYDPLTEEFVLNSPTLTSMKWWPGTLGHTATHAVVVARLITKGKDEGIHLFIVQLRSLEDHRPLPGIKVGDIGPKFGYFGMDNGFLHMTNVRIPRDQMLMKYAQVSRDGTYSKPPTDKITYGTMVFVRAGIVVQSASILARAVTIAIRYSVVRRQTQNRPGEPETQVLDYQTQQFKLFPLLASAYAMKFASQYMLKLYVGITGEIAEGNLESLPELHATSAGLKALCSEISSNGVELCRLCCGGHGYSAASGLPQLYVDYSPAQTYEGENTVMLLQTARYLLKISRQKVPQAQLPNNVAYLGVDYPKYKESPVLTPKQFNDPHILLEAYRQRVIRLVAVALRRYMNGIDSGLDAVAAWNNSSVDWTVAARAHCHYLVLKAFQSSIDTAEMCETNLSIMRVLCCLFGLFGIMQYSGEFCLDGYMNSDQIEMAKNQLYSLLKEVRYEAVPLVDAFDIHDDILNSCLGRYDGDVYRHLYQWALRAPRNKKEVHDTYEKYLRPLLKKTKSKL

SEQ ID NO: 1043 - protein, 948 aa, Talaromyces stipitatus
MTDITLDQKEPDQEENAVGAVRNPNERPECFSSTSQECLFVLTSTMAIGMTSFFQGAIIVVLAEISRDLNMDSAETTWTTAGVALSSGTFLLPFGKVADMFGRRTLFIASMIGFTLTLLVIGFATSALYFDIFSGVIGLFCASSVPPAVGLLGIAYEKPSPRKNKAFACFSAGNPLGYVGGMLVSGIASQVSTWRASFWALAVIYAIFSILSIVTVPKDSSQAKAPLTWQSLLKLDPLGMLLAVTGIALFSSSLSLAGDAPQGWRTPYVIVLLVLGVLLIGAFLYWQSIYSTPLMPLHIWRDRNFSLLMGALSLGFMAFVSGQFWMALYMQQVQNYSGLEITVRLLPMVVGGVLVNVACALILHRVSNKLLMFVATVAYTLSFLIASFTKEDSIYWGCYFVPFVLMVVGADIEFNVVNMYVMSSLPPSEQSLAGGIFNTVSKLVSNVGLGISTAIYNAVRDERSSSVIRPYLATYWFATAIAGVAIFLVSFLKLGTQGGNDSKEQSDEDPSSEGVNIKTERIMECLYETTLEGLWMPRYMPPTSPQPGFPRVEIVMGRLIVKNEDRGVQSFIVWLNDGNRMCKGVYARVLPRRAGSKPLDHSITSFRHVRLPSTALLGDTNNNQNFHSTIHRVHVGTLALSTVLIPQLQHAAYVTGKYSLRRHVTGSNGIAKPVISFRTQQAPILHCLARSKVYKAFAKECIHVFMNKNIEYRVRHGIAATFKAVVTHASQKTLYALAERCGAQGLFEYNGVIESQLTARGVSIAEGDMLVLTIRLATELLLRRYSLPPPRNAFCLLARYEHGVFEWSRKELNGISNGHHSEEYNTRILPHCHSLVRAIGNRLAYEAALEEGVEKDLLDLYEAGVLLQSPALSLQGTGIDLWREIQKERQAMDAILPRLEHLLDGTGVEPYITAPILTEESWVAFVDRLPGYGDKLYTRDIDGADCRL

SEQ ID NO: 1044 - protein, 948 aa, Talaromyces stipitatus; identical to SEQ ID NO: 1043

SEQ ID NO: 1045 - protein, 570 aa, Aeromonas caviae
MSHPASLASRLHALALNDTLFPDLHHLEKAQRTRAIYRIFHTVASTAALGQEDIVDDLVPLFTLMESPCLTRQGGLCPLLASHYNLYLGTLLELGDRHHPEIIGQIEEALALRTHGLYLVTELGCGNNAMSMATEVRYDCATDGFILHTPHRYAAKFMPYIALEGQPKSSVVMARLWVGEQDCGIHPFLVPCRDARGALCQGVSVSSPDVLDLPYFDVVDHAIITFEQVTLPRWAWLRGHEHDISAGGVFHSRLASQRDIFFSSLRRVEWGKLVLTASLIPGLKLSLALAIHYAQQRTLHAHNGRVIPLAHHALHRRILTRAYVTGLAAMALYEGIKQRHLPDGRHSSRFQTDAGLVKAVAVELMRTSLQHCMQRCGAQGKFLRNRIAPTLQLCDLVGTAEGDSMPVLMKVAKDILAWPDESLDDGTPLGQLLLRMRRQMNQQLADATDKLAAWHDLGCEAARLGWLAGNLEALRHLGSRDDIRTACREQLMLDYAPQLLHHGLCSPAEIAALPARQEATLDHVWEHHAVSVPDEFDVRDLMAATPLGSPDLASAWFALAPSLHDPLPEG

SEQ ID NO: 1046 - protein, 493 aa, Monodelphis domestica
MNPDLRRERDNASFMAEKLTNILDGGLERTRRRREIENLILNDPDFQHEDLNFLSRSQRYEIAVRKSATMVKKMRDFGIADPEEIMWFKNFVHRGRPEPLDLHLGMFLPTLLHQATQEQQERFFMPAWNLEIIGTYAQTEMGHGTHLRGLETTATYDPKTQEFVLNSPTVTSIKWWPGGLGKTSNHAIVLAQLYTKGECYGLHAFIVPIREIGTHKPLPGIIVGDIGPKFGYDEMDNGYLKMDNCRIPRENMLMKYAQVKPDGTYVKPLSNKLTYGTMVFVRSFLVGEAARSLSKACTIAIRYSIVRHQSEIQSGDPEPQILDFQTQQYKLFPLLATAYAFQFVGAYMKETYHRINVDINQGNLSELPELHALTAGLKAFTSWTANSGIEACRMACGGHGYSHCSGLPNIYVNFTPTCTFEGENTVMMLQTARFLIKSYDQVHSGKLVGGMVSYLNDLPSQRIQPHQVAAWPAVVDINSPDSLVEAYKLRAAR

SEQ ID NO: 1047 - protein, 493 aa, Monodelphis domestica
MNPDLRRERDNASFMAEKLTNILDGGLERTRRRREIENLILNDPDFQHEDLNFLSRSQRYEIAVRKSATMVKKMRDFGIADPEEIMWFKKLHMINFVDPVGINYSMFIPTLLNQGTTAQQQKWLTPSFRLQIIGTYAQTEMGHGTHLRGLETTATYDPKTQEFVLNSPTVTSIKWWPGGLGKTSNHAIVLAQLYTKGECYGLHAFIVPIREIGTHKPLPGIIVGDIGPKFGYDEMDNGYLKMDNCRIPRENMLMKYAQVKPDGTYVKPLSNKLTYGTMVFVRSFLVGEAARSLSKACTIAIRYSIVRHQSEIQSGDPEPQILDFQTQQYKLFPLLATAYAFQFVGAYMKETYHRINVDINQGNLSELPELHALTAGLKAFTSWTANSGIEACRMACGGHGYSHCSGLPNIYVNFTPTCTFEGENTVMMLQTARFLIKSYDQVHSGKLVGGMVSYLNDLPSQRIQPHQVAAWPAVVDINSPDSLVEAYKLRAAR

SEQ ID NO: 1048 - protein, 617 aa, Monodelphis domestica
MANQIYSLMARNTRNKGVNPSLAAERQNKSFNVERLTNLLDGGEELTQRRRQVESMIYSDPVFSQRNNYFMSQNQRYEAAVRKSVHCKKLMKQMGWREEGPEKSYMYRALGGDTAFNIHAVFRRALHSLGADEQISKWGPLTENFQIIVTYAQTEMGHGTYLQGLETTATYDASTQEFVLNTPSLSATKWWPGDLGRTATHALVLAQLYCSGTCHGMHGFLVPIRSLQDHSPLPGITVGDIGPKMNFEQTDNGFLKLDHVRIPRENMLSRFSQVLPDGTYVKKGTPQSNYLTMIVVRVQLLSSEFVPPLMKACIIATRYAVVRHQSKIKPSEPEVKILDYQTQQQKLFPQLAMAYAFHFVNNSVVEFFNDAYQGIISGDTASLPELHALSSGMKAFISDCCILGAETCRRACGGHGYSLLSGLPSLVTKLSASCTYEGENTVLYLQTARYLVKSYLQIQSSQDSESHKVLPQSIQYFASTRTDRCPAQKAVDFLNPALYTEAYAHVAARLIRNSADKLYDLTSSGTDQYVAWNQTSVLHVQAAKAHCHYFIVKTFAASLRKLENEPEIHQVMKRLCDLYALHGLLSDLGNFLHDGYMSGAQADLATAAYLDLLPLIR

SEQ ID NO: 1049 - protein, 584 aa, Penicillium marneffei
MLPPSPEIKHADKPDQSLYDWVWLSPSPTLELAQLPLFKIPERLLTLEERTRLTYERARKICDVYGLTVEDILTVGPKFWKLHTDLIGAVDGGALTLISIQYNLFVGTVAPFAVKRPDLHWILQRALSFEISAQFMLTEVGHGLDAKNLETTATLLPDGGFELHSPSWAAAKCMPPTTPRCGLPVVAVVFARLIVEGEDRGVRPFLVPIGDGREMCKGIIAKALPPRTGTHPIDHALTLFNHVALPASALLGSLEKPQNEREHFFSTIHRVPAGTLFLSGAAIPALKVAIYNAAQFSMRRKVTGHDGKAMAVIKFRTQHLPILHAIAQYHVLQAFIVHAGTIFRNRETDPRVKHAVATAFKAVTIQSFQKSIKSLNEGCGWHGYYEHNQTLQTELEFRAAGTAEGDIRVLAIRLASELIIGRYEVPPPNDLSSPIAQHEAALMTEAKQHLMLIGGMHRSEEFNRNILPLSLPLIQAIGHRMALEAAKEANIDTKLINLYESGVIIDDSAWYTEQGGISRLAQKEVEAQAADALLPEMEKLVFNTGAALYSNAPMASEKVWNVFVSELETFSGEASFDTDVSARI

SEQ ID NO: 1050 - protein, 509 aa, Oryza sativa
MTELHHGSNVQALQTTATFDPVTDEFIINTPNDGAIKWWIGNAALHGKFATVFARLILPLQGKGGDPADMGIHAFIVPIRDLDTNAVLPGIEINDCGHKIGLNGVDNGALRFRSVRIPRDNLLNRFGDVSRDGKYTSSLPTINKRFAATLGELVGGRVGIAYSSVGILKVSVTIAVRYALLRQQFGPPKKPEISVLDYQSHQHKLMPMLASSYAFHFATRYLVDKYSEMKKTNDEDVMADVHVLSSGLKAYITSYTAKSISVCRESCGGHGYAAVNRFGALRNDHDIFQTFEGDNTVLLQQVAGDLLKQYQEKFKGGTLSATWNYLRDSMGTYLSQPNPVTSRWEGEDHLRDPNFQLDAFRYRTSRLLHSVAARLQKHSKTLGGFGAWNRCLNHLLTLAESHIESVILAKFIEAVKRCPDEKTRELLKLVCDLYALDRIWKDIGTYRNVDYVAPNKAKAIHKLADYLSYQVRLVAQELVDAFDLPDLIIRAPIGMQSEAYAQYTQHVGF

SEQ ID NO: 1051 - protein, 604 aa, Streptomyces himastatinicus
MGTAVMAGRARVSLLTEVLFDGRFDDLHRPWTEKLRRDIFRYRDGLSLSERSALAYERLRAVNEGIESVEEFVTATDRLVSLHEWLGMVDGSLTTLATIHYNLFLGSLLRLDPRRAVDLAPFTRLWRFGTVLITELGYGNNAAELETTAVHQPEADTFVLHTPSAGAQKFMPNTGAAGGRKSGLVAARLIVRGQDCGVFLFLVPLRDERGPLPGIRIRPLSETPGSSVDHAITSFDHVVLERTALLAGDHADLTAEGAFRSAIGSRRGRFLRSIQRVTTGKLCLAAAALSGARAALTIAVRYAHRRHTFAPASRTGVPLFAYRCNQTRLLGAAAHAYAATFLLREATRHCTGRDDPESAEAEVLVAAAKGWITWQARDIAIECRERCGAQGLLSANRIVDLLTPIESTITAEGDNLVIWTKAAADMLTGRGYSPPPAPAARSGPPTDRARLLDLLVRHELSCLQQARNRLGRAGDGALDRWNQAVNPALDLVDAYATRRAAEAFLTAVDRVADDATRGLLEQVFRLFALQRLAPHAGPLLADGHLTADTVRDLAPAVDRVAAALAPHAPALVEAFAIPDDILQAPIATDGYAAAYDDPAGPWQP

SEQ ID NO: 1052 - protein, 687 aa, Acyrthosiphon pisum
MNTCSDILKDFESGPLDVYRKNSTINWKKMRVFIESEDILRYKMRAWKTFESDPLFQHSNETLPLDEQRRLALLRMYRIVESKVFPFEEIMSSPKLALAKIVAMFQYCPSVAIKVGLTFDMFSNVIFSMDNGRNSNLYENAQEGKVPGCFALTEISHGTNTKEMRTTALYDNNLKQFILHTPDFEAAKCWVGSLGKSSTHAIIWAKLIMSNGDDHGLHAFVVNIRDPKTMLPYSGVIVGDLGEKASLNGVDNGFIMFNKFCIPKESLLSKTGDINEDGKYVSPFKDKSKRLGASLGSLSVGRLSIVNICVAYITKAVPIAIRYTGVRKQFGPPNGDELPVLEYQLVQCRLIPNLAAAYALKIYGDYVANVYESFLIEMFSNSGSEKIRLLGTEIHAISSCTKPIAAWTCRDAIQECREACGGHGYLKAAGLSELRNANDANCTYEGDNNVLVQQTSNWLLNIWTNLLNGNTSCCDTPLGTIEFLKDVKTILSEKFKLSRVDEVFTHMHLLSCFQWMICYLLRQTYAQLQLLKDQRKDLFTAKNDSQMFFARDLSIVFAEYLILKKFIETTSSPNLDDAHKVVLHKLASLYGFWLVEKHLSIMYEGGYANGPLASVIVKGSIIDLCSSLKNEAVTLADAIVPPDFILNSVLAASNGRVYDNLKDLLFEDKSTFERPTWWTEIAVRSKL

SEQ ID NO: 1053 - protein, 714 aa, Acyrthosiphon pisum
MFLIRRRIKLNYLQKLKCSNASNNEITMNTCSDILKDFESGPLDVYRKNSTINWKKMRVFIESEDILRYKMRAWKTFESDPLFQHSNETLPLDEQRRLALLRMYRIVESKVFPFEEIMSSPKLALAKIVAMFQYCPSVAIKVGLTFDMFSNVIFSMDNGRNSNLYENAQEGKVPGCFALTEISHGTNTKEMRTTALYDNNLKQFILHTPDFEAAKCWVGSLGKSSTHAIIWAKLIMSNGDDHGLHAFVVNIRDPKTMLPYSGVIVGDLGEKASLNGVDNGFIMFNKFCIPKESLLSKTGDINEDGKYVSPFKDKSKRLGASLGSLSVGRLSIVNICVAYITKAVPIAIRYTGVRKQFGPPNGDELPVLEYQLVQCRLIPNLAAAYALKIYGDYVANVYESFLIEMFSNSGSEKIRLLGTEIHAISSCTKPIAAWTCRDAIQECREACGGHGYLKAAGLSELRNANDANCTYEGDNNVLVQQTSNWLLNIWTNLLNGNTSCCDTPLGTIEFLKDVKTILSEKFKLSRVDEVFTHMHLLSCFQWMICYLLRQTYAQLQLLKDQRKDLFTAKNDSQMFFARDLSIVFAEYLILKKFIETTSSPNLDDAHKVVLHKLASLYGFWLVEKHLSIMYEGGYANGPLASVIVKGSIIDLCSSLKNEAVTLADAIVPPDFILNSVLAASNGRVYDNLKDLLFEDKSTFERPTWWTEIAVRSKL

SEQ ID NO: 1054 - protein, 714 aa, Acyrthosiphon pisum; identical to SEQ ID NO: 1053

SEQ ID NO: 1055 - protein, 687 aa, Acyrthosiphon pisum; identical to SEQ ID NO: 1052

SEQ ID NO: 1056 - protein, 632 aa, Acyrthosiphon pisum
MKLKVNEDLQKERLKCTFNTEELTNFLDGDANKTLSRRKLESFFLSDLNLKDKIPMEYLSHKERYEEAVRKSCILFKKVNEWQQSGDSGSNSMEVYKSLLGGSVGSAIIIIGTYAQTELGHGTFIRGLETICTYDPATEEFVLNSPTLTSYKWWPGGLGHTCNYAVVIAQLYTQGKCHGIHPFIVQLRDEETWNPMPGIKIGEIGGKLGMNSTNNGYLAFDNVRIPRMNMLMKNAQVLKDGTYKKSVNDKLTYGTMIFVRVVIVRDLVSSYISKAAIIATRYSCVRRQSELKPGAGEPQILDYQTQQYKIFPAIAISLAYKFAASWLWDVYNDVTSQLEQGDLERLPELHAMACCLKAVSTADAAVAVTTCRLACGGHGYMNCSNFPNMYAMASAAETYEGENTVLLLQTARYLMKACQDAKSGLKLTETVLYLSNFKSLRRRNWITDLDCIGNAFLQVAGSKIENCYFAINQLINSGMSQEDAWNETTIKLSRATEAHCRAFVIQSFITTIKTIHLSSELMKVLTELCKLVCAHWMLNQMGDFLQYSNLKPSDVPSIQSLLEECLKRIRPNAVGLVDSFDVRDEILGSALGVYDGNVYERLIEDANKSPLNQEPVNESFHKYLKPYLKSNL

SEQ ID NO: 1057 - protein, 687 aa, Acyrthosiphon pisum; identical to SEQ ID NO: 1052

SEQ ID NO: 1058 - protein, 500 aa, Metarhizium anisopliae
MTAFIIATIHLNLCIGTLSSFFTTRPDLSNLLDDLLSFRTCGEFMLTEVGHGLDARNLETAATLLPNGCFDLHSPNESAWKAMPPSTPLCGMPRVAIVFARLIVGHDDHGVKPFVVELNDSQQMRRGITSRILPVRPGTKPLDHGITSFDHVLLPPTALLGSEAKPDDARRDFLQQIWRVSIGTLSLSIMGVSALRIGSRVALTYSRRRLITTGDGAAKVPILRFSTQRWPIVRGFVKSTVLRAFAEWTIDRFCSKTLSGSVRQALAVVFKTSVGRETKLLTELSERCGWQGLFAYNQISELALTFQGNSIAEGDTLVLCIPPRSGLGSELLGDKYSLPEPQDPLAPLAKHELGLIAEARQEMIDLGGYGERRSAAFNNNIVPRCRKLIEAIGERMAYEAARARGVQRELLHLYALLCMEEDLSWYTGSGVITRKQFFKSLVEAYKAVLPLLLQFADNTAEAAYITAPIMSDESWRIFLQTLQSFGHSDPSASLETSSKL

SEQ ID NO: 1059 - protein, 545 aa, Ectocarpus siliculosus
  MOD_RES (544)..(545): Any amino acid
MCHTAHKALTRVIDGGARNTATRRRLQAIVEQDPVFTNADNMFMSRPERYRHGLRKARRFTALKEELKLSPEDAELVSDSLNDAMPTYIHALMFRPNVEALCTEQQRQFWLPRCDSMEVIGCYAQTELGHGSNIRALETTATFVRETDEFEIHSPSITATKWWPGTMGRTANHAMVIAQLVIDGKQYGIHNFIVPIRGDDHLPLPGVRVGDIGPKIGFNTMDNGFCSFDRVRIPRGNMAMRHQRVDRDGVYASFGSKESGKIAYISMMQVRVVIAKDAGRSLAKAATIATRYSIVRRQGFREGSKEHQVLDYTIQMHRLLPLIASAYGFHFAGVDLNLRLRRLEREHVHGLPPLAGGKGAGDTLKQFHATSSCLKGLCSGLTAAGIEDCRKACGGHGYLQSSGLPELLGNYLQSCTVEGENHMLTQQVVRVLLQELAAARQSGAVGNDCAYMSRLVRGEGKGRRRCPVRSPKGFRDSVVLEAALEHRAFRLLVRVEARLRSEREAGSSPAEAWNLALIEVREDGEGRGGGGGGRGNPGGGGGGXX

SEQ ID NO: 1060 - protein, 603 aa, Aspergillus fumigatus
MCLLSTKKSFAQPPPEYKSPLLAGRELWIAYPSTSTARRPDHNMLPSEPKAFDAGQPDHSGQALYEWLWQSPSPTLELAQSRCFKSPASFLTLEERTRLTYERAKKICDVYGLAVDDILTLSPKFWKLQTDPIAAVDGGALTLISIQADSKDRLRAQFMLTEVGHGLDARNLKTTATLLPDGSFELHSPSWAAAKCMPPTTPRSGLPVVAVVIARLIVDGENYGVRPFLVPLGDGHEMALPPRAGAHPVDHALTLFKRVVLPNSALLGSLEKPRNERDHFFATIHRVSAGTVFLSGASLPALQLAVYNAAQFSLRRRVTGHDGNPMAVIKFRTQHLPILHAIAQYRVLQAFLVEAATTFRNRKVDPRVRHAIATVFKAVALQHFQKSIKALNDECGWHGYCGHNQILQLELEFRAVGTAEGDIRVLAIRLASELLIGRYQLLSPRDPNSAVARHEAALLTEAKHRLIEFGGVHRSEDFNRNILPLSLPMIQAIGHRMALEAAKDANIDSNLCALYESGVILEDSAWYTEQGGISRRVQREIEAQAADTLLPDLERLVYETGAGPYSSAPMTSEPLWNTFVSELETYSGEALLDIGASPVQANL

SEQ ID NO: 1061 - protein, 670 aa, Neosartorya fischeri
MFAAGLASCMETNHRPQSGLQYILQQLRAFLLSTRKTFAQPTLEYKYPQLAERELGIAHSSISTACRPDHNMLPPEPNAFDAGQPDQPDQTLYEWVWQSPSPTLELAQSPLFKSPASFLTLEERTRLTYKRAKKICDVYGLTVDDILTLSPKFWKLQTDPIAAVDGGALTLISIQYNLFMGTVAPFAASRPDLQWILQRALSFDISADSKERLRAQFMLTEVGHGLDARNLETTATLLPDGGFELHSPSWAAAKCMPPTTPRSGLPVVAVVIARLIVDGENYGVRPFLVPLGDGREMCKGVVAKALPPRAGAHPIDHALTLFNRVVLPNSALLGSLEKPRNERDHFFATIHRVSAGTLFLSGASIPALKVAVYNAAQFSLRRMVTGHDGNPMAVIKFRTQHLPILHAIAQYHVLQAFLVQAATTFRNRKVDPRVRHATATVFKAVALQHFQKSIKALNDECGWHGYYEHNQILQSELEFRAVGTAEGDIRVLAIRLASELLIGRYQLPSPRDPDSPVARHEAALLTEAKHRLIEFGGIHRSEDFNRNILPLSLPMIQAIGHRMALEAAKEANIDSKLCALYESGIILEDSAWYTEQGGISRRVQREMEAQAADALLPDLERLVYETGAGPYSSAPMTSERLWNTFVSELETFSGEAFLDIGASPVQTTKL

SEQ ID NO: 1062 - protein, 550 aa, Aspergillus clavatus
MLSTPPYVTLDDDFWQPSSKSLKLTRLPVLTSTYARSHPHETIKSHYEQVKALCQAHVLEVACRSDQPPVVRRHDPNWVTVKSRRGHHCAVHEIQRLMDFDVSFLCNHRGIYMPTELGHGLDARNLQTVATLLPDGGFDLHTPTPAAAKCMPVATPISGLQKIATVFARLHVNGQDHCARGFVVQLNVGSQMAEGITAKLLPNRAGSTYLDHAITVFNHVRLPKNALLGEIRKIPVSEQDQFSSLIWRVPVGTFSLAMASVPTLKICSSIAARYAMKRRVGHSVAEEGLPITHFRTQQIPIFHAIAQASVLAEYATCAVQNFTDRRLDPRVRHAHAMFFKTIAMAQTLESTRTLSLEMGWRGFSGDNQIIRAEYRGNKIAEGDTTVLCIRLASDILLGKVAIHPLCPLAKHESVLLNEAQVLLKECGGNFRSPASNRHLLPRCQALVEAIGFRMAYEAARDAHIDPVILKLYEMGATKSDLACYVEHKLLTRREVFDIEDKCISALVPRINELLDKMDMDAYCDAPIISDEKWDSFLSTLDTFSGGSVLC

SEQ ID NO: 1063 - protein, 604 aa, Streptomyces hygroscopicus; identical to SEQ ID NO: 1051

SEQ ID NO: 1064 - protein, 465 aa, Ostreococcus tauri; identical to SEQ ID NO: 1010

SEQ ID NO: 1065 - protein, 554 aa, Camponotus floridanus
MLGTEQHHHFIKELNNGNYICCFALTEVSHGSNAKGMRTTATYDIATRSFILHTPDFEATKCWSGGLGKCATHAIVFAQLITSDGVNHGLHLFIVPIRDPQTHLPFPGVTVGDMGEKIGLNGIDNGFLMFDKYFIPRTCLLNRTADVSEDGKYVLVVKDRRKRYGLSLGTLSSGRTSISLIGVHYMIIAVTIAVRYSAVRKQFGPTDDDELPIIEYQTQQWRIIPHLAATYAIRIFSDEFYKIMIDFLISRFTGKNLNADLGIEIHVLSSATKPLCSWIARDAIQDCRESCGGYGYLKMSRLGDIRAENDANCTYEGENNVLIQQASNWLLSQWTNVINGRPIPSPLGSADFLVDAEQILNTKFNHSTVENTMKPENLLFTFKWLICYYLKKTYQHIKDFKSNGMSDFDIKNNSQLFLARTLSLVYGEHALILYFIRCLQDPKWKVNEREVLTKLCSLFGAVTLEKRLGDLYGSGYASTASNINNFLREGIITLCRDLLDNAVALVDVLAPPDFILNSPLGMSDGEVYKHIKEWLFKDKNLERPSWWKEIRSKI

SEQ ID NO: 1066 - protein, 650 aa, Camponotus floridanus
MSIANNLIKDLPKGPLDVYRKRATFDWKSFKLTLEGEDSVRFQEKLWEYVRTNPAFQKTSTGLTSLDELRKRCNIQLRAFHENDMTPIHAQDNFFYIFQYDGSIPIKLSIMYSMVSSTVLALGTEQHYHLVEELSSGKYIGCFALTEFSHGSNAKGMRTTATYDIATKSFILHTPDFEAAKCWAGGLGKSATHAIIFAQLITPDRVNRGLHAFIVPIRNPKTHLPFSGVTIGDMGEKIALNGIDNGFIIFDKYSISRTCLLNRTAGVTEDGKYVLAIKDERKRYGSSLGALSSGRVSITLMCSHYMSLALTIAIRYCAVRKQFGPTDKNDELPVIEYQAQQWRIFPHLAATYAIKIFSSMFYKKMVEFNMKRFMGEDENLSPDIGLEIHALSCAAKPLCSWIARDAIQDCRESCGGHGYLKMSRLGEIRGENDANCTYEGENNILIQQASNWLLNQWTNVIKGQRVPSPLGSADFLVDAEQILNTKFDQVTIEDTLRPENLLLAFKWLICYYLKKTYQHVNKLKSNGMSDFDTRNNSQAFLARTLSLVYGEHAIMAYFITYLQDPKWKANERKVLTQLCSLFGAIILEKKLADLYSGGYASSSSNIDNFLREGIIILCRDLLDNAVALVDVLAPPDFILNSALGMSDGEV

SEQ ID NO: 1067 - protein, 644 aa, Macaca mulatta
  MOD_RES (228)..(242): Any amino acid
MGSPVHRVSLGDTWSRQMHPDMESERYMQSFDVERLTNILDGGAQNTALRRKVESIIHSYPEFSRKDNYFMTQNERYKAAMRRAFHIRLIAQRLGWLEDGRELGYAYRALSGDVALNIHRVFLKALRSLGSEEQIAKWDPLCKNIQIIATYAQTELGHGTYLQGLETEATYDAATQEFVIHSPTLTATKWWPGDREAPEVPIQNPSPRRLGWEKQCAGLPVTGLSSLXXXXXXXXXXXXXXXGMHAFIVPIRSLRDHTPLPGIIIGDIGPKMDFDQMDNGFLRLNHVRVPRENMLSRFAQVLPDGTYIKLGTAQSNYLPMVVVRVELLLGEVLPTLQKACVIATRYSVIRRQSQLRPSDPEAKVLDYQTQQQKLFPQLAISYAFHFLAVSLLEFFQHAYTAILNRDFSLLPELHALSTGMKAMMSEFCTQGAEMCRRACGGHGYSKLSGLPSLVTKLSASCTYEGENTVLYLQVARFLVKSYLQTQMSPGSTPQRSLPPSVAYLATPDLARCPAQRAADFLCPELYTTAWAHVAARLIKDSVHHLQTLTQSGADQHEAWNQTTVIHLQAAKAHCYYVTVKGFTEALEKLENESAIQQVLKRLCDLHAIHGILTNSGDFLHDAFLSGAQVDMARTAYLDLLRLIR

SEQ ID NO: 1068 - protein, 596 aa, Macaca mulatta
MLYFQVFGSAVYSSGSERHLTYIQKIFSMEIFGCFALTELSHGSNTKAIRTTAHYDPATKEFIIHSPDFEAAKFWVGNMGKTATHAVVFAKLHVPGDQCHGLHPFIVQIRDPKTLLPMPGVMVGDMGKKLGQNGLDNGFAMFHKVRVPRQSLLNRMGDVTPEGTYVSPFKDVRQRFGVSLGGLSSGRVSILSLAVVNLKLAIAIALRFSATRRQFGPTQEEEIAVLEYPMQQCRLLPYLAAAYTLDHFSKSLFLDLVELQRGRASGDRSARQAELGREIHALASAGKPLASWTAQQGIQECREACGGHGYLAMNRLGVLRDDNDPNCTYEGDNNVLLQQTSNYLLGLLAHRVRDGACFRSPLKSVDFLDAYPSILDQKFEVSSIADCLDSAVALAAYKWLVCYLLRETYQKLNQEKRSGSSDFEARNNCQVSHGRPLALAFLELTVVQRFHEHVHQPCVPPSLRAVLGRLSALYALWSLSRHAALLYRGEASDCGLAVLPRPGTRIQASDEITHWQQSRTCRSGYPLLLKDDAVALVDVIAPPDFVLDSPIGRADGELYKNLWGAVLQESNVLERASWWPEFSVNKPVIGSLKSKL

SEQ ID NO: 1069 - protein, 653 aa, Paracoccidioides brasiliensis; identical to SEQ ID NO: 1030

SEQ ID NO: 1070 - protein, 615 aa, Perkinsus marinus
MSLTESLSFLLDGFDPRRQRRRRWMSRLADRLEVDPDTDRNMSRDERAAEALRRFFHLHKPHLHSSTSAPTEALPRSGMTPAADPLEVVWMSEIAPHSSGMWDSMVPFLQAIVGQGSEKQRREWIPKVMTMEVVGSYCQTELGHGSNVKGLATTATFIAGDGDDGEAHFLLSTPTLTATKWWPGGLALIATHAIVYARLVLPEDGDQGVAGFIITLRDTNHRVLPGIQLGELGPKMGEESHDSGWMRLDNLRVPLGALLAGKGEVTKNGKFISNPRANTRLEHSSMVATRAAWIALSGGVLAKAATIATRYSHVRRQGRSPLTPIGEEARLIDHDAQAMRLLRGIASAYVLKLAGQWLLIDAGVDRQSEWLVGALKGVACALSADLNEDLRRCCGGNGYLINSGIARISLDNLWRVTAEGDVQVLLSYAGRKMRSLPADSILGDEVPWTLPLVELRGRAQRAHATACDRSSSVYDIVAARAYCEWVLANWAYSRVEKVAALKPDCEAIDLVRKLVSVYAYCIMYMPISGMSLLPELTPRGDGVKELLALVKELRPAALALVDAFEFSDQQLLGSTLGRKDGKVYEALFEDACKASWSRGVPETVRKVMIMRQSKL

SEQ ID NO: 1071 - protein, 601 aa, Naegleria gruberi
MYKFLDTPLMLHKSINITKEEAREVALKQVIFLCQSGYFNVTDMKKNPELFLQRMEAGIIDASMNVKLGVQLLLFAGSIMNLGTKKHHDLYLKRAERCELPGAFAMTEIEHGSNVRELKTTAIFDEQTNEFVLNTPNKGAIKWWLGNAACHATMATVFARLILKGKDYGVHAFLCPIRDPKSMELLPGVIAGDCGDKIGLHGVDNGFLEFENVRIPYDNLLDRFGGIDLESKSYKSEFDSAGRRFAAVLGELITGRVTIVSGSLNCRRVGCMIATRYASQRTQFSAGKEFPEQPILDYKSHKTRLMPIIASSYVFEFIKRNVVKKYCRLHLEKVSDDELQEIHALSAGVKAAMSWDTQTHLQTLREMCGGHGYSAYNRLGTLRNDHDVLKTFEGDNTVLIQQLGGYLLKEFSKQFSGELISDSVQYIRKQVGGMAQRNPLITRLSSKKHLRNSDYHLQAFEYRTAKLLQECALEINVNKKKQGIFRAFGESLPKLIRLGRAYVEQVALHDYLHGIEQVQDPELKPILKMMGDLYALDIISKNVGDFIDLIKKNKLSAIHDMVEWLCEELRVHAVSLVDSFGFPDFLLDAPIAKRDHVRDDF

SEQ ID NO: 1072 - protein, 713 aa, Saccoglossus kowalevskii
MTSDNPVCFSEYIDVNGVNTHVLKYDYDRKENLHQKDTNEHSKRCDVLVLLIPGNPGIVGFYEDFMLTLYDASSRRVPVWGISHAGHELTPGMNKRCCTWKHNEKLNLRGQVKHKVDFIKNHISPDTKVILIGHSIGCYIILEILKELPRLNVLKCVLLFPTIEGMWESPKGTWMAPFLVYLRWVAILPVYLASYLSPWVQWNLIQWYFKGRTFIRGLETTATYDPTTEEFVLHTPTLSALKWWPGNLGKTVTHAVVLAQLYTRGKCYGLHPFIVQLRSLENHEPLPGITLGDIGPKLGYQSNDNGFLGFDHVRIPRRGMLMKHSQVSPDGSYTKPLQQKLAYGTMVFVRVNLVMLSSYYLSQAVTIAVRYSAVRRQTEQIPGGKEPQILDYRSQQLKLFPYLAAAYAFTFTGWSTRYRYMEVQMEMNDGNMEALPELHALSAGLKAFTSYVANEGIEVCRLSCGGHGYSQASGFPELYGLATPLVTYEGENTVMLLQTARYLMKCAATAKRGGGLPGFVLYLNQRQKGQCPARSESDLLDHGLLSDAFEHRARRTVMDAAQQIDSEVAKGNPQHVAWNNCHIYLLKAASAHCHFYVVQTFVKYINDTEMSDAVRDVLTSLCQFYALHGIWQNAGDFLQDGYMNGKQLDMVQSLVGKLLDKIRINAVALVDAFDFRDELLCSKLGKYDGNVYEVHDSYYKYLRPMMQSSKAKL

SEQ ID NO: 1073 - protein, 601 aa, Naegleria gruberi; identical to SEQ ID NO: 1071

SEQ ID NO: 1074 - protein, 646 aa, Polysphondylium pallidum
MEQNYDRIKSIIAHLLPLEISNTNASVDAAPAITAEKPRAQIPKWNKDELRDYLESNPSYKQVKQNLQNFLKDPIFAPKYNMNCEQWREVTLQRSIKVINSGLISLAEFNRDPMKYLLSMELLNLSDPSLSVKLGVHFSLFGNAVLNLGTEKHHLKYIKDIDTWKLPGCFGMTELGHGSNVQGVETTATYDKDTQEFIINTPSDSAQKFWIGNAALHGQACAVFAQLYIGGVHYGVHVFVVPIRNADGSTATNVRIMDNGYKLGLQGVDNGRLWFDNKRIPRDNLLNKFGDVMPDGSYVTSIPSKNKRFGSMVAPLVGGRVLIASSALNAAKLSLIIAIRYAYARRQFGSKGNEIPIIQYLTHQRRLFPLIAATVALNFPVLQLKQIYCEPNKTPQNVKDVHIWASGLKAVVSWHKTHTLQQVRECCGGQGFSAFNQIATLKSDLEIDMTYEGDNHVLLQQVAKNLLVELQKGRYTVTLPNHGVKIQNSDFQIQCFKWRESHLVQTLSSKIMSALDVGVGLEHSWNDNLDVITALGKAYIERITLEYFQAAIKKASANLQPVLELCRNLYFSSRVENDLGFFLCNDGLTHETGLKIQESVNKLCGDMLPVALDIVNSFDIPEQFVHAPIAKPDYIQEFRYGLERNY

SEQ ID NO: 1075 - protein, 550 aa, Ajellomyces dermatitidis
MSTTLHFPSFCGVEGRIEGRKQLLKALTSNPIFSKTAVTIPSLARKDAWKRAVSQARKLVVLKHKEKWTGPQFRDAVRMLDYFLPVQPQFRTSDGQVVFISNLERQMTDEQKAVWIPKAERFEILGSYAQTELGHGSNVRGLETTATFDRATDEFIINSPTLRDLETHKLLPGVEIYELGPKVFQGMVGVHNGAMQVHNVRIPRDHMLARNAQVLRDGTDIPPKNTKHSYGSMITVRASMAEITGYDLLRAVAVAYHYTTFRKQFWIKGQKEENTVFNYARVKYRLLPLLAKGTALVLVGQDINRAFDEYSELVIKTGNTSQLEDLHLQTVGAKVYSTDITANGVETCRIACGGHGYSALSGFGQMYAHTVNAVTYEGDNYVIAQQAPRVILKHYKAILRRPESSSKLNVSSESDWFEPDNQQWVLERRLPTLVKAHMEASDVMLVEIPVSLFTSSPWHIAISSTGEDSGILTSAYDKAIQTLSDFSKAIIDAYGFAEFEMDSALARAEMNPYEALVAGAKNSDMNNMRDVWPVDSRRIWAKLDVEEKAK

SEQ ID NO: 1076 - protein, 686 aa, Pediculus humanus
MPTDVPSASNFIKNDLPPGPLTCYRKQSTFCWRKMQVFLESEDIINYKYKIWKTLEGDPLFQQSPISLPHEEFRKLTTLRANRIRDYDFLNRDVIMENPIRFMISIGALTMYDASALIKYIIPAHFFNNSIQGLGSKIHSDVIKKIENEEIIGCFALTEVSHGTNVKKMRTTATFDKETQEFILNTPDFEAAKCWAGSLGSSATHATVYAQLFTPDGVCHGLHGFYTPLRDPNTMLAYPGVVLGDMGEKLGLNGVDNGFAIFNNYRIPKDSLLDKNGKVSSSGKYISCIKDPRKRFGASLGSLVAGRMAIVNICTGNLVKAISIAIRYSSVRKQFGPDEDELPVIEYQLQQWRLFPYLADAYAFMVLAVATSQAFVDFNILVAFKNMEELNVFGVELHALMSSAKPLVSWAAQHGVQEAREACGGHGYLKCSGFGSLRNDNDANCTYEGDNNVLMQQSSNWLLSLFKKLDTPFESPLGSVKFLYKEKSFPSPTTVDEMCQIPVIISMYEWLLLRLLSETQRIYEENLKNNQNDSFTAKNNCQVFYARTLSLAYIEHYVLLICWNKIQDAGQEFFNEVNIFKKLVSLFGLHHLQRHLSDFYEGGFTKGPLLSLLIKKAILKLCEDIKPDAVSLIDAIAPPDFILNSAIGKSDGEIYKNLQAAFLQNPGVTQRPEWWREMTKKFRSRL

SEQ ID NO: 1077 - protein, 660 aa, Pediculus humanus
MDEPLIINDLPSGPLTKYRNQASFDWKKLKIYLEEKELLKYKLQFWNFVEKHPAFHQPLETLSLDDQRRLTSFRMYQVFNAKFLTWEKVASEPRLPMIIYSAMFQYDASLAIKYSLTFGLFGNTIRSLGSEKQSFFADDVDSGKIAGCFALTEISHGTNTKGMRTEAVYDPETQEFVLNSPDFEAAKCWVGNLGKCSTHAVVYAKLLTPDGKDHGHNWFVVPVRDPKTLLPYPGLTVGDMGEKIGLNGVDNGFIFFNKYRIPKDNLLNKNGKITPDGKFISKFKDRRKQIGASLGALSGGRVMIMSICVAYFSMSVTIAVRYSAVRKQFGINDEEIPVLEYQLQQWRLIPYVAVVYAFKIFSDYFTYELSWFQFKKFVGEENLDELGVEIHSISSAGKPLFSWISQRGIQECREACGGHGYLKASRLGDLRNENDANCTYEGENNVLIQQTSKWLLNLYKNLLEKKTISTPLHSADFLNNFSELLLKSFTCKTLEETSKPENIIQAYDWLVCWLLKTTFDRWQENLKKFDQFTAFNESQVYFARTMSIAFAERYVLVKFLEKATLSSLDKKLQDVLLKLCSLYGLWSLDQHMSILYQGGYCNGPNPAQFVRDGILKLCKELKVEVVSLVDVLAPPDFILNSVLGKSDAKKHLVDRVGGKK

SEQ ID NO: 1078 - protein, 948 aa, Talaromyces stipitatus; identical to SEQ ID NO: 1043

SEQ ID NO: 1079 - protein, 948 aa, Talaromyces stipitatus; identical to SEQ ID NO: 1043

SEQ ID NO: 1080 - protein, 705 aa, Ixodes scapularis
MSLTEEGRAHSASVDDYMPSFPPGPLDKYRHLASFDWRKMKVAIEGEDIIRFKAKVFKTLENDPLFARQPYDNITLEEHRHLCFRRMKRVFEYQFYTQEEFFQNPFLSSACNNCIGAYDWSLAVKKVLCFDMFIGAVRGLGTKRHMQIFEEMLKFEAAGCFALTELSHGTNTRGMRTQAVYDPSTQEFVLDTPDIEAIKVWSGNMGQTATDAILFAQLYTPDEKCHGLHAFVVPIRNRKTLLPFPGVMVGDMGPKLGLNGIDNGVMRNESYPKLKEELRQPTEKSVSVGSIPLLWCPLQDPKKRFGMTLGSLSMGRVAIVGICTTNLIKGIVISIRYSAVRRQFGPENQEELPVIEYQLQQWRLIPFLAAAYVMNYYSAILYKDFVSFHIAVMFGEKSPEVSEQGVELHILSCAAKCKAGWLARDAIQESREACGGHGYLKVSGLGDLRNDNDANCTYEGDNNVLLQQTSNVLVTMLQSSKAGQPLPASMTTVQFINDMDAILGGVLTATTVQEMMDINVVLAAYKWLVCYLLKLSEEKYSTLLSQGQDQFSAKNDAQAFCLRELALTYIEHTIIEKFQNFISDLRDPQLVNVLQRLNTLFGLWSLEKRLGDLYGGGYCSGEAAKHLIREGILCLCHDLKDDAVALVDVLAPPDIALNSILGCSDGQVYKKLYQSFLHSPGSVQRAPWWKEFLDKPVMGSLLAKL

SEQ ID NO: 1081 - protein, 615 aa, Perkinsus marinus; identical to SEQ ID NO: 1070

SEQ ID NO: 1082 - protein, 550 aa, Ajellomyces dermatitidis; identical to SEQ ID NO: 1075

SEQ ID NO: 1083 - protein, 648 aa, Rhodococcus opacus; identical to SEQ ID NO: 290

SEQ ID NO: 1084 - protein, 705 aa, Ixodes scapularis; identical to SEQ ID NO: 1080

SEQ ID NO: 1085 - protein, 584 aa, Penicillium marneffei; identical to SEQ ID NO: 1049

SEQ ID NO: 1086 - protein, 686 aa, Pediculus humanus; identical to SEQ ID NO: 1076

SEQ ID NO: 1087 - protein, 660 aa, Pediculus humanus; identical to SEQ ID NO: 1077

SEQ ID NO: 1088 - protein, 670 aa, Streptomyces griseus; identical to SEQ ID NO: 288

SEQ ID NO: 1089 - protein, 592 aa, Streptomyces griseus; identical to SEQ ID NO: 289

SEQ ID NO: 1090 - protein, 670 aa, Neosartorya fischeri; identical to SEQ ID NO: 1061

SEQ ID NO: 1091 - protein, 550 aa, Aspergillus clavatus; identical to SEQ ID NO: 1062

SEQ ID NO: 1092 - protein, 630 aa, Aspergillus fumigatus; identical to SEQ ID NO: 318

SEQ ID NO: 1093 - protein, 872 aa, Streptomyces hygroscopicus
MTGRANGRGVVVTITGPIACGKTELLDAAAAKADAITLRAVCSAEEQALPYALIGQLIDNPALASHALEPACPTLPGEHLSPEAENRLRSDLTRTLLALAAERPVLIGIDESHANALCLLHLARRVGSARIAMVLTELRRLTPAHSQFQAELLSLGHHREIALRPLSPKHTAELVRAGLGPDVDEDVLTGLYRATGGNLNLTRGLINDVREAWETGGTGISAGRAYRLAYLGSLYRCGPVPLRVARVAAVLGQSANTTLVRWISGLNADAVGEATEILTEGGLLHDLRFPHPAARSVVLNDMSAQERRRLHRSALEVLDDVPVEVVAHHQVGAGLLHGPKAAEIFAKAGQELHVRGELDTASDYLQLAHQASDDAVTGMRAEAVAIERRRNPLASSRHLDELTVVARAGLLFPEHTALMIRWLGVGGRSGEAAGLLASQRPRAVTDQDRAHMRAAEVSLALVSPGTSGPDRRPRPLTPDELANLPKAARLCAIADNAVMSALRGRPELAAAEAENVLQHADSAAAGTTALAALTALLYAENTDTAQLWADKLVSETGASNEEEAGYAGPRAEAALRRGDLAAAVEAGSTVLDHRRLSTLGITAALPLSSAVAAAIRLGETERAEKWLAQPLPQAIQDGLFGLHLLSARGQYSLATGQHESAYTAFRTCGERMRNWGVDVPGLSLWRVDAAEALLHGRDRDEGRRLVDEQLTRAMGPRSRALTLRVQAAYSPPAKRVDLLDEAADLLLSCNDQYERARVLADLSETFSALRHHSRARGLLRQARHLAAQRGAIPLLRRLGAKPGGPGWLEESGLPQRIKSLTDAERRVASLAAGGQTNRVIADQLFVTASTVEQHLTDVSTGSRPPAPAAELV

SEQ ID NO: 1094 - protein, 724 aa, Candida maltosa; identical to SEQ ID NO: 55

SEQ ID NO: 1095 - protein, 611 aa, Deinococcus proteolyticus
MPQYKAPLRDFRFVMNELLDAPAQLAQMPFYQDNETADADLMAQVLEEAARFVEGELLPLNQTGDQQGCQRSENGDVKTPDGFKAAYQKYVQAGWPALDADPQWGGQGMPHTVANAMLEMMNSANVAWAMYPGLTHGAVSALSEVGSPELQQLYLPKLISGEWTGTMCLTEPHAGTDLGIIRTKAADNGDGTYSITGTKIFISAGEHDFTDNIIHLVLARLEGSPEGTKGISLFLVPKFVPNADGTPGERNGVVCGSLEHKMGIHGNATAVLNFDGAKGWLVGEVNRGMNHMFIMMNAARLGTGLQGLGLGEVAYQNAVAYAKDRTQMRAEPRVNPAEQADPIIVHPDVRRMLMTGKAYTEAGRALALWLALALDTEAHHPDEAKQKEAADTVALLTPIAKAFMTDNGFNIAVQSQQVFGGHGYIAEWGMEQFVRDARIGQIYEGTNGIQSLDLLGRKVLMDGGKKLQALAGTLQAFADENEDDEVVGEYITQLGKAANQLATLTMLVGQKAMDGGEKGPDEVNAVAVDYLRYFGHVVYGYLWARMAKIAADKVVAGQDQDGFYQAKLDTARFYFARLFPETKSLSQTIKAGGESLDFDLKGMFGFEPEHA

SEQ ID NO: 1096 - protein, 599 aa, Deinococcus maricopensis
MPSYKAPLRDMRFIMHELLGAQDVLGAMPYYAENETHDASLLDQILDEAARFTENELQPLNQSGDQEGCTRHEDGSVTTPKGFKEAYKKYREAGWTALSADPQYGGQGLPHLVGNALVEMMNSANVAWSMYPGLSHGAYSALAAVGSDDLKATYLPKLVNGEWTGTMCLTEPHAGTDLGIIRTRARDNGDGTYAITGTKIFISAGEHDMADNILHLVLARLEGSPEGTKGISLFLVPKYLVNADGTLGERNTVVCGSIEHKMGIHGNATAVLNFDDAKGYLVGELNKGMNHMFIMMNAARLGTGLQGLGIGEVAYQNAVAYAKDRLQMRAPQRVRPDEAADPIIVHPDVRRMLLTAKAYTEAGRALAMWLALSLDVEHHHPDDAKRKEAGDLVALLTPIAKAFMTDNGFQSAVLAQQVFGGHGYIQEWGMEQFVRDARIGQIYEGTNGIQALDLIGRKVLMDGGRKLQKLAGMLETFLEENEGNEDLAPYLDTLSRAAQQVGTLTMVVGQKAMQNPDEANAVAVDYLRYVGHVTYAYLWARMAKIALDKQGDDKTGFYAAKLATAKFYFEKLFPETKALSATIKAGNDALAVDEAIFNF

SEQ ID NO: 1097 - protein, 599 aa, Deinococcus maricopensis; identical to SEQ ID NO: 1096

SEQ ID NO: 1098 - protein, 599 aa, Deinococcus maricopensis
MTPFLNRRDLRFQLFEVLRAQDLTARERYRDHDQATFDAVLTLAADLAETHFLPHRRDTDTFEPHIVNGRVQLVPDVQKAIHAFRDAGFFSAHHDEALGGLQLPWLITQAALACFQAANIATSAYPFLTIGNANLLRAFGTPEQQEKYLRPLLEGRWFGTMALSEPHAGSGLADITTLATPRDDGTYTVAGTKMWISGGEHELSENILHLVLARTPGAPPGVKGISLFLVPRYRVTDDGRAGASNHVVLAGLNHKLGYRGTTNTLLNFGEGGDSLGELVGTLGGGLNAMFHMMNEARIGVGLGATMLGVAGYQYSLAYARERTQGRAASTRDPSSPPVPIIAHADVRRMLLAQKATVEGALALGLYAARLVDDERTADTPEERATATLLLDLLTPLAKAWPSSHVQTALDHALQILGGAGYTRDHPVEQLWRDNRLNPIHEGTNGIQGLDLLGRKVTAHGGRSLQLLAQAVTQDLAAAEGLPDVQVIRDAVRHALTTSAQALQAILTQAPDLGPDRFLANADSALEMLGGTVIGWMWLRQATVAARALPDATGPDADFYRGKLHAAQYFARFELPRVDHHARLLASADPTTYDMQDAWY

SEQ ID NO: 1099 - protein, 599 aa, Deinococcus maricopensis; identical to SEQ ID NO: 1098

SEQ ID NO: 1100 - protein, 668 aa, Arabidopsis thaliana
MAMPRATSGPAYPERFYAAASYVGLDGSDSSAKNVISKFPDDTALLLYALYQQATVGPCNTPKPSAWRPVEQSKWKSWQGLGTMPSIEAMRLFVKILEEDDPGWYSRASNDIPDPVVDVQINRAKDEPVVENGSTFSETKTISTENGRLAETQDKDVVSEDSNTVSVYNQWTAPQTSGQRPKARYEHGAAVIQDKMYIYGGNHNGRYLGDLHVLDLKSWTWSRVETKVATESQETSTPTLLAPCAGHSLIAWDNKLLSIGGHTKDPSESMQVKVFDPHTITWSMLKTYGKPPVSRGGQSVTMVGKTLVIFGGQDAKRSLLNDLHILDLDTMTWDEIDAVGVSPSPRSDHAAAVHAERFLLIFGGGSHATCFDDLHVLDLQTMEWSRPAQQGDAPTPRAGHAGVTIGENWFIVGGGDNKSGASESVVLNMSTLAWSVVASVQGRVPLASEGLSLVVSSYNGEDVLVAFGGYNGRYNNEINLLKPSHKSTLQTKTLEAPLPGSLSAVNNATTRDIESEVEVSQEGRVREIVMDNVNPGSKVEGNSERIIATIKSEKEELEASLNKERMQTLQLRQELGEAELRNTDLYKELQSVRGQLAAEQSRCFKLEVDVAELRQKLQTLETLQKELELLQRQKAASEQAAMNAKRQGSGGVWGWLAGSPQEKDDDSP

SEQ ID NO: 1101 - protein, 648 aa, Arabidopsis thaliana
MAHMVRASSGLSYPERFYAAASYVGLDGSQSSVKQLSSKFSNDTSLLLYTLHQQATLGPCSIPKPSAWNPVEQSKWKSWQGLGTMPSIEAMRLFVKILEEADPGWYPRTSNSVLDPAVHVQINSTKAEPSFESGASFGETKTITSEDGRLTETQDKDVVLEDPDTVSVYNQWTAPRTSGQPPKARYQHGAAVIQDKMYMYGGNHNGRYLGDLHVLDLKNWTWSRVETKVVTGSQETSSPAKLTHCAGHSLIPWDNQLLSIGGHTKDPSESMPVMVFDLHCCSWSILKTYGKPPISRGGQSVTLVGKSLVIFGGQDAKRSLLNDLHILDLDTMTWEEIDAVGSPPTPRSDHAAAVHAERYLLIFGGGSHATCFDDLHVLDLQTMEWSRHTQQGDAPTPRAGHAGVTIGENWYIVGGGDNKSGASKTVVLNMSTLAWSVVTSVQEHVPLASEGLSLVVSSYNGEDIVVAFGGYNGHYNNEVNVLKPSHKSSLKSKIMGASAVPDSFSAVNNATTRDIESEIKVEGKADRIITTLKSEKEEVEASLNKEKIQTLQLKEELAEIDTRNTELYKELQSVRNQLAAEQSRCFKLEVEVAELRQKLQTMETLQKELELLQRQRAVASEQAATMNAKRQSSGGVWGWLAGTPPPKT

SEQ ID NO: 1102 - protein, 411 aa, Deinococcus proteolyticus
MTSTAERSARPDTAPDALGQNPNVQPFNEDQRTIISALRSFLKNKVEPGAAERDQTGEFPMDLVRELGEMGIMGAQTPEKYGGAELDTATFAQIIEEIAVVDGSLCLTVASHNSLCQGHILIGGTEEQKQKFLPDLASARKLGAWGLTEPGSGSDSAGLQTNAKEQPDGSWILNGSKNFITQGSVGGTYVILARTDPPREGKGKNDGISAFVFNRDEVQGFSIGRKEDKLGLRSSDTAQLIFEDIHLPAEALLGERGNAFKDVMRVLDGGRVGIGAMGLGLGRAAFEYAARYTLEREQFGKPLAYNQNIAFRLAEMDTKLEAARLLIRKAADLKDAGQPFTIPVARAKYYATVVGVEACDEAIQMLGGYGYIKEYPVERFWRDNRLTRIGEGTDEVQRLVISRDVLKRFED

SEQ ID NO: 1103 - protein, 584 aa, Marinithermus hydrothermalis
MVEEKDTKLWKKGGGWLLEAPEATYTPEDFDETTRMIIDTTRTYVEREVLPVLERLEHGELELNVPLLRKAGELGLLGVEIEEAYGGLDLPKVVSTVIAEYLAPTGGFSVSFGAHTSIGTLPLVFFGTEEQKKKYLPKLATGEWIAAYALTEPGSGSDALGAKTRAELSPDGKYYILNGTKQFISNAAFADLFTVFAKVDGEHFTAFLVERSFEGVSVGPEEKKMGIKASSTRQLILENVKVPVENVLGEVGKGHKIAFNVLNVGRYKLGAGAVGGAKEALGQAARYAKERHQFGQPIASFGAIRQKLARIAIKTFAAESAVYRTMGLIDAALEGKKGAEAVLKGIEEYAVEASIIKVLGSEVLDYAVDEALQIHGGYGYIQEYPIERAYRDSRINRIFEGTNEINRLLIPGMLLRRAMKGTLPLVEAAMKLQEELLEPSFGEEAEGEWAKEARYVANLKKLALMTAGLAAQKFGPRIEAEQEVLLGIADILIDVFAAESALLRAQRLGGVYADMARLYLAEAQDRAAQIAQFLLPYLEEGDDLRVLLAAARRLTKRDPFDPITATRRVAEAVLEAEGYPQPRA

SEQ ID NO: 1104 - protein, 430 aa, Deinococcus proteolyticus
MTAAPHAVPGAAALAAFGVSERALELLDRLTRFMAEHIYPNEAAFLAEVGAGDRWAHLHLLEDLKARAQAEGLWNLFLPPASDPEGRFGAGLSNLDYAPLAEQMGRVWWAPEVFNCSAPDTGNMEVLARYGSPEQQERWLGPLLRGEIRSGFCMTEPDVASSDATNIRASIRRDGDGYVISGRKWWTSGAGDPRCQVAIFMGQTDPAAERWRQQSMILVPLDAPGVTRERMLTVFGYDDAPHGHAELSFHEVRVPASHLILGEGRGFEIAQGRLGPGRIHHCMRLIGQAERALELMVARAAARTAFGKPLAAHQHTRELIAQSRMEIDQARLLTLQAAQMMDTVGNKAARGEIAAIKVVAPGVALRVIDRAIQVYGGAGVSQDTPLAQMYAHARTLRLADGPDIVHTETVAKAELARQGIDLRVARGGKA

SEQ ID NO: 1105 - protein, 414 aa, Deinococcus maricopensis
MFDHSPRTQDLLGRLTAFMDEHIYPNEAEFRRQVNAGERWAHVPLLDDLKPKAQAAGLWNLFLPPLTDPEARFGAGLTNREYAPLCEVMGRVWWAPEVFNCNAPDTGNMEVLAKYGTPEQQETWLRPLLNGEIRSAFAMTEPDVASSDATNIESSVARDGDEYVINGRKWWTSGAGDPRCTVAIFMGKTDPDAPRHLQQSMILVPMDAPGVTVQRMLTVFGYDDAPHGHAEITFENVRVPAANLLLGEGRGFEIAQGRLGPGRIHHCMRLIGQAERALELMVQRAAGRVAFGKPLAGHQHVRDLIAQSRIEIDQARLLTLHAAHMMDTVGNKAARAEIAAIKVVAPNVALAVIDRAIQVHGGAGVSGDTPLAEMYAQARTLRLADGPDIVHLETVAKEELRRQGVDLRGGQRGR

SEQ ID NO: 1106 - protein, 602 aa, Desulfatibacillum alkenivorans
MAQVLSDRRDVQFVLNEQLQIGDLCKSERYGDLNTKTFDLFMNEARALATKELLPTREESDRVGATWDDGNVTVPPSFHRAYKLFREGEWLTIADDIEVGGQGMPQVLAFASLELFAAANMAFSIYTMLGHGAGKLIEVYGSELQKKMFLGKVYSGEWGGTMCLTEPEAGSDVGALTTTAVKNEDGTYNITGNKIFISAADHDLVDNVVHPVLARIEGDPAGTSGISIFLVPKYWVNEDGTTGDYNNVYVDRIEEKMGIHASATCSVQFGAKGPCRGLLLGEERKGMRIMFHMMNEERLNVGVQGLGSASAAFLLALNYARERVQGKEILKSRDPEAKGATIINHPDVRRMLLQMKAYVEGLRSLNYYTGYCMDKVVTSESDEEKSLYQGIVDLLTPICKGYTTEKSVLVCNDAIQTYGGYGFTKEYPVEQLARDTKILTIYEGTTGIQAADLLGRKLGMQKGQVFMKFLEQINATIAKGKELEATKALAENLEKAVIKFSETAMSVGKAAASEKVLAAFGHATPFMEVMGDIVLGWMHLWRATVAAPMVEKGKKDLAFYKGQMETARYFINVMLPITFGKMDSILALDDAAVAIDDASFGG

SEQ ID NO: 1107 - protein, 414 aa, Deinococcus maricopensis; identical to SEQ ID NO: 1105

SEQ ID NO: 1108 - protein, 824 aa, Arabidopsis thaliana
MGSSTGDLVTRIQSAHRFDHDALFRFAADNVSGFPTNPSQFKVSQFGHGQSNPTFLIEVGSGSSLKRYVLRKKPPGKLLQSAHAVDREFQVLRALGEHTQVPVPKVFCLCTDPAVIGTAFYIMEFMEGRIFIDPKLPNVAPERRNAIYRATAKALASLHSADVDAIGLEKYGRRGNYCKRQIDRWFKQYLASTSEGKPERNPKMFELVDWLRKNIPAEDSTGATSGLVHGDFRIDNLVFHPSEDRVIGIIDWELSTLGNQMCDVAYSCMHYIVNVQLDKEHVSEGFETTGLPEGMLSMPEFLLEYCSASGKPWPAANWKFYVAFSLFRAASIYTGVYSRWLMGNASAGERARNTGVQANELVESALGYIARENVLPEHPPSVQRDVSPSYESLVDGSGRFIPNRKVLELRQKLIKFMETHIYPMENEFSKLAQSDMRWTVHPQEEKLKEMAKREGLWNLFVPVDSAARARRELAATENKHNLSGKSFDQLFGEGLTNLEYGYLCEIMGRSVWAPQVFNCGAPDTGNMEVILRYGNKEQISEWLIPLLEGRIRSGFAMTEPQVASSDATNIECSIRRQGDSYVINGTKWWTSGAMDPRCRVLILMGKTDFNAPKHKQQSMILVDMRTPGISVKRPLTVFGFDDAPHGHAEISFENVVVPAKNILLGEGRGFEIAQGRLGPGRLHHCMRLIGAAERGMELMAQRALSRKTFGKFIAQHGSFVSDLAKLRVELEGTRLLVLEAADHLDKFGNKKARGILAMAKVAAPNMALKVLDTAIQVHGAAGVSSDTVLAHLWATARTLRIADGPDEVHLGTIGKLELQRASKL

SEQ ID NO: 1109 - protein, 824 aa, Arabidopsis thaliana; identical to SEQ ID NO: 1108

SEQ ID NO: 1110 - protein, 452 aa, Deinococcus proteolyticus
MEKNTPDLNDLMAQIDLGKLGVLAGKVDLAGILNAASNMNDKQLRQLSRALGVGGSGRKRELPAADGDFYDYLDTLTDAQVEVAGRVHAFMRAEVMPVMNEYWSRDEFPRDLIGKMRELNLLRAIWNEDGTRRPDATIMEGIITLEACRVDVSTAVFFGVHGGLAFASIALGGSEEQKKRWLPDMLDMRRIGAFGLTEPEGGSQVSEGMRTTCRRDGDGWVLNGEKKWIGNSTFSDFTVIWARDEETSEVRGFVVEAGTPGYSVEKIQGKIALRMVENGHITLQDCRVADEFRLQAVQGWDTVSDVLKLTRAGVAWQGVGCAMGAYELALAYAQQRKQFGKRIGEFQLVQNHLVLMLADVTAMLGMVTRLSHLADEGRMDDAHAALAKVHTAARCREVVARAREVFGGNGILLEHGVAKHFADTEAIYSYEGTNEINTLVVGRAVTGLSAFV

SEQ ID NO: 1111 - protein, 604 aa, Desulfatibacillum alkenivorans
MGQQIADRRDIEFVLYEQFDAEYLANNERYQGLNRKAFDLILTEARAFAIKELLPIMAEGDRQGVRLEDGTVKVPDCFKKPFAQFIENEWMSLTEDPEMGGQGLPHLIATAATEYLVGPNFAFAGYLGMGHGTGKMIELYGTEAQKSLFVKNLYTCKWAGTMMLTEPEAGSDVGALTTTAVPNEDGSYSITGNKIFITVGDHDLTENIIHAVLARIEGAPAGTAGVSLFIVPKIRVNEDGSLGIPNDVICTGLEEKMGIHGSATCSMALGSKGQCQGFLLGEANKGMRAMFHMMNEARLAVSMQSLGIASTAYLHAANYAKERVQGRDLSDMLNKDAVSVPIVRHPDVRRMLTWMKAYVDGMRSFVYFIADCIEKEENSQDIEEHKRCKGLVDLLTPIIKTYNAKYGFEVCVQAIQTYGGYGYIREYPVEQLLRDAKITSLYEGTDGVQAMDLLARKIGMEQGAVFQSFIKEINNVIDRARKSDALASMADAVDQCLKDLSNLAIAMGTTAMSPDFKIAFAHSVPFLDVFGDMVMAWMLLWRACVAAEKLGEMAKKKDLAFYEGQIKTAQFFCETVLPVTEGRMKSIKNFSPAPLEMDEAAFGG

SEQ ID NO: 1112 - protein, 602 aa, Desulfatibacillum alkenivorans
MAQLIADRRDIDFVLFEQMKADELAKTDKFAEFNKKTIDLIVNEARNLAIKEILPTNADGDKGCVFENNKVTVPESFHRPYELLCEGEWVAMQEDPEVGGQGMPAMVAQAAGEYFVGANCAFMMYPGLSHGAGHLVEVFGTDKQKELYLKNMYTGKWGGTMLLTEPEAGSDVGALTTTAKPNGDGTYSISGTKIFISGGEHDLTENIIHPVLARIEGAPAGTAGISLFAVPKIWVNDDGSLGEDNDVVCDRIEEKMGIHGSCTCVLTLGGKGKCKGTLLGEENKGMRAMFQMMNEARLGVGLQGFSMASCAYMYALDYTRQRKQGKNLLEFANPDAQSVTIINHPDVRRMLMTMKAYIDGMRSFLYFVGNCFDKHKTAGNEEEAEKYMNLIEVLIPVIKAYCTDRAFDVCSLAVQSYGGYGYTKEYPVEQLLRDTKITCIYEGTNGIQAMDLLGRKLGMKGGKPFMELMGVMMQTVAEAKEAGLEDLAAKVEAAVNGAGEIAMLMGKTAMSEKVLTAFAHACPFQDVLGDTIMGWMHLWRATIATNKVEKAKSKDKPFYEGLIKTANFYINSFLPITEGKRNSIKAMESAAVDMTEDAFAGK

SEQ ID NO: 1113 - protein, 611 aa, Deinococcus proteolyticus; identical to SEQ ID NO: 1095

SEQ ID NO: 1114 - protein, 601 aa, Desulfatibacillum alkenivorans
MADKFYSERNLKFLLYEVFDAASLTKYDYYSEHNKKMFDMVLAEADKLAKKMMRPILEEMDRNPPELEDGSIRVHDDVRKILDECGKGGWITASKPVDHGGDQLPLMITDSCQYIFCAANYSAAVYPGLNAGASHLIEEFGSEDLKETYLPNLHNGTWQGTMALTEPGAGSSLSDLETSAEPTEEGYYLIRGQKIFISAGDHNCVDNVVHLMLAKIKGGPPGVKGISLFVVPKFRPALGGGLEPNDVVASGVYHKMGYRGAPIAQLSMGDGDNCRGWLVGEPHKGLFYMFQMMNEARLGVGLGATAIASAAYYAALEYCRERRQGRKIGQKDPTQPQVPIIEHADIRRALLFQKAIIEGSHSLLLQGCKYADMMRVTTGEEQERYSLLLDLLTPVAKTYPSEMGIQAVSQGLQCFGGSGYCDDYPLEQYYRDMRIHPIHEGTTAIHGLDILGRKVVMKEGKAFAIFKQEVLQTVQNAEADSELKGFGGKLKAALEVLDDATRHLLNLASKKGPEYYLADATLYLELFGIVTIAWQWLVQGLAASKALSEGAKKKDVNFYNGKILTLKYFYAYELPKITGLSIRLLNTDGLTVDLDTAIFND

SEQ ID NO: 1115 - protein, 433 aa, Caenorhabditis remanei
MTISVILLKNKPIVDHQLSTSILSKMALLARKAPALLPAPTTSTMKHMIYDETHFAMQNSLSKMITEKINPNVAQWEKSGRYPAHYIFKMMGQLGVFAVNKPEEFGGTGRDFSMSIAVAEQIGSIDCGSIPMSVMVQTEMSTPALAQFGSDFLRNRFLRPSLNGDLVSSIAVSEPHAGSDVSAIRTHARRFGTDLIINGSKMWITNGDQADWACVLVNTSNEKNLHKNKSLVCIPLDSPGVHRSSPLDKLGMRCSDTVQLFFEDVRVPASFIIGEEGRGFSYQMKQFNDERLVTVAVGLLPLQNCINKTIEYARERSIFGKTLLDQQYVQFRLAELEAELEATRSLLYRTVMARCQDEDVSMLTAMSKLKIGRLARKVTDSCLQIWGGAGYLNDNGISRAFRDFRIFSIGAGCDEVMMQIIHKTQSKRQQKTI

SEQ ID NO: 1116 - protein, 615 aa, Desulfatibacillum alkenivorans
MAQYIADRRDIDFVLFEQLEADKLCEHEKYAEFNKKTFDLLINEARNYAVKEVLPTLTEGDRAGGAIFDNGKVTVPECYQKPYKLLVEGEWVGMTEDPEVGGQGFPLTIGQAVIEYIIGANFAFAAYGYAGHGTGKMIEIFGTDKQKELYLKKLYSAEWGGTMVLTEPEAGSDVGNLSTTATPNDDGTYNISGNKIFITGAEQDLTPNVIHPVLARIEGAPKGTKGISLFIVPKIWVNDDGSLGEPNDVVCTGIEHKMGLKGSSTCSLTFGGQGKCKGVLLGEVNKGMQVMFHMMNEARLLVGTIGACNASAAYLYAVNYAKERVQGRDLDDMFNHDATPVTIIKHPDVRRMLLWMKAHVDGMRSLCYYGANLFDKIELETDEAKKDYMQGVIEILTPIIKSYCTDRGFQVCGEAIQCYGGYGYTQEFPVEQIMRDSKINSIYEGTNGIQAMDLLGRKMGMKKGAYFINLLSEIGKIVAQAKQNPALDQDASKLEEAVTRLSEIAMHLGSTAASGKIKEAFSFATPFQEVMGDVVMGWMLLWRAVIAAPKLDKIVGDKDAAEVAAKNKEAAFYLSQLKTAEYFINSILPGTIGKMNAIANTNDAVVSTPEACFMG

SEQ ID NO: 1117 - protein, 605 aa, Desulfatibacillum alkenivorans
MAQQLIDQRDLDFVIWEQMKAEEILANEKYAEFNKKTCEMILREARAIAIKEILPTLAEGDKEGVKFENGVVTTPECFRPVHKKILEGEWQSVGVPQDMGGQGAPGHIAYAVAEYFLGANYAVSGYAKMGAGTARMIHLYGTQEQKDKYIPNLVAGKWGGTMLLTEACAGSDVGALETTAVRNPDGTFSLTGNKIFITNGEHDLVENIIHPVLARIEGDPPGTSGISIFIVPKYFVNEDGSLGDRNDIVCTGVEEKLGIHGSATCSMSLGTKGKCTGFLLGEERKGMNIMFNMINGSRMGTGLQGLSYASAAYLLAVNYARERVQGRSLADFKDKSAPSVPIIEHPDVRRNLLWMKSYVDGMRSFFHYLVSCSTRMETAATQEEREIYSDLFEMLTPSIKDYLAVKGHEVCVQAIQVFGGAGYTRDYLVEQYARDCKITSIFEGTSGIQAMDLLARKLGRKKGAVFAHLLKEMNATVSRSKEFEGLKDLAEDLEQAIPAFAATAEGILKRAASPEFMTAFAHSLPFLNILGDMMMAWMLLWRAEISSKQLADGAKKKDLDFYNGQVKTARFYIKTILPEVLGKMNAVNAGSGVAMEMTSAEYGGL

SEQ ID NO: 1118 - protein, 604 aa, Desulfatibacillum alkenivorans
MAQVIADRRDIEFVLYEQLEADKINKHKEYSDLDKKSLDLIITEARNLALKELLPINAEADKTGLRFENNQVFVPEVFHKPFRILAEDGWGSVTEDPDLGGQGLPTLIMQPIIEYLMGACGVCLGYVTMGHGTGKMIELFGTDKQKELYLKNLYSAKWGGTMVLTEAEAGSDVGNLSTTARKNDDGTYSITGNKIFITYGEHDLTENIIHPVLARIEGAPAGTAGISIFIVPKIWVNDDGSLGEPNDVVCTGIEEKMGIHASSTCSLAFGGKGQCRGYLLGEENKGMKVMFLMMNEARLNVGFQGFSAASVAYMYACNYAKERIQGRALEDSANKDAKPVAIINHPDVRRNLLTMKAYTDGMRSFIYYVADLFDKEELAESPEEADRFNKLIQLYTPVIKAYCTDKGFELASTGIQVYGGYGYISEYPMEQILRDAKIGSIYEGTNGIQAMDLIGRKLGMDKGAIFMSFMGEVAKTVAQAKAVPGLEDMAAKVEAACNRLGETAMHLGKTAVSPQFKAAFAHSTHFLEAMGDVIMAWMLLWRAVISAPKIEKQKKAVEKEYYEGQVKTAEFFIFNMLPVTMGKMDSITITNPAALEIADSCFGG

SEQ ID NO: 1119 - protein, 606 aa, Desulfatibacillum alkenivorans
MAQQLVDRRDLDFVLWEQLDCEGEILKKYDAYKEFNKKTCDMILNEAKALAVKELLPTMQEGDRQGVRYENNEVKVPDSFHRPHELLLEGEWQNLGVEPEMGGQGAPAFISSATAEMFMAASWACYSYATMGNGTSDMIEKYGTQEQKDLYIPKITTGEWGGTMLLTEPDAGTDVGALTTTAVKNDDGTYSLTGNKIFITNGEHDLCENIIHPVLARIEGDPAGTKGISIFIVPKYFVNPDGSLGDRNDILCTGVEHKHGIKASATCQMSMGSKGKCIGFLLGKEREGMKVMFNMMNGARMATGLQALAYASASYLDALNYARDRIQGRSIDDMANHGAPPVAIINHPDVRRNLLWMKSYVCGFRSFFQYSSMLATKAAMAEDEEERKLNNGLYELMTPLIKAYLSDLGYEVCVQGIQVYGGVGFCQDFLAEQYARDCKITSIYEGTSGIQSMDLLGRKLGMEKGKVFMAFMGEVGKTIAKAKGQEALKGLAEDLEAALNRLGETAMHLGKTAVSPDFKAAFAHSLPFLYVMGDVIMAWMLLWRASVAVEKLAGKVKKKDEAFYTGQVKTAEFFIQSLLPITHGKMNAIFNTCKAAIEMPDDGYGI

SEQ ID NO: 1120 - protein, 433 aa, Caenorhabditis remanei; identical to SEQ ID NO: 1115

SEQ ID NO: 1121 - protein, 661 aa, Planctomyces brasiliensis
MSTTEHPKSDTQSNLNQAPDNPPVSSTVADSSPTEPQSTFVETALRLSGKTAEEAQKTGTIDRADDEMELLFADEYKTTRSPVHRAVWDDRFPNELFRSKISKPTPAVERIFAACLNCVIKHQDQGTHYNDQGKVSEALFRDLGKAGYWGLLVDKEYGGSEVPFEQFAAFLSRMATINPTVAGLGSVHGCIGAVDPLMAFGNEEQKRKYLPLLASGEKLSAFALTEPGAGSDLTALKTEARLEGDHFIVNGEKLFITNAIPGRVIGLVVRIDDKPAVLIAELPEEENEQFQMVDYGLYALKHSYNNGLKFRNFKVPKENLLHIDGGDGLTIAYHGLNRGRVALCATAAGTIRLMLANTLPWARYRETYGLPIEERELVRRRLGMMAAYILGCDAMVHWCGGMLDAGYRGEMECIVAKIFGSEVQKETAIELFMKTHGGRSFLHGHLFGDNVHEFLAPCIYEGEGEMLGMAFMKSLIKQHGKTYYEPIGKALQKAGIKQPNPANPAHLFALRQAAMPYLKWRIGESLVWPKRDDYEDIPFQLREHVESSVERLQGARTAVDGLMQKYQLALADRQCTMADVSQRIQDQIVSLVTCLYASERDTELNVAAADVLARHLNQRSTGRRPGGAYFKAVTRLGAMVINRGEDLLGGIEAEAIMMPYK

SEQ ID NO: 1122 - protein, 564 aa, Prevotella multisaccharivorax
MIEAKKLQYYLDSPLMKRIVELKERDFTDKDQFDYAPVSYEDAIENYKRVVDITDEVAQNIIEPNSESVDLEGPHLENNRMVYASKTYENLDATRKAGLWGVTMPRQFGGLNLPMTVFSMLSELVSAADSGFQNIWSLQSCIDTLYEFGTPEQQAKYIPRICAGETMSMDLTEPDAGSDLQHVMLKATQDADGTWRLNGVKRFITNGDSDIHLVLARSEEGTRDGRGLSMFIYDKRDGGVDVRHIENKLGIHGSPTCELVYKNAKAELCGERRLGLIKYVMSLMNGARLGIAAQSVGLQQEAYDQALAYARERKQFGEAIVNFPAVYDMLSRTKAKLDASRAILYQTSRYVDIYKTLGDISRERKLTADERKEMKQYSRLADAFTPLGKGMTSEYANQAAYDCVSVHGGSGFIMEYKAQRLLRDARIFSIYEGTTQLQVVAAVRYITNGTYLNIMKEMLTDEVSEAVEPLRGRIVKCVDLYTEAVEKVKADENQEEHDFLARRLYNMTGDIILSLLLLRDATKDAGEFEKSANVFVRMAEEECIGSHAYIMNFKADDLKNFVAE

SEQ ID NO: 1123 - protein, 569 aa, Odoribacter splanchnicus
MANFYTDNEDIKFHLGHPLMEKIVALKERNYTEAQQYDNAPRDFEDAFDNYDKVLEIVGEICGDVVAVNAESVDAEGPQVVDGHVKYAAGTQQNIDVINQAGLNGISLPRKYNGLNFPITPFIMAAEIVARADAGLQNIWGLQDCAETINEFASDEQKAKYLPRVCAGETCAMDLTEPDAGSDLQAVQLKATYNEADGQWYLNGVKRFITNGDGHISLVLARSEAGTNDGRGLSMFIYDRNSNAVTVRRIENKLGIKGSPTCELVFKNAPAELVGERKMGLIKYVMALMNAARLGIGAQSVGIAEAAYREGLKYAQERKQFGKAIIEFPAIYEMLSNMEAKLHGIRSVLYETARFVDMYKTYYHISKERALDKDERNEMKEYQKLADIYTPLQKLFASEYANEITYDALQIHGGSGFMKDYPIQRYVRDARITNIYEGTSQLQVVAAIRGVTTGQYAKHIREVYEKMEIAPEHEYLRETLKCMTGKLEAATAKVAEAGSTEYTDFHARRLVEMAGYTIIGYLLLQDAQKYDKYVKSAEIFINYGKAKVAAHDEMINSFNPDKLGIYKKN

SEQ ID NO: 1124 - protein, 406 aa, Desulfatibacillum alkenivorans
MTYNELNIDLTEEQIALKRETHKFAKEVMRPASIELDQLADPEEVIKSPVYWNVMKKGYELGYHSIFIPDTWGGMGLDPLDVHIVLEELGWGAGGMAIGLCVGCFPAFFSSMVPTDKLIDDVILPFCECDDASFIGCWGITEPEHGTDTLSPGTEMFSNPDISCDVKARLDGDEWVISGQKSAWVSNGTVATHCLCFLTIEPSMGMAGGGICVIPTDLPGVRKGKPLDKMGQRDLNQGELYFDNVRIPRDYMMVDQEAYDGILDLTLATANASMGAIFTGVARSAFDLALDYSKKRVQGGKPIFQHQMIKHKLFSMFMKVEAARALSRAAFVYNLNNSPPLTEYSIASKVFCTQTALEVANDAVQIFGGVGLSKEYPIEKIFRDARASLIEDGANDTLMITAAHHF

SEQ ID NO: 1125 - protein, 602 aa, Desulfatibacillum alkenivorans
MASKFVSKRNIDFLLYDVFNVDELTRFDYYKEHNHKVFDMVVSSAVQLAKNLMRPILEEMDVTPPELVDGEVKVHPKVKEIMKECGEGGWIASNFPLEYGGDQFPLTLTNMSRFIFAAANYSASVYSDANAGAAHLIISFGDKALQETYLDKLIQGEWQGTMALTEPQAGSSLSDITTTAYPTDEGYYKIRGHKIFISGGDHDALDNIVHLMLARIDGAPAGTKGISLFVVPKKRVEPDGSLVFNDIVCSSVYHKLGYKGMPLTELSIGEKNDCRGYLIGEPHKGLKCMFQMMNEARIEVGLGAAGIATAAYYASLEYARDRPQGRKITEKDPTQPQTPIINHADVKRMLLLQRSIVEGSLSLLTQCGMYYDLALVADNEEDKEKYHLLLEILTPIAKSFPSEMGVLSVSNGLQCFGGYGYCDDFPLEQYYRDIRIHPIHEGATGIQAMDLLGRKVLMKNGKASMFYNQEVQKTIDVAKGVKSLEPYAVRLDEAMHQLQQVTMHLLGVAQEDGPEVFLADASLYLEYFGRIAVGWQWLLQGIAAQTKLENGPSKKEADFYTGKVYTMQYYFHYELSKIKGLSERLMEKARLCVDMQTDYFYD

SEQ ID NO: 1126 - protein, 576 aa, Porphyromonas asaccharolytica
MANFYTDNPHIQYHLQHPLMERIARLKERDYADADQYDYAPSDYADALDSYQRVLEVVGEVCGEVIAPNAAEVDLTGPTLHEGRVSYDPLTAQNLDTVRQTGLMGMALPRRYGGLNMPITPYIMAADMVSRADAGFENLWGLQDCAETLYEFGSEDQRERFLPRVCAGETMSMDLTEPDAGSDLQAVMLKATYNEADQQWYLNGVKRFITNGDSNIHLVLARSEEGTKDARGLSMFIYDAKKGGVTVRRIENKMGIKGVPTCELVFKDAPAELCGERRLGLIRYVMSLMNGARLGIMAQAVGISEAAYREAKAYAADRHQYGHAIDRFPAVYEMLALIRAKADATRAHLYETSRFVDMYKAYDDIARERKLTPEERKEQKYYSRLADAYTPIGKGMSTELANQNVYDCIQIYGGSGYMKDYTCERLYRDVRITNIYEGTTQLQVVAAIRHVTTGTYFARLEEYQQVAVSPEWQETKKLLASWIERAKACTELVTEAKDQTLLDYHARRLVEMCGHCIFAHLLLIAAQDRPDLYEHSTHVYIQYASGEMDKCEGQIRRFDPKQLQHYAVQTSTPAEA

SEQ ID NO: 1127 - protein, 661 aa, Planctomyces brasiliensis; identical to SEQ ID NO: 1121

SEQ ID NO: 1128 - protein, 569 aa, Odoribacter splanchnicus; identical to SEQ ID NO: 1123

SEQ ID NO: 1129 - protein, 572 aa, Prevotella dentalis
MANYYTDHPEIAFYLDNPLMKRIVELKERNYADKENYADAPVNYEDAIENYKRILEITGDVAANVLEPNSESVDQEGPHLENGRMIYASKTKENIGVTRQAGLWGVSMPRRFGGLNLPITVFSMLSELVAAADSGFQNIWSLQSCIDTLYEFGSEEQQQKYIPRIAAGETMSMDLTEPDAGSDLQRVMLKATQDEDGTWRLNGVKRFITNGDSDIHLVLARSEAGTKDGRGLSMFIYDKRDGGVDVRHIENKLGIHGSPTCELVYKNAKAELCGDRKLGLIKYVMSLMNGARLGIGAQSVGLEQEAYNEALAYAKERAQFGKKIISFPAVYDMLSRMKAKIDASRAILYQTARYVDIYKTLDDISRERKLTPEERQEMKKYNRLADAFTPLTKGMASEYANQNAYDSISVHGGSGFIMEYKCQRLYRDARIFSIYEGTTQLQVVAAIRYITNGTYLGIMKELLDGEVSEDMKPLQERMAKCVELYEQALDKVKADDNQDEHDFLGRRLYNMTGDIVMSLLLLDNASKAPELFAKSANVYVRMAEEEVVGHAAYIQAFKAEDLQHFVQTETEA

SEQ ID NO: 1130 - protein, 409 aa, Arabidopsis thaliana
MQRFFSARSILGYAVKTRRRSFSSRSSSLLFDDTQLQFKESVSKFAQDNIAPHAERIDKTNSFPKDVNLWKLMGEFNLHGITAPEEYGGLGLGYLYHCIAMEEISRASGSVALSYGAHSNLCINQLVRNGTAAQKEKYLPKLISGEHVGALAMSEPNAGSDVVGMKCKAEKVDGGYILNGNKMWCTNGPSAETLVVYAKTDTKAGSKGITAFIIEKGMTGFSTAQKLDKLGMRGSDTCELVFENCFVPEENILDKEGKGVYVLMSGLDLERLVLAAGPLGIMQACLDNVLPYIRQREQFGRPVGEFQFIQGKVADMYTALQSSRSYVYSVARDCDNGKVDPKDCAGTILCAAERATQVALQAIQCLGGNGYINEYATGRLLRDAKLYEIGAGTSEIRRIVIGRELFKEE

SEQ ID NO: 1131 - protein, 564 aa, Prevotella multisaccharivorax; identical to SEQ ID NO: 1122

SEQ ID NO: 1132 - protein, 576 aa, Porphyromonas asaccharolytica; identical to SEQ ID NO: 1126

SEQ ID NO: 1133 - protein, 409 aa, Arabidopsis thaliana; identical to SEQ ID NO: 1130

SEQ ID NO: 1134 - protein, 604 aa, Haliscomenobacter hydrossis
MAEKTFSRRNLDFTLFEVLQVSELIRHDYFKAHDTETFGFTLDMASDIARQIMAPAFTESDRKQPELENGQVKVHSSIHEFIKTFSEAGLMSAPFSEEWGGIQLPKVIAAAAEFIMGSAHNSMVMYTDLTKGAANLIYTFGNPEQKAAFLPKMLSGEWMGTMCLTEVQAGSSLSDVATAASPQADGTYLIKGQKIFISAGDQDVTDNIVHLVLARIDGAPKGTKGISLFIVPKKRINSAGTLEPNDVDSIGIYHKMGQKATPAMHLEFGGKNDCVGYLLGEINRGLPQMFLMMNAARLGVGMGGIHIASAAYYAALQYAQERPQGRRLNEKQALVEPVCIIQHPDVRRMLFLQKAIVEGGLSLILQCYQYLDLEKVHADQPEVKQHYNQLLELLTPVAKTYGAEMGFVAVNQGLQVLGGYGYTEDFPLEQLARDVRIMSLYEGTTGIQAQALLGRQVVGNQGKSLVKWFEEVAKTVHEAENSASLSTYWNDLMSAMRNFQEVTNQQFKNAAHGDMEVLLADANLYMEAFGILNVAWQWLQHGIAAEKGLGNAEIQGEERIFYQSKIETLRFFFHYELPRVQGLFHRLMDTTRLTIFDADAEVLI

SEQ ID NO: 1135 - protein, 661 aa, Xenopus laevis
MNPDLSRERAAASFNPETITYILDGSPERTHRRREIEGLVLNDPSFQHEDPNFLSRSERYEVAIKKSALMVQKMREHGISDPEEIYWFKRTCLGSQTDPLGLHFSMFSNMLANQLTDLQKQKWLPLASHLQVIGTYAQTELGHGTHLRGLETTATYDPSTQEFILNSPTVSSIKWWPGGLGKTSNHAVVLAQLYTQGECKGLQAFIVPIRHMGTHEPLPGVVVGDIGPKFGYDETDNGFLKFDKVRIPRENMLMKYAKVEPDGTYVKPLSDKLTYGTMVFIRSMIVGDSARSLSRACTIAIRYSAVRHQSEIRAGEPEPQILDFQTQQFKLFPLLATAYAFQFVGSYMSHTYHRISAEIQAGNLNELPELHALSAGLKAFTSWAANAGIEECRMACGGHGYSRSSGIPDIYVTFTPSCTYEGENTVMMLQTARFLVKSYIAVLAGKQLDGTVSYLNDVSQHRVQPHPVAGRSFLKDINDIQNLVEAYKQRAAWLVVAAAKNVNADTKRGKRKEDAWNKNSVDLVRASEAHCHYVVVRLFAEKLSEVLDVAAHRILSSLCLFYALHGISKNTGDFLQAGLLTALQVDQVQQRVKDLLAVIRPNALALVDAFDYSDTQLGSVLGRYDGNVYENMFEWAKKSPLNKTQVHESFHKYLKPLQSKL

SEQ ID NO: 1136 - protein, 602 aa, Desulfatibacillum alkenivorans
MAAKFASEKNVKFMLYEVHDLMSLTKLEYYSMHNKKAFDMILDAGMQMAKDMYYPIFKEMDEVHPELADGTVKVHADVKKIMKEAGEGGWISATFPIEFDGGQLPTMLNCATHHMFGAANYSGSVYPGLTSGAAKLITSFGSKELIDTYVPNMLDGKWQGTMALTEPQAGSSLADITTTAYPQEDGSYKIKGQKVFISAGDHDGVENIVHLMLAKIEGAPPGVKGISLFVAPKYRPTADGKLEYNDIAVSQVFHKMGYRGAPITELAIGDKGECVGWLVGKPHHGLKYMFQMMNGARLDVGNAATSIACAAYYASLDYAKQRPQGRKLGQKDLSKPQVSIIEHADVKRMLLQQKAIVEGSLSLILQCHKYEDLETAAADPEEAEKYNLLCEILTPIAKTYPSEMGIISTSNAIQCLGGYGYCQDFPVEQYYRDIRIHPIHEGTTGIQGMDLLGRKVVMLEGKAFKLFKEEMEKTLVMAEESDVYKEYAGLLRDALADIEEVTAHKMKVAATKGAEAFLADACLYLEMFGYMTIGWQWLLQALMAQKGLDGGKAKKMKDLYEGKIITCKYFFKYELIKAKALKIRLMEDDYLTAEAPASCFND

SEQ ID NO: 1137 - protein, 604 aa, Haliscomenobacter hydrossis; identical to SEQ ID NO: 1134

SEQ ID NO: 1138 - protein, 661 aa, Xenopus laevis; identical to SEQ ID NO: 1135

SEQ ID NO: 1139 - protein, 572 aa, Caenorhabditis remanei
MCLLSLPSGRSLFATVTPPAPAHQYIKTPTFPFPTIFIMSSLSSSSSKIFKHALSLTARRRSYSTALATSHRPNDDVTVPPVPPVNLLSENENFFVETVRKFSQNIVKPLVREMDKNSKMNPIVTKGAFENGLMGVHVPEEYGGSGSTFFDAMIVIEELAKTDPSVSAMVGIHNTLPVSMIVEHGTEEQKHKYLPLLCSQSLASFCISESGAGSDAFALKTVAKKDGDDFLISGSKMWITDSGEAQVFVVFANADPSQKYKGITCFIVERGVEGLTVDREEDKLGIRASSTCQVHFDNVRVHKSAILGEYGKAYKYAIECLNAGRIGIGAQMLGLAQGCFDQTIPYLQQREQFGKRLIDFQSSPNRIQGLQHQIAQVRTEIEAARLLVYNAARMKEYGIPYVREAAMAKLFASQVATSTSAQCVKWLGGVGFTKEFPAEKFYRDAMIGEIYEGTSNIQLNTIAKLIDNEYKLRSPSVQNGSNVHLRHSHLDVEEFEHYALDHVDMAFEKVEQVKYNQTVVLKEDSGVHFTAMPAGHMIGGFIWRICRVAGEDIIYCVNFNNKKDRTIAFGKI

SEQ ID NO: 1140 - protein, 424 aa, Caenorhabditis remanei
MSSLSRSLLIGRSAAPLVSATSSMSTKPRTQVDGHVPSPLQQLSEQEISIVDTVRRFAVNVIKPLVREMDDKSQMHQSVITGTFENGLMGIEIPEKYGGPGSSFFDAVLVIEELAKVDPSVSVFVDVQNTLVAPLIIQLGNEEQKQKYLPKIVTEAIGSFALSETGSGSDAFALKTTAKKDGDDFVISGSKMWITNAGHAQFFLVFANAEPGKGYKGITCFLVDRNQEGVSVGKKEDKLGIRASSTCSVHFDNVRVHKSAILGEYGKGTSYKYAIECLNAGRIGIGAQMLGLAQGCFDQTIPYLQQREQFGKRLIDFQGMQHQIGQVRMEIEAARLLVYNAARMKENGIPFVREAAMAKLFASQVATTATSRCVEWLGGVGFTKEFPVEKFYRDSKIGTIYEGTSNIQLNTIAKLVDTEYQQKA

SEQ ID NO: 1141 - protein, 432 aa, Caenorhabditis remanei
MSSLSSSSSKIFKHALSLTARRRSYSTALATSHRPNDDVTVPPVRPVNLLSENENFFVESVRKFSQNIVKPLVREMDKNSKMNPIVTKGAFENGLMGVHVPEEYGGSGSTFFDAMIVIEELAKTDPSVSAMVGIHNTLPVSMIVEHGTEEQKHRYLPDLCSESLASFCISESGAGSDAFALKTAAKKDGDDFLISGSKMWITNSGEAQVFVVFANADPSQKYKGITCFIVERGAEGLTVDREEDKLGIRASSTCQVHFDNVRVHKSAILGEYGKGYKYAIECLNAGRIAIGAQMIGLAQGCFDQTIPYLQQREQFGKRLIDFQGLQHQIAQVRTEIEAARLLVYNAARMKEYGIPYVREAAMAKLFASQVIYLNHFSPNYPISRWPPQHLLNEFPAEKFYRDAMIGEIYEGTSNIQLNTIAKLIDNEYKLRS

SEQ ID NO: 1142 - protein, 437 aa, Caenorhabditis remanei
MSLLARVLRLNTSYRLLNSTSSASFSQKYRTDDVTPQPLQLLSETENSFVETVRRFAGDVIQPLVREMDRKGEMDDRVLKGCFDNGLMGIEVPEKYGGSGSKFFDAVLVIEEISKVDASVAALVDVHNTLFVPLIIELGTEEQKQKYLPRSVTEAVGSFALSEVSSGSDAFALKTTAKKDGDDYIINGSKMWITNSEHSEAFLLFANADPSQGYKGITAFMVDKDSKGFSIGKPEDKLGIRASSTCPIHFDNVRVPKSAILGEYGKGYKYAIECLNAGRIGIGAQMLGLAQGCFDQTIPYLQQREQFGERLIDFQGMQHQIAQIRTEIEAARLLVYNAARMKENGLPFVREAAMAKLFASQVTTETESLRSQSTYFQVATNTTSKCVEWLGGVGFTKEFPVEKYYRDCKIGTIYEGTSNIQLNTIAKLIDLEFKNKA

SEQ ID NO: 1143 - protein, 428 aa, Caenorhabditis remanei
MSLLARVLRLNTSHRLLNSTSSVSFSQKYRADDVTPQPLQLLSETENSFVETVRRFAGDVIQPLVREMDRKGEMDDRVLKGCFDNGLMGIEVPEKYGGSGSKFFDAVLVIEEISKVDASVAALVDVHNTLFVPLIIELGTEEQKQKYLPRSVTEAVLSFALYEVSSGSDAFALKTTAKKDGDDYIINGSKMWITNSEHSEAFLVMLIRVKDTKESLLSWLTRIARDLVLANRKTNLESARLPLVPFISTTFVSPSQRFWENTEKCLNAGRIGIGAQMLGLAQGCFDQTIPYLQQREQFGERLIDFQGMQHQIAQIRTEIEAARLLVYNAARMKENGLPFVREAAMAKLFASQVTTETESLRSQSTYFQVATNTTSKCVEWLGGVGFTKEFPVEKYYRDCKIGTIYEGTSNIQLNTIAKLIDLEFKNKA

SEQ ID NO: 1144 - protein, 572 aa, Caenorhabditis remanei; identical to SEQ ID NO: 1139

SEQ ID NO: 1145 - protein, 424 aa, Caenorhabditis remanei; identical to SEQ ID NO: 1140

SEQ ID NO: 1146 - protein, 432 aa, Caenorhabditis remanei; identical to SEQ ID NO: 1141

SEQ ID NO: 1147 - protein, 437 aa, Caenorhabditis remanei; identical to SEQ ID NO: 1142

SEQ ID NO: 1148 - protein, 428 aa, Caenorhabditis remanei; identical to SEQ ID NO: 1143

SEQ ID NO: 1149 - protein, 601 aa, Haliscomenobacter hydrossis
MLEQYISSRNLRFVLYELLDVTQLQKIERFEAYDREAIDMTLDAAKQIGDQYLFPFYRAMDKEKARYADGEVLVHPSMKPAIMAMVEGGWINAHDDFEAGGQQMPYAILNAATLIFHAANANIACHPFLTTGAANLIRTFGSAALNETYIPNLYNGTWQGTMALTEPQAGSSLSDITSSAEPVNDGEYYKIKGQKIYISGGDHNAVDNVVHLLLARIKGAPVGTKGISLFVVPKLRYENGELVTNDVTTAGIYGKMGQKGYVAAHLMMGEQHDDCRGYLVGQPNQGLRYMFQMMNEARIGTGMVAAATASAAYYASLKYANERPQGRHPSNKDVHQPQVLIIEHADVRRMLLYQKAIVEGSIALLLQCSLYGDLAHHGQGEDAVNANLLLELLTPIAKSYPSEMGIHSVSQGMQVLGGAGYTDDFPLEQHYRDIRVNAIYEGTTTIHGMDLLGRKLTMENGKGLQLLSKEIQTAIEAALLIPNLKPYAEQLMKTGASLQETTVNLFQLASKESPEVFLADATLYLEYFGTLVLAWIWLKQALAAEKGLAQNPSTNDQNFYEGKIQTFKYFFEYELPKMVAMKIRLNSSVRVTLETRAEVLV

SEQ ID NO: 1150 - protein, 573 aa, Caldithrix abyssi
MANFFTDNKDLVFQFENLDLKEIVEIAENNYKEAETYNFAPRDYEDAMDNYRKVLEIVGDIAANIVGPNAAEVDEEGAHFEDGKVTYARGTQLALDYLTKAELMGFTLPRKYGGLNIPKTIYMMAIEMISRADASLMNIFGLQDIAETIYKYGDEAQKQEFLPQFAAGTATGAMALTEPDAGSDLQAVKLQAYQDENGQWRLRGVKRFITNGNGRILLVLARSEPGTKDGRGLSMFVCYGDDTVKVRRIENKLGIHGSPTCELQFNDTPAQLVGKRRFGLIRYVMDLMNGARLAVSAQALGIAQAAYEEALSYARAREQFGRAIYYIPPVTNMLIDMRVRLESDRSLLYATSRWVDLRDKLEEKIEHLKAEGKDTSEYRARLKQVAKISELLTPLTKYFLTEDANKIAYDALQIHGGAGYMREFNVERLVRDARITNIYEGTSQLQIVAAIGGVINDVLGKYFEEKEQQSYKGNLSHLAEILKEMRELFLDALKYVTDKDDKHFQDVAARDLVEMYGYLYVGYLLLDEAEKNARKIWIAKRYISHALAHCQHNVTSIKNEEFNDLYHADEILL

SEQ ID NO: 1151 - protein, 414 aa, Desulfatibacillum alkenivorans
MFDFLLNEEEIKARDEAREFVKTIPRQMILDMDADKIKFPKEFLQEAGRRNLLGVRHPKEWGGRGMSWAGSAAVVEEIGTLGYIFSCTFGVGADLVCDAICLHGTDEQKEKYVKPLLAGDIFAAECLTEPRGGSDFFGATTTAVDKGDHFILNGQKRFIVGAEGADYFLVYAKTNPDAKPQESLSCLIVDRGPGVNVEYLYGLMGCRGGGAGRIVFKDVKVPKENVVGKVHGAYPVFTTMMIPERLGTAAMTIGSARPALDVATGYTTRRKAFGQTINNFQGVNFQIAEAAMLLDACRSLVYTTGRSADIAPYAGQTRRMVSETKKFVTESCQKVVHNAMQVMGGIGYTNVFPVERMYRDLRLATIWTGSNEVMSMVIAHEWYKDFFKSKQANIVRDMELDAEEAEAPDEKIYE

SEQ ID NO: 1152 - protein, 601 aa, Desulfatibacillum alkenivorans
MAQVLADRRDIDFVLYEQLDMEQLTKTPVYKGMNRKLFDMMITEARNLAIKEILPTNADGDKIGVTFDNGEVLVPESFKKAFDLIREGDWTAMNEDPDLGGQGTPYLINFPTREYLWGGNYCLVNYATMGHGTGKMIEAFGSQKQKDLFLEKLYTAQWGGTMLLTEPEAGSDVGALTTTAVKNEDGTYSISGAKIFITNGEHQLTENIVHPVLARVEGAPEGTKGISIFIVPKYWVNEDGSMGDFNDVVCTGVEEKMGIHGSATCSLTLGGAGKCRGLLLGQECEGMKIMFHMMNDARLNVGFQAFTYASSAYLYACNYAKERIQGKDLTAGKNSPSVTIINHPDIRRMLTWMKAHVDGMRSFIYYTASLFDWMKAEPDSDQAQNRQDLIDFFIPLVKGYSAQRSFDVCVNAMQVYGGYGYTKEYPIEQLLRDCKITSIYEGTDGIQAMDLLGRKLQMRGGALFQAFANEVNSCITAALEVPELSAMADRLANALACLGETAQSLSKNLATPLIKTSFASAFPFMEATGDVIMAWMLLWRSNIAVKAQEKAKSKDKAYYSGVIKTAEFFIYNVLPVALGKMDAMNEGNGAAIEIPDDCFGG

SEQ ID NO: 1153 - protein, 595 aa, Desulfatibacillum alkenivorans
MSDFKINQKDLFFILKEQLGYGKLCEFERYESLNEDALDMLVNEAIRFAKGVVSPLNEIGEEQGVHWENNTVTCPKEFKTAFKAYGEDGWTAAVRDPEFGGQGFPTMMRIVVNDLMYGACQSFNMAPSLTHGAAHLIESFGTDEQKQTYIPKMYGGEWAGTMALTEPNAGSNLAALETMAYPEGDHYKIKGNKIFISWGDHDLAGNIVHLALARIEGAPEGVRGISLFIVPKYRVDENGNPGEFNDVVCTGIEKKLGLHSSPTAALAFGGKDGCIGYLCGKANMGLAHMFQMMNAARINTGVSGMSMASAAYQHALDYTKSRVQGRDIAKRKQGSVPIIDHPDVRRMLLWMKGAVDGMRSMIYTTAFWADLAQVTTDPEEKERCTMLMEFMTPIVKSYCSDIGFKVCETAMQCLGGYGFCKDYPIEQYLRDSKIMSLYEGTNGIQSTDLMGRKMHMNEGAPYKAFLKEITDFCEKNHAHPGLGSQVRFLKDVMDDLQEMAREMSSRYSADPLQWASYTYPALMCFSEVIMVWRLVDMAIIAYDRAQKSGKKNDFFRGKVAQATFFTDITLPHTQARARTCTRVDREVVEMADNAF

SEQ ID NO: 1154 - protein, 601 aa, Haliscomenobacter hydrossis; identical to SEQ ID NO: 1149

SEQ ID NO: 1155 - protein, 573 aa, Caldithrix abyssi; identical to SEQ ID NO: 1150

SEQ ID NO: 1156 - protein, 405 aa, Caenorhabditis brenneri
MALLARKVLPVSTSATAKHMIYEESHYQMQHSLAKLIKEKINPNVAQWEKSGPYPAHYVFKLLGRLGVFAVNKPVEFGGTGQDFSMSIAVAEQIGAVDCGSIPMSVMVQTDMSTPALAEFGSDYLRNRFLRPSMSGDLVSSIAVSEPHAGSDVSAIRTSARHYGSDLIINGSKMWITNGDQADWACVLVNTSNEKNLHKNKSLVCIPLNAPGVHRSMPLDKLGMRSSDTAQLFFEDVRVPSSYIIGEEGRGFSYQMKQFNDERLVTVAVGLLPLQKCINETIEYARERSIFGKTLLDQQYVQFRLAELEAELEATRSLLYRTVLARCQGEDVSMLTAMAKLKIGRLARKVTDQCLQIWGGAGYLNDNGISRAFRDFRIFSIGAGCDEVMMQIIHKIQSKRQQKEI

SEQ ID NO: 1157 - protein, 629 aa, Caenorhabditis remanei
MLSTLSKTARISQTRFLRLSHSAAAKDAKPKKAPVAAVDSPSFVMNLFRGKAVTDQVFPYPLNMTEEQKETLGMVMSPLEKMLIEVNDVVKNDETSDIPRAVLDQFAELGTFGVLVPPELEGSGFNNSQMARVAEIVGAYDLGFGVVMGAHQSIGYKGILLEGTDAQKQKYLPDLATGRKFAAFALTEPTTGSDASSVRTRAELSADGKHYVLNGGKIWISNGGFADVFTVFAQTPVKLADGSTKDKMSAFIVERAFGGVTSGPQEKKMGIKGSNTTEVHFDNVKIPVENLLGKEGEGFKVAMNILNNGRFGIPAACTGAMKHCIQKTVDHITTRVQFGKKLQEFGNVQEKLVEMISKLYATESIVYMLSSNMDRGIKEYQLEAAIGKVLASENAWHVCDDAIQVHGGMGFMRETGLERVLRDLRIFRIFEGANDVLRLFIALTGAQHAGKHLAEQASGVGGLIGLAVSRVTGGNTGSNFGQVVDSSLQDSAKALDQQIALFGQTVQGLLMKHKKGIIDRQYEMHRVANAAIDIYSSAAVLSRATYAIKHKASSADFERKVAIYYVEKVLKNKLNFLLKIIFQAMRSSNRYLKDAANGTENKEKVATIESLAKEVCGNGGLTLQHPVEL

SEQ ID NO: 1158 - protein, 498 aa, Myroides odoratus
MNTLVENMDFSIYIEEFKRRLKYLFREKYNYNALGLTRDFPAELVDEIMDQTPLSVAIPQRYGGRGMKVKECLQILSAASYESLPLSLIFGINIALFLEPLAKYGQAAVQQRVFKEFIENKAMGGLMITEKAHGSDALNMKTAFEQKQNMYHIKGQKHWQGLSGTADFWIVTARETRPNGELARDIDFFVCENNKEHQYIPMTHRYNNLGLYAIAYGINEIDIIVPKEQKLLNETTGIKLMLDTLHRSRLQFPGMGLGFIKRLLDESLTHCQERQVGGTPLLTIDSVKNQIAKIQAAYTLCSGMCIFSVDISGIDKNLALMSIEANVLKALVTDLMQESAQISLQLAGANGYRLDHIAGRSLVDCRPFQIFEGSNEMLYTQIAEGILKLMRKAKKTNLYGFLKEYERTSLSAEYFVSQLDLSIDSTLKQRNLILIGKMIARVISFQFILQLDGFNTQLIEITRQSLLSDLAAFYGQFNVQNDVNPILDYEMNSDWTTF

SEQ ID NO: 1159 - protein, 528 aa, Myroides odoratus
MTQSLIDFSVHRGGNCQTAVDFLIEKKEIVMHAVIEHIDFSTYIAEFKKRLKYLFREKYNYNDMGLTRDFPAELMEEIMEEKPLAVAIPTMHGGRGVQVKECLQILAAASYESLPLSLMFGINIALFLEPLAKYGQPAVQQRVFQQFMENKAMGGLMITEKAHGSDALNMKTAFEQKEDMFHIKGQKHWQGLSGAADFWLVTARECKPNGELSRDIDFFVSENNRAEQHIPMTHRYNNLGLYAIPYGINEIDIAVPSEQKLVTESTGIKLMLDTLHRSRLQFPGMGLGFIQRLLDESLAHCQERQVGGVPLLSIDSVKNQIAKIQAAYTLCSGMCIFSVATSGIENDLASMSIEANVLKAVVTDLMQESAQISLQLAGANGYRLDHIAGRSLVDCRPFQIFEGSNEMLYTQIAEGIVKLMRKAKETNLYRFLQGYERTNLSVDLFQMYFNFTVDSAVKQRNMLLIGKMLSRVIAFQFVLQMDDFNSQLVEITRQQVEADLAAFYGQFKTQNDVDPILDYQVNSDWTRF

SEQ ID NO: 1160 - protein, 498 aa, Myroides odoratus; identical to SEQ ID NO: 1158

SEQ ID NO: 1161 - protein, 528 aa, Myroides odoratus; identical to SEQ ID NO: 1159

SEQ ID NO: 1162 - protein, 411 aa, Caenorhabditis remanei
MLSRLTSSIGRNRISVQTRQMSFELSDTQKEVQAAALQFSKDVLLPNAVKYDKSGEFPWDIVRQAHQLGFMNPIIPEKYGGPGMDGFNTCLIVEALSYGCTGIQLAIVGPSLAVAPVFLSGSEEQKKKYLGMLAAEPIIASYAVTEPGAGSDVNGVKTKAVKKGDEYVINGSKAWITGGGHAKWFFVLARTDDDPKAPAGKAFTAFIVDGDTPGITRGKKEENMGQKCSDTRTITFEDVRVPKENILGAPGAGFKVAMGAFDLTRPQVAAGAVGLAWRCLDESCKYALERNAFGTPIANHQAIQFMLADMAINLELSRLYTYRAAAESDAGGVSSYNASIAKCFAADTANIAAANACQIFGGAGFNCDYPVEKLMRDAKIYQIYEGTSQIQRMVIARTLLSHFTHSGTSKM

SEQ ID NO: 1163 - protein, 425 aa, Caenorhabditis remanei
MLKLSRGVPLASVTKFSTKSIKCRPVYPLQHLSENEMKLVEKVKEFATSRVKPLVKEMDRNAKLDKNLLKAAFDSKLMGLEIDEKYGGSGSSFFETILTVEELSKIDPAFALTIHLQNALIAPMLSEYGNEEQKEKYLKKVCTNSIGSFALSETVSGSDAFAMKTTATKDNNDFLINGSKWGISNAPIADFFLVLANAEPEKGYRGITCFLIDRDQEGVVVGEQDDNLGMRAGTTAQVHFNNVRVPKSSIVGEYGKGCLYLRIILIFVFIGYKYAIDILNASRILIGAQMVGLAQGCFDQTIPYLRERKQFGSRLIDFQGLQHQIAKVGTEIEAARLMVYNSARMKDCGFPFVKAASMAKYYAPEVACKTTKMCIEWLGGRGFTKEFSAEKFYRDAVVGGIYEGTSNIQLNTIAKFIDNEYKNKL

SEQ ID NO: 1164 - protein, 411 aa, Caenorhabditis remanei
MLSRLSSSVGRNRVSVQKRLISFEFTDTQKEIRAAALQFSKNVVLPNAAKHDKSGEFPWEIARQAHKLGFMHSIIPEKYGGPGMNALNTCIIVEMLAYGCTGIQAAIVGPSLAISPVLLSGSEEQKKKYLGMLAAEPIIASYAVTEPGAGSDVNGVKTKAVKKGDEYVINGSKAWITGGGHAKWFFVLARTDDDPKAPAGKAFTAFIVDGDTPGITRGKKEENMGQKCSDTRTITFEDVRVPKENILGAPGAGFKVAMGAFDLTRPQVAAGAVGLAWRCLDESCKYALERNAFGTPIANHQAIQFMLADMAINLELSRLYTYRAAAESDAGGVSSYNASIAKCFAADTANIAAANACQIFGGAGFNCDYPVEKLMRDAKIYQIYEGTSQIQRIIIARTLLSHFRHSGTSKM

SEQ ID NO: 1165 - protein, 417 aa, Caenorhabditis remanei
MLSRLANTSVGLSRSATGILASQSRQISFDLSDTQKEIQAAALKFSKDVLVPNAAKFDESGEFPWEIVRQAHSLGLMNPQIPEKYGGPGMTTLETALIVEALSYGCTGLQLGIMGPSLAIAPVYIAGNEEQKKKYLGALAAEPIIASYCVTEPGAGSDVNGVKTKCEKKGNEYIINGSKAWITGGGHAKWFFVLARSDSDPKTPAGKAFTAFIVDGDTPGISRGKKEKNMGQRCSDTRTITFEDVRVPAENVLGAPGAGFKVAMGAFDMTRPGVAAGALGLSWRCLDESAKYALQRKAFGTEIANHQAVQFMLADMAVNLELARLITYKSATDVDNKVRSSYNASIAKCFAADTANQAATNAVQIFGGNGFNSEYPVEKLMRDAKIYQIYEGTSQIQRIVISRMLLGHFAQNGTSRI

SEQ ID NO: 1166 - protein, 455 aa, Caenorhabditis remanei
MIADGRHTHNPSCCVFLPPIYFLPVVTLIDPVFDCTKNAYFQKMLSRNLSKCTRMFSTTNKAMSTGIDFNLTADQTEFRANVRKFVADEVIPVAAEYDRTMEYPWPIIKKAHAQGYLIADIPEAYGGLGVDMVSNCIISEEMAYGCSGIATAIMANDLALTPLILCANDDIKKRFLGRMVENPFVASYAVTEPGAGSDVAGIKTKCEKKGDEYILNGSKMWITNAGHANWFFVLARSDPNPKTPAGKAFTAFVVEGDSPGLTRGRKEINMGQRCSDTRGVTFEDVRVPAANVVGAPGEGFKVAMKTFDKTRPTVAALATGVTYRCLDVATQYSLERKAFGTQIANHQGVSFLLAEMAINAELARLMTYKSGAEVDAGRPGSYYASIAKLFASDAVNQAATNAVQVFGGAGFNTEYPAEKLMRDAKIFQIYEGTSQIQRMVIARQLLARVAQNGGY

SEQ ID NO: 1167 - protein, 629 aa, Caenorhabditis remanei; identical to SEQ ID NO: 1157

SEQ ID NO: 1168 - protein, 411 aa, Caenorhabditis remanei; identical to SEQ ID NO: 1162

SEQ ID NO: 1169 - protein, 425 aa, Caenorhabditis remanei; identical to SEQ ID NO: 1163

SEQ ID NO: 1170 - protein, 411 aa, Caenorhabditis remanei; identical to SEQ ID NO: 1164

SEQ ID NO: 1171 - protein, 417 aa, Caenorhabditis remanei; identical to SEQ ID NO: 1165

SEQ ID NO: 1172 - protein, 455 aa, Caenorhabditis remanei; identical to SEQ ID NO: 1166

SEQ ID NO: 1173 - protein, 600 aa, Weeksella virosa
MSTQPNRLIGGEYLVKNATYNDIFTYEDFSEEQRMIIESAKEFIDKEVVPKKHQIEKKDYALIEELMRKIGELGLLGISIPEEYGGLGMGFVTTMLVCDYISGATGSLATAFGAHTGIGTMPILLYGTEEQKQKYLPKLATGEWFSSYCLTEPEAGSDANSGKTKAVLSEDGKEYIITGQKMWITNAGFADIFIVFARIDDDKNITAFIVEKDKAGEGFSLGEEEDKLGIVSSSTRQVFFNEVRVPVENLLGERNGGFKIAMNALNVGRIKLGAACLDAQRRVLNNSLQYASERKQFNVSINTFGAIQEKLADMAVATFTSEAGAYRAAKDIQDAIEDNIAKGMPHNEAELKGIEEYAIEASILKVWISEAAQKASDEGIQIYGGMGYSKEMPMEAAWRDARISRIYEGTNEINSLLCISMLVKRAFQGRIDLMTPAMDVANELMSIPSFDIPDYTELFAQEKEIIINLKKAFFMVAGAALQKFGADLEKHQQLILAASRIMQEIYMVESAMLRAEKIAAVKGNDVAANAVKLVQLQLFKSVEIIKTEATRGIVSFAEGDEQRMMLSGLRRFTRYNEYPNVVNLKNDIAQLIIEKNEYVY

SEQ ID NO: 1174 - protein, 602 aa, Cellulophaga lytica
MADTEKDILRGGQFLVKETNCEDVFTPEDFSEEQTMMKEAVAEFNEREIIAHKARFEAKDYALTEEVMRKAGELGFLGVAVPEAYNGLGMGFVSTVLTCDYISSGTGSFSTAFGAHTGIGTMPITLYGTEEQKQKYVPKLATGEWFGAYCLTEPGAGSDANSGKTTAVLSEDGKSYKINGQKMWISNAGFCSLMIVFARIEDDKNITGFIVEYDPENANGITLGEEEHKLGIRASSTRQVFFNDTVVPAENMLAGRGEGFKIAMNALNVGRIKLAAACLDSQRRIVTTGVQYANERKQFKTPISDFGAIKVKIAEMATNAYAGESATYRASKNIEDRIAMREAAGNTHQEAELKGVEEYAIECSILKVAVSEDVQNCADEGIQIFGGMGFSEETPMEAAWRDARIARIYEGTNEINRMLSVGMLVKKAMKGHVDLLGPASEVQKELMGIPSFETPDYSELFSEEKEMIKKLKKTFLMVAGGAVQKYGPQLEDHQQLLIAAADILIEIYMAESTILRTEKNAKRFGEESQKTQIAMSKLYLYNAVDIIEKKGKESIISFAEGDEQRMMLMGLKRFTKYQNYPDIVDLRNEIAEKVKAENKYCF

SEQ ID NO: 1175 - protein, 603 aa, Muricauda ruestringensis
MSTETTNKDILRGGQFLVKETKCEDVFTLEDLNEEQKMMRESTKEFVDRELWAHWERFEKKDYAYTEECMKKAGDLGLLSVAVPEAYGGMGMGFVSTMLVCDYISGATGSFSTAFGAHTGIGTLPITLYGTEEQKQKYVPRLATGEWFGAYCLTEPGAGSDANSGKTKAVLSDDGKYYSITGQKMWISNAGFCNLFIVFARIEDDKNITGFIVENDPENGISLGDEEKKLGIHSSSTRQVFFSETKVPVENMLSERGNGFKIAMNALNVGRIKLAAACLEAQRRVINEATKYANERIQFKTPIINFGAIKAKIADMATNAYVDEAACYRAAKNIEDRIAIREASGNSHQEAELKGVEEYAIECSILKVAVSEHVQHTTDEGIQIFGGMGFSADTPMESAWRDARISRIYEGTNEINRMLSVGMLVKKAMKGHVDLLGPATAVGEELMGIPSFETPDYSELLSEEKDLLGRLKKVFLMVAGSAVQKFGPDLEKHQMLLMAASDILIQVYMAESAILRTEKNAKRFGEEAQATQIAMTKLYLYRAVDIIQQKAKEGIVSFAEGDEQRMMLMGIKRFTKYTNQPNVVKLRTQIADKVAADNGYTFD

SEQ ID NO: 1176 - protein, 598 aa, Haliscomenobacter hydrossis
MEAVLSKTALQGGEFLIKDSRAEDIFIPEELNEEQMMIREMVRDFLHNEILPNSEKIEHQEDNISPRLLEKMAALGLLGTHMPEVYGGMQLDTNTNTLIGDALGPAGAFTVSYAAHIGIGMLPILYFGTEEQKDKYLPRLINGELKAAYCLTEPGSGSDALAAKTRADLSADGKNYLFNGQKMWISNAGFADLFIVFAKIDGDKFTGFIVERDSAGLTLGAEEKKLGIKGSSTRQVFFENTPVPVENVLGKIGKGHLIAFNALNTGRFKLCALSLGGAKYSVTTAIRYANERIQFGVPISSFGAIQYKLAEQAIRIFSTESALFRVSNLMELKKQEFEANGASFGEAELKAAEEYAIECSILKVTGSEALDYVVDETLQVHGGMGFSEEGTAARAYRDARINRIYEGTNEINRLLSIDMLLKRAMKGALDIVGPAWQVQKELASMPSFEKEEGLYAEEKKAVKDFKKAVLMVAGAAAKLQMEGKLDLKNEQEIIMNVADMLSDLFLAESTLLRVEKLAGMQGKVKQEVYDAILKVFIHDATLRMNKNGTDALASFAEGDLLRTMLMGLKRFTKYPAQNVKTLRRELADVLIAANEYAL

SEQ ID NO: 1177 - protein, 407 aa, Haliscomenobacter hydrossis
MSLENGANTPPIQKRSREDRFQGHDYYNIDDLLSEDHLLAREAVRTWVKQEVTPIIEEYSDRAQCPTHLFKGLAEIGAFGPSLPEEYGGGGMDEIAYGIIMQELERGDSGIRSMASVQGSLVMYPIYRFGSEEQRRKYLPKLGNGDFIGCFGLTEPDHGSNPNGMVTNIKDDGDAYILNGAKMWITNSPLADVAVVWAKDESGIVRGVIVERGMPGFSAPEIHGKLSLRASITGELVFEDVRVPKSNLLPNVQGMKGPLSCLSKARYGIAWGAIGAAMDCYDSALRYAKERNQFGRPIAQFQLTQKKLAEMITEITKAQLLAWRLGTLANQGKATPGQISMAKRNNVNMALEIAREARQIHGGMGITNEYPVMRHMMNLETVLTYEGTHDIHLLITGMDVTGLNAFQ

SEQ ID NO: 1178 - protein, 592 aa, Fluviicola taffensis
MSQAIKGGEFIIRDVTPNEIFTPEEWTEEQNMIAQTCDDFIEQEITPLLDRIDKMEEGLMPSLIEKAGELGMLGLSVPEDLGGMGVDFKTSLLATERLGKGHSFSVAYGAHTGIGTLPLLYYGNAEQKAKYIPKLASGEWKAAYCLTEPSAGSDANSGKTKAALSPDGKHYIINGQKMWITNGGFANFFTVFAKIDDDKNLSAFLVEADSEGISLNPEEKKMGIKGSSTRQVFFNNVKVPVENMLSERENGFKIALNILNIGRIKLAAGVLGGAKQTITDSVRYANEREQFGRMISKYGAIRYKIAEQAIRTYVAESAIYRAGQNIDDAIQAFVAGGMEKGQATLKGIEQFAPECAILKVAGSECLDYVADEGVQIFGGMGYSAESSVERGYRDSRINRIFEGTNEINRLLIVDMVLRRAMKGELDLMGPAMKVASELMSIPEMTELGSSPLAVQRQALAGFKKTILMVAGSAVQKLMQTMSKEQEILMNIADLAIWVYQAESVLLRVEKLIETKGEAAAAVQIAIVKTYFYDTAERIDKAAKDAIYSFADGDEARMMTTGVKRFTKIDPINPKNERQTIAEFVIEKNAYTL

SEQ ID NO: 1179 - protein, 569 aa, Bacteroides salanitronis
MPNYYTEHPELRFHLNNPMMERICQLKERDYRDKDQYDYAPQDYADAMDSYDKVLEITGEITGEVIAANAEGVDLEGPHHANGRVEYASGTKQNLDAMVKAGLNGMTMPRRFGGLNFPITPYTMCAEIVAQADAGFGNIWSLQDCIETLYEFGNEDQHSRFIPRICAGETMSMDLTEPDAGSDLQSVMLKATYDEANQCWRLNGVKRFITNGDANLHLVLARSEEGTHDGRGLSMFIYDKNDGGVDVRRIENKLGIHGSPTCELVYKNAKAELCGDRKLGLIKYVMALMNGARLGIAAQSVGLSQAAYDEGLAYAKDRKQFGKAIIEFPAVYDMLATMKAKLDAGRALLYQTSRYVDIYKALDDIARERKLTPEERQEQKRYAKLADSFTPLAKGMNSEYANQNAYDCIQIHGGSGFMMEYACQRIYRDARITSIYEGTTQLQTVAAIRYVTNGSYAATLHEYEAIPCAPEYQGYMDRLKAMTGKLEACTTKVKEAQNQELLDFTSRRLYEMAALCVMSHLLLQDANKAPELFAKSLDVYVNYAEAEVEKHYSFIQNFQAEELENYRKA

SEQ ID NO: 1180 - protein, 647 aa, Caenorhabditis remanei
MPLNKYIQDGDNQDLTDERFKATFDTDALGAVFHGGEDALKRVREIRDELTKRGHLFDALPAAHRTRAERMEDVSRKLKNLMENVSEFADFSNNLDMLAIIRDVMGIEGFPLALHNLMFVPTIQNQADDEQTLATLSEINRITGTNLSAIETTATYDKSTEEFIIHTPTTTATKWWPGGLGTSCTHVILVANLIIDSKNYGLHPFFVPIRDRNSYSQMSGVRVGDIGTKMGVNCVDNGFLAFDNYRIPRRNMLMKHSKVSKEGVYTAPSHPKVGYTTMLYMRSEMLTHQSYYLAMAMAISIRYSAVRRQGEIKPGTQEVQILDYQTQQYRLFPGLARCFAFVTAAATVRQMTESCIKELSHGNSDVLADLHALSCGLKAVVTHQSSQSIDQARQACGGHGYSDASYLPTLYTCSVGACTYEGENMVMLLQLSKYLMKAAAKAEAGAEMAPLVAYLAVSDPIENGDKFGKLLNHFEHIARHRVMHAYHQMIEEEKHGIERDYAFANHSVDWTKAARAHTKLFMARGFVKKVQEIQNEAVHDVLNTLAELYLSYELIEMSSDLTANGYLSETEVQTIRHQIYDCMRKIRPNAVSIVDSFDICDRELRSVLGRRDGHVYENLYKWAQMSPLNQKNLPHVEKYLKPMTSKL

SEQ ID NO: 1181 - protein, 599 aa, Cellulophaga algicola
MAEKEILRGGQFLVKETNCEDIFTLEDLSEEQKMMRDSTKEFVDRELWAHWERFEKKDYAYTEETMRKAGELGLLSVAVPESYGGMGMGFVSTMLVCDYISGATGSFSTAFGAHTGIGTMPITLYGTEEQKQKYVPKLASGEWFGAYCLTEPGAGSDANSGKTKAVLSEDGKHYSISGQKMWISNAGFCSVFIVFARIGDDKNITGFIVENDPSNGISLGDEEKKLGIHSSSTRQVFFNETKVPVENMLSDRGNGFKIAMNALNVGRIKLAAACLDAQRRVIGEATKYANERIQFKTPIINFGAIKAKIANMVTNVYADESAAYRAAKNIEDRIAMREAAGNSHQEAELKGVEEYAIECSILKVAVSEDCQSTTDEGIQIFGGMGFSADTPMESAWRDSRIARIYEGTNEINRMLAVGMLVKKAMKGHVDLLGPATKVGEELMGIPSFDTPDFSELFAEEKDLVAKLKKVFLMVAGSAVQKYGAELENHQQLMMSASDILIEVYMAESTILRTEKNVKRFGEAEQATQIAMSKLYLYTAVDTVIQRGKEAIVSFAEGDEQRMMLMGLKRFTKYTNNPNVVALRTQIADKVAADNGYTFD

SEQ ID NO: 1182 - protein, 596 aa, Niastella koreensis
MSTTTQQNMLKGGEWLIKESSPFDTFIPEDFSEEQQMVKDMCASFLDAEVLPILDRIDKLEPGLMPSLVTKAGEQGLLGASIPEQYGGLGKDFITSNLVGEGLGGGFSFSVAVSAHMGIGTLPILYFGTDKQKEKYIPKLATGEWKGAYGLTEPNSGSDALGAKTTATLSADGKHYLLNGQKCWITNGGFADVYTVFAKIDGDKFSAFIVERGFEGFTQGAEEHKMGIKGSSTVQLYFQDCKVPVENLLGEIGKGHIIAFNILNIGRLKLCAAALGGAKRATTTSIQYANTREQFKTPIASFGAIKNKLAEMAIAMWVAESALYRTAKWIDDKEHELLAAGKSFSEAVLGGAEEYAIECAILKVFGSETLDLVVDEGVQIHGGNGYSDEYVISKAYRDSRINRIYEGTNEINRLLTVDMVLKRAMKGRLDLMTGAMNVQKELMSIPDFGSGDEEAFAKEKKLIANFKKAILLTAGAAVQKLMMKIEQEQEILMHIADMAIATFAAESALLRAMKLADRKGEAAAAFELDITRTYLYDAADLIHKHGKDAINAFADGDEQRMMLLGIKRFTKTEPFNSKEAKRRIAAKLIADNRYPL

SEQ ID NO: 1183 - protein, 597 aa, Niabella soli
MDAAINAETITRGAEWLIKEQTPAQTFIANEFDEEQLMIRDLCNQFLAADVWPILDRIDSMEPGLMKSLVQKAGGQGLLATSFPEVYGGLGKDFVTSTIINEYLGAGHSFSVAIAAHTGIGTLPILYFGTDAQKEKYIPKLITGEWAGAYGLTEPNSGSDALSAKTTAKLSADGKYYLLNGQKCWITNGGFADVYTVFAKVDGDKFTGFIVERGTEGFTQGPEEQKMGIKGSSTVQLYFQDAKVPVENVLGETGKGHKIAFNILNIGRLKLCAAALGGARKAFDTSLEYAKTREQFKQPISNFGAIKHKLAEMAIGMFAAESALYRTAKWIDQLEQKLLTEGKPFNEAVLGAAEEYAIECAMLKIFGSELLDFVVDEGVQIHGGNGFSAEYNISRAYRDSRINRIYEGTNEINRLLILDMTLKRAMQGRLNLMGPAMEVQKELMSIPDFGGEDETPFAEEKKLIANLKKAILMVAGAAAQKLMMKIESEQEILMNISDMAIEIFHAESMLLRTMKIAAAKGDTAAADYAAMTRVFLYDAADKINKAGKDAINGFAEGDEQRMILMGLKRFTKAQPFNSKDARRSIADKLIAAGHYCF

SEQ ID NO: 1184 - protein, 597 aa, Niabella soli; identical to SEQ ID NO: 1183

SEQ ID NO: 1185 - protein, 603 aa, Muricauda ruestringensis; identical to SEQ ID NO: 1175

SEQ ID NO: 1186 - protein, 598 aa, Haliscomenobacter hydrossis; identical to SEQ ID NO: 1176

SEQ ID NO: 1187 - protein, 407 aa, Haliscomenobacter hydrossis; identical to SEQ ID NO: 1177

SEQ ID NO: 1188 - protein, 584 aa, Marinithermus hydrothermalis; identical to SEQ ID NO: 1103

SEQ ID NO: 1189 - protein, 592 aa, Fluviicola taffensis; identical to SEQ ID NO: 1178

SEQ ID NO: 1190 - protein, 602 aa, Cellulophaga lytica; identical to SEQ ID NO: 1174

SEQ ID NO: 1191 - protein, 569 aa, Bacteroides salanitronis; identical to SEQ ID NO: 1179

SEQ ID NO: 1192 - protein, 430 aa, Deinococcus proteolyticus; identical to SEQ ID NO: 1104

SEQ ID NO: 1193 - protein, 411 aa, Deinococcus proteolyticus; identical to SEQ ID NO: 1102

SEQ ID NO: 1194 - protein, 600 aa, Weeksella virosa; identical to SEQ ID NO: 1173

SEQ ID NO: 1195 - protein, 599 aa, Cellulophaga algicola; identical to SEQ ID NO: 1181

SEQ ID NO: 1196 - protein, 596 aa, Niastella koreensis; identical to SEQ ID NO: 1182

SEQ ID NO: 1197 - protein, 690 aa, Caenorhabditis remanei
MSAPLIDKYRKMATFDWRKLKAAVEGEEHVRLKAEVVAKMKSEPVFQRDFRVLSREEHREVVHQRWKKIVEWGLFKDPYSDLENFHALTETLEAYDQGTSARLFLHGNVFGAAVKSMGTERHKELVQQIENNEIVGAFCLTEIGHGSNTAEIQTTATFDNGQLVFNTPDVGAIKCWAGNVCKSFLRRFRYTFCLISAHSATHVVVYAQLHVGGKNEGFHGFVIQVRCPKTFQTLPGITIGDMGSKPGCWQGVENGWIEFKNHRAPLSALLNKGCDITPDGKYVTSFKSASEKQSVSLGTLSVGRKQIIIFRLGIIAKGMMACTFASTIAIRYSVARRQFGPEKGAENEIPVLEYPLQQYRLFPYLSAAICIRIFQKTFVEKFTEYMMRVMMGEKSEELSEFSKEVHALSSGAKPVATWLGVESLGEARKACGGHGFLHMSRLNTLRDDNDPSQTFEGENFMILQQTSNILLGKVSSIGTINTPMSTMSFLNSNPSKFSSWSSNPVDDVLSAYRYLTYHLLQTTSSEAKKLKGAGKNSFEVRNEIQVHRAVNLSVAYTEHTMIDWVQQFVEEVEDVTVKRVLQKVLNLFSLFLLERHLATLYITGYASGGKFGEDLREKLRHAVAELKPESMALVDSIAPDDFILHSALGASDGRAYDHIMEEFRKYTNEQPKWVCDLAQFLQKRSQTSKL

SEQ ID NO: 1198 - protein, 409 aa, Caenorhabditis remanei
MLLRNILSKGFSLRNSSSYCMRPSVGLERDVEDVLEAAHQFAKKEMYPKMAEWDKQGELPMDVLKKAGEMGFGAIYCSGDHGGSGLSRLHASVIFEQLSMGCVSTAAYISIHNMCAWMLDTYGPDKLKEDLLPDMALFNKLGSYCLTEPDAGSDAASIRTTATKKGDYYVVNGSKAFISGAGTSDNYFVMMRQDGAAPGAKGIFCLMIENGTEGFSFGKKEDKLGWNSQPTRILTFEDCKVPITNQIGKDGFGFNIAMAGLNGGRVNIASCSLGAAQRSLDLAIEHLKCRKQFGKTLSDFQYNQFKLAELATKLYTSRLIVRNAAEQLDNDLPEKVALCAMAKLHATDNCFDVVNGALQMFGGYGFLKDYPIQQYLRDIRVHQILEGTNEMMRLLISRDLLTKDIFWSS

SEQ ID NO: 1199 - protein, 593 aa, Caenorhabditis remanei
MPIYNAPLADMKFILNDVFNAEQFWQANEKLAHVDAATAEAILEEMAKFAQNVTLPLNRTGDEEGAHYENGKVTTPAGFKEAFQQYAEGGWIGLGAEEEWGGQAMPKMLTVLADEMLFATNPSFMLYPLLSVGAGMALNSYASQEQKETYLPKIYSGEWSGTMCLTEPHAGTDLGIIKTKAEPNQDGTYNITGTKIFITGGDHDLADNIIHLVLAKTPDAPAGSRGISLFIVPKFLVNADGSLGERNTAGPGSIEHKMGIKASATCVMNFDAAKGFLVGKENEGLAAMFVMMNYERLSMGIQGLGASEYAYQNAAQYATDRVQGRSATGVKSPNKPADSILVHGDVRRMLLNARANNEASRAFAVYVGQQLDITKFSTDPEAVAKANNRVALLTPIAKAYLTDTAFNAAIDAQMVFGGHGYIREWGMEQCVRDLRIAQIYEGTNGVQSQDLIGRKTIKCNGEFIAEYIEEIRDFANGLDTDLNFIKDATLDIATEVDMITQHILERAKENADFANAAAVEYLHVVGLLSFSYMFARIANAAKNKQGQFYQDKLALTHYFIQRLLPDLNARVAKIKAGAEVIMNFSEDYFTNQA

SEQ ID NO: 1200 - protein, 412 aa, Caenorhabditis remanei
MLTRGFGNVASIGKIATRGLSSSFYQDAFQLSDQLTDDERSLMLSAREYCQERLLPRVTEAYRNEKFDKSLIPEMGSMGLLGAPYQGYGCAGTSTVGYGLIAREVERVDSGYRSTMSVQTSLVIGPIYNYGTEEQKEKYIPDLASGKKIGCFGLTEPNHGSNPGGMETKATWDETTKTYKLSGSKTWISNSPVADVMVVWARSSRHGNKIKGFILERGMKGLTTPKIEGKLSLRASITGQIAMDDVPVPEENLLPNVEGLAGPFGCLNNARLGIAWGALGAAEECFHLARQYTLDRHQFGRPLAQNQLMQLKMADMLTEISLGLQGCLRVSRLKDEGKVQPEQISIIKRNSCGKSLEIARKARDMLGGNGIVDEYHIMRHMVNLETVNTYEGTHDVHALILGRAITGLNGFF

SEQ ID NO: 1201 - protein, 412 aa, Caenorhabditis remanei; identical to SEQ ID NO: 1200

SEQ ID NO: 1202 - protein, 647 aa, Caenorhabditis remanei; identical to SEQ ID NO: 1180

SEQ ID NO: 1203 - protein, 409 aa, Caenorhabditis remanei; identical to SEQ ID NO: 1198

SEQ ID NO: 1204 - protein, 690 aa, Caenorhabditis remanei; identical to SEQ ID NO: 1197

SEQ ID NO: 1205 - protein, 593 aa, Caenorhabditis remanei; identical to SEQ ID NO: 1199

SEQ ID NO: 1206 - protein, 421 aa, Rattus norvegicus
MAAALRRGYKVLRSVSHFECRAQHTKPSLKQEPGLGFSFELTEQQKEFQTIARKFAREEIIPVAPDYDKSGEYPFPLIKRAWELGLINTHIPESCGGLGLGTFDACLITEELAYGCTGVQTAIEANSLGQMPVIIAGNDQQKKKYLGRMTEQLMMCAYCVTEPSAGSDVAGIKTKAEKKGDEYVINGQKMWITNGGKANWYFVLTRSNPDPKVPASKAFTGFIVEADTPGIHIGKKELNMGQRCSDTRGITFEDVRVPKENVLIGEGAGFKIAMGAFDRTRPTVAAGAVGLAQRALDEATKYALDRKTFGKLLVEHQGVSFLLAEMAMKVELARLSYQRAAWEVDSGRRNTYFASIAKAFAGDIANQLATDAVQIFGGYGFNTEYPVEKLMRDAKIYQIYEGTAQIQRLIIAREHIEKYKN

SEQ ID NO: 1207 - protein, 452 aa, Weeksella virosa
MANFISKLKGLYQLASTIDIEQVNIISQQVDLPKMLKALSNLDKNKMKALEKMIDPTRKKKELPPIDGDFYDVYHELPPELRVIQQKVREVMETKIQPLVNDYWLRDEFPFEIIPIFQELNICGVTYEGYGCPNLPFLMEGVIAHEMARIDASIATFFGVQSGLVMGSIYLCGSDEQKNKWLPELQQLKKIGAFGLTEPEVDSGAAGGLTTTCEKTENGWLLNGEKKWIGNAPFADVFIIWARDIADDQVKGFLVEKDNPGISVEKIKGKMALRIVQNGQITLNNCLVPDTDKLEKANTFKDTANVLRMTRAGVAWMATGCARGAYENALDYTRKREQFGKPIASFQLIQGHLVEMLSNLTAMQTMVYRLSKIQDEGKLKDEHASLAKVFCTLRTRDIVAHAREVMGGNGILLDHNVARFVADAEAIYSYEGTKEINSLIVGRSITGFSAFA

SEQ ID NO: 1208 - protein, 534 aa, Marinithermus hydrothermalis
MKDVSYAYGTNHYRLDPDLRNVLRHYWREAPQHEAELERWGAYMGREAYEVAYHVDQDAPPVLVMHDLYGNRVDRARLSPAQRTVLEELRPITRPPYEGGSWHHHYALGYLLADPGLYCILTITHQVAYAIHKYAPQYEDWKHRLLYGEAYGATWMTEIQGGSDLGANRTLARKEDGAWRLFGGDKYFASGAGLADVALVTARPEGAPPGPKGLALFLVPRLNRKGTLNYRVRRLKHKSGTRAVPSGEVELEGSEAYPIGRLEEGIYYTLETLTVSRLANAVAAMGIAQKAQLEARFRVRARHAFGKRLLEQPLVRYDLTDLAVRQAGGLALAFHAVAAFDAAWRDRPPYTPAYHYARFLSHLAKNRTADHAAAITQRAMELFGGLGFLEEYAVARWHREALITPIWEGPSNIQALDMLEAMQKKHAHRPFLEEVTATLGAQPDPEAQATLKVLEATLSRLNGARPEAAAWLAKAALERLADAATVAALYALAGSAGERYAVLARLYATRFLLGEPYPEWALAAPEVLALEEDA

SEQ ID NO: 1209 - protein, 602 aa, Cyclobacterium marinum
MEKINEKNALNGGEFLIKETQASAVFIPEEFSEEQKMMAQACQDFLDMEITPKMEEIDSMKNPELVPSILKKAGDLGLLGISIPEEYGGLGMSFNTSMLIADIIGAAGSFSTTYGAHSGIGTLPVLYYGTEEQKKKYLPKLANADWAACYCLTEPDAGSDANSGKTKASLNEEGTHYLINGQKMWISNAGFADFFIVFAKIDDDKNLSAFLVEKTFGGITMNEEEKKMGIKGSSTRQVFFNDCPVPVENLLSERGNGFKIAVNILNIGRIKLGAGVLGGCRTILGYSIQYSAERKQFGQAINSFGAIQAKLAEMAVKTYACESLCYRAGQDIEDRIDALIKEGMEPNKAKLKGVEQFAIECAIAKVHGSEVLDYVTDQGVQIYGGMGYSADAPMERAFRDARISRIYEGTNEINRILMVGMLLKRAMKGEIDILGPAMEVSKELTSVPSFGSTDSSQPLSIEKETLKKLKKVFLMIGGKAAQDLGSKMEEEQEIMMNLADIMIEIYAAESTLLRTENLLFKEGEEAVKFQLAATKIYLYEAVEKIQSAGKEAIMSFTKGDEQKMLLMGLKRFTKYDNVNTKFLRREIASALISKGKYFFFHA

SEQ ID NO: 1210 - protein, 422 aa, Caenorhabditis brenneri
MSSLSRSLLIGRSTAPLLTAASPMSTKPRAHIDGHVPTPLQQLSEQEVSIVDTVRRFAVNVIKPLVREMDDKSQMHQSVITGTFENGLMGIEIPEKYGGPGSSFFDAVLVIEELAKIDPSVSVFVDVQNTLVAPLIIQLGTEEQKKKYLPKIVTEAIGSFALSETGSGSDAFALKTTAKKDGDDFVISGSKMWITNAGHAQFFLVFANADPAKGYKGITCFLVDRNQEGVSVGKKEDKLGIRASSTCSVHFDNVRVHKSSILGEYGKGYKYAIECLNAGRIGIGAQMLGLAQGCFDQTIPYLQQREQFGQRLIDFQGMQHQIGQVRMEIEAARLLVYNAARMKENGLPFVREAAMAKLFASQVATTTTSKCVEWLGGVGFTKEFPVEKFYRDSKIGTIYEGTSNIQLNTIAKLVDIEYQQKA

SEQ ID NO: 1211 - protein, 433 aa, Caenorhabditis brenneri
MSSKLMQQVARLPRKSYSTATAFATSRQDVTVPPPPVNLLSENETFFVETVRKFSQSVVKPLVREMDKNSKMNPIVTQGAFENGLMGLHVPEEYGGSGSSFFDAMIVIEELAKTDPSVSAMVGIHNTLPVSMIADHGSEEQKQRYLPRLCSDTLASFCISESGAGSDAFALKTVARRDEDHFLISGSKMWITNSGDAQVFVVFANADPSQKYKGITCFIVERSADGLTVDREEDKLGIRASSTCQVHFDNVRVHESAILGEYGKGYKYAIECLNAGRIAIGAQMIGLAQGCFDQTIPYLQQREQFGQRLIDFQGLQHQIAQARTEIEAARLLVYNAARMKENGIPYVREAAMAKLFASQVRKSCFSVFKLSSQVATSTSAQCIKWLGGVGFTKEFPAEKFYRDAMIGEIYEGTSNIQLNTIAKLIDNEYKLKN

SEQ ID NO: 1212 - protein, 985 aa, Caenorhabditis elegans
MTIKAVIFDMGGVILPAPMHYWKSIEKTHNLRDGSVVETIISKDFYPHFKLFETGRLTSEDLDPLFTHIYNFQNNRVGDILPIFVEVSSQIQHTPLLPEMVELIKSLRLAGYRTILITNNFYTDRARLLPTVPSQVGLLFDDVLESCRLGLRKPDTKIYELALERSKLHPSDCVFLDDLGSNLKSAKEMGITTIKVVSSQQAIHDLGNILKLNFSYPPETRDCIPREVLPIEKINELITRRTGTDNKVETIRKFRHGQSNPTYYIRTVRGSQYVLRKKPSGSLLPKAHQVDREFKIMNALQGLVPLPKTLLYDETTLDTSFYLMEYQKGRIFLKPSLPELTPPERRRVYEEALKTLATIHSVDYEKVGLQDFGRTDGYMARNLKRWSDSYQMAKTEEIQEMIKLEAYLKANLPKSGKSTIVHGDFRVDNLIIEENEIKVKGVLDWELSTIGDPLSDLATFLFVYYVPNRMILLPGLGDYSESDLHRMGIPTIKECLELYAKYTNTEVVDPELWTYYMAFVIFRFASIIQGVYKRSQLKNASSTEASQLGPLVRKLAAEGMQMISKVHASKSYGQLTIIPSGMSLKAQKYYEIVREIIQNDVIPLEQELLEYYEEGPHRWTIPHPKIEKLKEKSKSLGAWNLFISEHIDPEQKYGKGLTNVEYAHICELMGRSIFAPEVFNCQAPDTGNMEVLIKYGSEEQKSKWLTPLLNGEIKSCFAMTEPDVASSDATNIQGSIVRVGNEYIINARKWFISNASHPKCRIAIFMGQVSGAKRSRNLQQSMILVPMQTEGVKIIRNTHVFGSQDAPGGHPEITFTNVRVPVGNMLLGEGKGFEIAQGRLGPGRIHHAMRLIGHAERAIDVIKDRLLTRIAFGRKLVQFDSLRKELALSRCEVEQARLLVLKAAHMIDTVGPKEAKSEIAMIKVVAPNMAISILDRAMQQQGARGLTPFTPLASFYVWARSLRIADGPDAVHLETIAKIEMKSRL

SEQ ID NO: 1213 - protein, 596 aa, Mucilaginibacter paludis
METTEKTTIKGGEFIIRETEAGDIFIPEEFDEESQMIKKTCEDFLATEVLPNLERIDAQEEGLMPTLMDKAGELGLLSVSIPEEYGGFGKNFNTSMLVADAIGAGYSFAVALSAHTGIGTLPILYYGNEEQKAKYIPKLASGEWKAAYCLTEPNSGSDANSGRTKAKLNAEGTHYLITGQKMWITNGGFADVFVVFAKIDDDANLSAFIVEKAFGGISMNPEEHKLGIKGSSTRQVFFNDCPVPVENLLSERQNGFKIAVNILNIGRIKLGAAAIGSSRMALNYAVKYSNERVQFKLPISKFGAIRYKIAEMATRIYAVESAAYRAGQNIDDAYEALHASGMDLAKAKLKSTEQFAVECAILKVWGSEMLDYVVDEGLQVYGGMGYSAEAPMERAYRDSRINRIFEGTNEINRMLIVDMLLKRALKGELDLMTPAQAVAGELMAIPDFAAEDDATFAYEKKILKNLKKTGLMIAGSAVQKLMATLGKEQEILMNIADIIGYVYVAESTILRTEKLVKLRGEDACKGQLDMMRIYLHEAVDHVYIAGKEALNSFADGDEYTAMMMGLRRFTKTTPFNIKDARQRVAKQIIEANKYCY

SEQ ID NO: 1214 - protein, 597 aa, Myroides odoratus
MNTAITRGGQYLIKETKSENIFTPEDFSEEQLMMRDSVKEFIDKEVWPHKNRFENKDYAFTKECMQKAGELGLLGVAVPEAYGGLEMGFVSTMLVCDYISGATGSFSTAFGAHTGIGTMPITLYGNEEQKKKYVPKLASGEWFGAYCLTEPDAGSDANSGKTKAVLSDDGKYYNITGQKMWISNAGFCNVFIVFARIEDDKNITGFIVENDPSNGISLGEEEHKLGIRASSTRQVFFTNTKVPVENMLSERGNGFKIAMNALNVGRIKLAAACLDSQRRLITEAIKYANERIQFKVPISSFGAIRTKIAEMVTNAYVGESASYRAAGSIEKRINQRIEEGNSHQEAELKGVEEFAIECSILKVAVSEDVQSCTDEGIQIFGGMGFSEDTPMESAWRDARISRIYEGTNEINRMLAVGMLIKKAMKGHVDLLTPAMQVADELMSIPSFDTPDYSELFTEEKEMIEKLKKAFLMVAGSAVQKFGPDLEKHQALMMAAADMMIEIYMAESAILRTEKLAKSKGEQNIKEEIAMAQLYLYHAVDIVAQKGKEGIASFAEGDEQRIMLMGLRRFTKYVNLPNVNALRESIAKKAIEANEYVF

SEQ ID NO: 1215 - protein, 596 aa, Mucilaginibacter paludis; identical to SEQ ID NO: 1213

SEQ ID NO: 1216 - protein, 592 aa, Leptonema illini
MRLHRCPMIQGNYFADNGDLQLHFDTLVDWDEVVSLYENGFTDAAAFDAAEPGGMQAERLSMAPHSVSEAVEYYRQILEGFGEFWGNEAAPLAQSMDQLGLKFESGKVTHPQPFVDVVKKFHETGLHPIAFLRRFGGLGVPHVLKAMAFELAYRADTSMTIAAASVNLAGILEMYASEELCEEWIPKLIEGGYVVTMGLSEPDFGSDLPSVRTKAEFVDGRWLLTGTKRFQTVASGINEIPSVLLALARTGDAGARGLSFFLVEGKDVQISGIEKKLGLKASATCEVVLEQSPGILIGEKGYGLSRYVIGMLNGARLSVASQGTGIAMAAFKEAQKYASERIQFGRPIAELPAVARMLRRMDVEIKAMRCLMVEAALSVDRYHWAELRTRFATKPGDREQKGGPGETDTRKWEKIASILTPISKYYISESCNAVVYEGLQVLGGAGYTEEYDLARLYRDARITNIYDGTTQIQVNAAIGGVVAGVSAKGHLREYIDEQFTALSSENERLTAMRQTFEDIVALYKDLPDADTKGRYAFEVVQSAARLLCSLFLEKTAGKLTGEAREERLQIAGEYQTDSEAILAGNRIKLERA

SEQ ID NO: 1217 - protein, 591 aa, Leptonema illini
MIQNNYFSDNEDLTLQFEKIMSWNDIIDTYENGFEDAKSYQKDGNERLAMAPSNHQEAVDFYRTILESTGEIAGKEIAPKAQVMDHTGLKFNSGKVTFPDEMVACMKSVKEAGIMPYSITRHYGGLGLPVTAQVMMMETISRADAAFAIAMGCVNLGETIESFASDEMIEEWVPQMAAGDLWGAMALTEPNYGSDLQNVRTKAEKGADGTWRITGTKRFITHGCGFGDTPAVILTLARTGGPESGGRGLSFFLVKGQDVEIAGIEKKMGLHISPTCEVVYDNSPALLIGEEGKGLVKYAMGMMNGARLSIAAQSMGIASAAFYEAKKYASERVQFGKTIDKIPAVAKMLEGMEREIIAMRCLLLEAATSVDMYHWRKHRLAHEGMADRDVRRDELVKKWEKLADLFTPLSKYYTSELTNKLAFDAVQIHGGAGYTEEYDVARIYRDARITNIYEGTTQLQVVAAIGGVVSGMTPSGHLRAYIDETLKGFEPSTMLKRNFEIFEEIVRAYREISEGEQKDALAFEVVESAARYINGLLLERSIDRLVKQGENVDRRRQLVDGYNRDSFAMLTANLVRVGGESRVEVRAGAAV

SEQ ID NO: 1218 - protein, 406 aa, Leptonema illini
MPLFRMDFTISEKMQMTLDLIRTFLAKEVDPLEQTFFRKPFRELLPELGLLRAKVKQMGLWGPQLPEELGGMGLSLVEHGLVSEALGRSPLGHYLFGCQAPDAGNIEILHMFGTEEQKERYLKPLAAGEIRSCFAMTEVNTAGSNPTLLESTAVKDGDEYVLNGHKWYTTGADGASFSIAMMVTNPKASPALRASMFIVPTDNPGFQLMRNIQIMGESGSDYFSHGEVMFQSCRIPKENLLGREGHGFRIAQERLGPGRIHHCMRWLGICGRAFDMLCERANERVITLDGRTLADNDAIQHKVAELYAEIQQARLSVLHAAWMIDNDGATKARDHIAAIKFSVAGTMQRVIDAALQIHGGLGMSDDTILAYLYRHERGARIYDGADEVHKSSLGKRILKDYAKGKR

SEQ ID NO: 1219 - protein, 543 aa, Leptonema illini
MQQSISTLQELYNTHLAKVTTGLAKASAKDQSVSVAKMDENQYVHYNLAFCTAEKYIADYFLSYAETRGDVEKSMAAIFYAEAFQHFRSEVSSRPAEYTVSSDDIAALFKAEVNAAVASLLDKKNYDAVANAVLDGNYGDLATDDFKEIRDVYRKIAENTVMPHAEHVHRHDDFIPDDILQEVINNGAFGLSIPEQYGGLLDMMGNVGMMIVTEELSRGGLSIAGSLITRPEILSKALIKGGTEEQKQKWLTALASGERMAGIAVTEPNYGSDVAGMKVTADKVDGGWVINGVKTWCTFAGYADVLLVLARTEKDPELKHKGLSILLAEKPRSKDHKFEFTQPSGGHMTGSAIATIGYRGMHSYEVNFDNWFVPDENLVGGEAGRGQGFYLQMAGFAGGRVQTAARATGVMQAATEAAVRYAKERKVFGKEIKEYQITRWKIARMAMITQACRQYGYEVARMMDDHKGSMEATMVKFYASRIAEWVTREAMQIHGGMGYAEEYPVSRYFVDARVFSIFEGAEEVMALRVCARDILDQAIKALN

SEQ ID NO: 1220 - protein, 604 aa, Gillisia limnaea
MSTETQKTQLIRGGQFLVKETKAEDIFTPEDFNEEQEMMKDSVMEFIDREVWPKKEEFEKKNYALTQEIMEKAGELGFLGVSVPEEYDGLGMGFVSTMLVCDYISGATGSIATAFGAHTGIGTMPITLYGTEEQKKKYVPKLATGEVFGAYCLTEPGAGSDANSGKTKAVLSEDGKYYSITGQKMWISNAGFAGTFIVFARIEDDKYITGFIVEYDKENPNGISLGEEEKKLGIHSSSTRQVFFNETKVPVENLLAERGDGFKIAMNVLNIGRIKLAGACLDAQRRVIDGSVKYANERVQFNTAIAKFGAIKLKLAEMATAAYAGESAVYRASKNIEDRIALRVEEGNSHSEAELKSVEEYAIECSILKVACSEDIQHCSDEGIQIFGGMGFSADAPMESAWRDARIPRIYEGTNEINRMLAVGMLVKKAMKGHVDLLGPATAVGQELTGIPSMDKPDYSELFAEEKEILKNLKKIFLMVAGSAVQKFGAELEEHQQLLLASADILIEIYMAESTILRTEKNANRLGEDTQKEQIAMSQLYLYNAVDKITQKAKEGIVSFAEGDEQRMMLMGLKRFTKYQNQPNVVALRNTIAEKLTSENKYCF

SEQ ID NO: 1221 - protein, 454 aa, Gillisia limnaea
MSIFGKVKNTINLLKSVDLDQLANISKHIDLPEAMNALGALDERQLKGLMKMLKTKKKKGQSDLPPIDGDFYNLDLKLTPEQREIQLKVRNFMEDEVKPLVNDHWNRAKFPFEIIEKFAKLNVAGVPYEGYGCPNHSFLMEGIIAQEIARVDVSISTFFGVHSGLAMGSIYLCGSEAQKQEWLPAMQKLEKIGAFGLTEPNVGSGVAGGMETTCSFDGENWVLNGQKKWIGNATFADVIIIWARDEDTNRVKGFIVRKENPGFKAEKMEDKMALRIVQNALITLTNCKIPENDRLKHANSFKDTAKVLRMTRAGVAWQAVGCARGAYESALKYTKKREQFGRPIASFQLIQDHLVEMLSNLTAMQTLVFRLSEMQDQGILTDEHASLAKVFCSMRTRDVVSRAREVLGGNGILLEYDVARFVADAEAIYSYEGTKEINTLIVGRAITGYSAFVN

SEQ ID NO: 1222 - protein, 501 aa, Desulfatibacillum alkenivorans
MTYQPCTPDYAQCAPDLNDVAANLVCAHATPRALIKETREVVDIARRFNKEVVRPYALELDRKLHEDPDFLPWDFVKKANDWGFYTMWIPRLFGGKGYFMHSMSAFVEEIGSACTAMANLIGVHYLGMATLAASWNAPLMMKIFRDVAAGEKAGDPRIISLAITEPSAGTDVEEPDLIDKGNITCHAKKVDGGYVVNGTKIFISNGHLSKWHVVIAYSDLDLPSQNTVCMLVQTGQKGFSFGRHEKKMGQRACPASELVFKDCFVPDNMIALDPEQIKDLKRDAKHTFQQVLDYVLGATRAGVAAFATGAARGAYEEALAFANETEVDGKLLANHEWAQCMLAEMYKNVNLARLAYMETNHHNASSGIYKSMLSKGMFQFSKYAPQFFVDKIAPTLLGNSLTTKWLRKQSFDSQPEDEMRRTSGWGSLAKFSGTDLGMKNCHMALELMGQAGLRHDQRVEKHFRDAKLLQIYEGTNQLNRLNLFKCLISRACPQSCVFHDA

SEQ ID NO: 1223 - protein, 401 aa, Desulfatibacillum alkenivorans
MDFAISEKMETILGMIREFVDKELIPMEPEFLTNEFRDMEPELEKKRDMVKKMELWAPNHPKEYGGMGLNLMDHALVSEALGRTPIGHYVFGCQAPDAGNIEILNLHGTPEQKDKYLQPLVEGKIRSCFSMTEVEQPGSNPVIMDTTAVKDGDDYIINGHKWYSSSADGAEFAIVMAVTNPDNAKYMQASMIIVPSDTPGFNLVRNIPVMGHAGSGWSSHGEILYQNCRVPQSNLLGPEGGGFVIAQERLGPGRIHHCMRWIGICTRAFDLMVHRANTRMMAPGQPLGSKQIIQAFISESAAEIQAARLMVLQAAWAMETKGHKEARKEVSLIKFYVAGVMQKVIDRALQVHGGLGMTDDTIIAFLFRHERAARIYDGADEVHKASIARRILKEYEGKNIR

SEQ ID NO: 1224 - protein, 481 aa, Desulfatibacillum alkenivorans
MDFSPPPYGLFSPDIDLMVNLPGLGKLREKHPAYIARAEKAQAAARKFAIKHILPRSLETDKKCSQDPAYFDWDLWHAANREKFTIACLPEKMGGLGWSALANAAAVEEFSSACMGSTANILFNTFGVLGAMVECKTGIVLSMIKKMLQAQQAGAPLFYSWAITEPGAGTDMEDARGMEAMRPSCHAQKVQGGYSLSGVKCFITNGSLAHYVIVNMPVDPEHPLESMATFHVPTDAPGFSVGRVERKCGQKASQTAELFFDRVFVPDADVWAQPGKGFDHTREILSITRGFVGLCGMGIARGALERCIRYSADKQTPQGRLIDQDWVRFALADMIKDLHMVRAAAYNFAMALDAFHVWKLFDSPAVKGAACLPDKLLLSDSLQALAKSAPASEAGSIFKKKIVTGKVLDEFVRHGSALKVAGTDLAMKTSSRVLDIVGLEGMSREFGMEKSFRDAKVTQIYEGSNQANLLDLFHEEIGRLL

SEQ ID NO: 1225 - protein, 597 aa, Myroides odoratus; identical to SEQ ID NO: 1214

SEQ ID NO: 1226 - protein, 604 aa, Gillisia limnaea; identical to SEQ ID NO: 1220

SEQ ID NO: 1227 - protein, 454 aa, Gillisia limnaea; identical to SEQ ID NO: 1221

SEQ ID NO: 1228 - protein, 592 aa, Leptonema illini; identical to SEQ ID NO: 1216

SEQ ID NO: 1229 - protein, 591 aa, Leptonema illini; identical to SEQ ID NO: 1217

SEQ ID NO: 1230 - protein, 406 aa, Leptonema illini; identical to SEQ ID NO: 1218

SEQ ID NO: 1231 - protein, 543 aa, Leptonema illini; identical to SEQ ID NO: 1219

SEQ ID NO: 1232 - protein, 452 aa, Weeksella virosa; identical to SEQ ID NO: 1207

SEQ ID NO: 1233 - protein, 669 aa, Arabidopsis thaliana
MAMPRATSGPAYPERFYAAASYVGLDGSDSSAKNVISKFPDDTALLLYALYQQATVGPCNTPKPSAWRPVEQSKWKSWQGLGTMPSIEAMRLFVKILEEDDPGWYSRASNDIPDPVVDVQINQRAKDEPVVENGSTFSETKTISTENGRLAETQDKDVVSEDSNTVSVYNQWTAPQTSGQRPKARYEHGAAVIQDKMYIYGGNHNGRYLGDLHVLDLKSWTWSRVETKVATESQETSTPTLLAPCAGHSLIAWDNKLLSIGGHTKDPSESMQVKVFDPHTITWSMLKTYGKPPVSRGGQSVTMVGKTLVIFGGQDAKRSLLNDLHILDLDTMTWDEIDAVGVSPSPRSDHAAAVHAERFLLIFGGGSHATCFDDLHVLDLQTMEWSRPAQQGDAPTPRAGHAGVTIGENWFIVGGGDNKSGASESVVLNMSTLAWSVVASVQGRVPLASEGLSLVVSSYNGEDVLVAFGGYNGRYNNEINLLKPSHKSTLQTKTLEAPLPGSLSAVNNATTRDIESEVEVSQEGRVREIVMDNVNPGSKVEGNSERIIATIKSEKEELEASLNKERMQTLQLRQELGEAELRNTDLYKELQSVRGQLAAEQSRCFKLEVDVAELRQKLQTLETLQKELELLQRQKAASEQAAMNAKRQGSGGVWGWLAGSPQEKDDDSP

SEQ ID NO: 1234 - protein, 668 aa, Arabidopsis thaliana; identical to SEQ ID NO: 1100

SEQ ID NO: 1235 - protein, 602 aa, Cyclobacterium marinum; identical to SEQ ID NO: 1209

SEQ ID NO: 1236 - protein, 669 aa, Arabidopsis thaliana; identical to SEQ ID NO: 1233

SEQ ID NO: 1237 - protein, 668 aa, Arabidopsis thaliana; identical to SEQ ID NO: 1100

SEQ ID NO: 1238 - protein, 418 aa, Caenorhabditis remanei
MSALASKLFSKCVVGRALQAQTVRQFSAYPIDDTMFGLNEEEITLRQSIRQFADKELAPFADKIDKDNGWDQLRPFWKKLGDQGLLGITAPAEYGGSAMNYFSHVIAMEELSRAAGGIALSYGAHSNLCVNQICRNGSEEQKKKYLPKLISGEHMGALAMSEAQAGSDVVSMKLRAEKKGDKYILNGTKFWITNGPDADVLVVYAKTDPSKHQHGITCFLVEKNTPGFSQSPKLDKLGMRGSNTCELVFDNCEIHESQIMGGVGKGVYVLMTGLDYERLVLSGGPLGLMQAACDIAFDYAHQRTAFGQKIGSFQLLQGKLADMYTTLNASRSYLYMVAKAADKGTVSNKDCAGVILYVAEKCTQVCLDAIQILGGNGYINDYPAGRLLRDAKLYEIGAGTSEVRRLIIGRALNKEYST

SEQ ID NO: 1239 - protein, 418 aa, Caenorhabditis remanei
MSALASKLFSKCVIGRALQAQTVRQFSAYPIDDTMFGLNEEEIALRQSIRQFADKELAPFADKIDKDNGWDQLRPFWKKLGDQGLLGITAPAEYGGSAMNYFSHVIAMEELSRAAGGIALSYGAHSNLCVNQICRNGSEEQKKKYLPKLISGEHMGALAMSEAQAGSDVVSMKLRAEKKGDKYILNGTKFWITNGPDADVLVVYAKTDPSKHQHGITCFLVEKNTPGFSQSPKLDKLGMRGSNTCELVFDNCEIHESQIMGGVGKGVYVLMTGLDYERLVLSGGPLGLMQAACDIAFDYAHQRTAFGQKIGSFQLLQGKLADMYTTLNASRSYLYMVAKAADKGTVSNKDCAGVILYVAEKCTQVCLDAIQILGGNGYINDYPAGRLLRDAKLYEIGAGTSEVRRLIIGRALNKEYST

SEQ ID NO: 1240 - protein, 676 aa, Caenorhabditis remanei
MPQFLNKTIQDGDNPDLTEERKTGTFNTNDMASQIWGSEKRARRRREISAKIAQLPELHDSKPLPFMTREEKIMESARKVTILTARMSEIIDPTDPAELYHLNNEVLGIEGNPMALHGVMFIPALSAQASDEQQAKWLPRALRREIIGTYAQTEMGHGTNLQNLETTATYDISTQEFILHTPQITALKWWPGNLGKSSNYAVVVAHMIIKGKNYGPHPFMVQLRDEKTHEPLTGITVGDIGPKMAYNIVDNGFLGFNQYRIPRTNLLMRHTKVEADGTYIKPPHAKINYSAMVHVRSYMLTGQAIMLSMALNIATRYSSVRRQGQIDKSQPEVKVLDYQTQQHRLFPSIARAYAFQFAGAETVKLYEHVLKEMKSGNVELMADLHALTSGLKSVVTHQTGEGIEQARMACGGHGYSMASYISEIYGVAIGGCTYEGENMVMLLQLARYLIKSAAAVKSGNISKLGPLVAYLGAKSEPTSLIDRVPNSGFVEYVKTFQHIAKRQTLKAADMFFGLMGKGEKREIAWNKSSVELTRASRLHTRLFIVEAFIRRVNEIVDFRIKEALTDLLHLHVNYELLDMAQYALEDGFLSSSQLDYIREQLYFYLGKVRPNAVSLVDSWEFSDIELRSVLGRRDGHVYPNLFKWAKSSPLNKTDVLPSVTQYLKPMMEKARQSSKL

SEQ ID NO: 1241 - protein, 661 aa, Caenorhabditis remanei
MMLNKSIMDGDNPDLTEERMKGTFDTDKMAALIYGSEKFARRRREISDCVSRIPQLADIKPYPFLTRDEKLMEGTRKISVLNHYLPAIIDKDNAAESLHLHQEVIGFEGHPLALHDSLFIPPLLTQGTDEQHEKWLGRAKRREIIGCYAQTEMGHGSNLRALETTATYDISTQEFILHTPTITALKWWPGNLGKSSNWAVVVADLVIKDTHYGAHMFMVQIRDEKTHEPLTGITVGDIGPKMAFNAADNGFLGFDHYRIPRDHLLMKYSRVEPDGTYIKPMHAKINYHGMVRVRSNMTTEQGLFLAHALTIAVRYSAVRRQGYLDDKSHEVKVLDYQTQQHRLFPSIARAYAFQFAGAETWKLYEQVLNGMKSGNVELMADLHALTSGLKSVVTHQTGEGIEQARMACGGHGYSMASYIFEIFGLAIGGCTYEGENMVMLLQLARYLVKSVELVQSGKSVGPMVAYLAEPDTKVDLTTGPEAYVKVFQHAARRQAWKATDKFHELMKSGQSRDIAWNNCAVELIRASRLHTRLYIMETFIRRVSSISDISIKKVLIDLVNVHVNYEVLDIGTYALEHVSSTQLDSIRSQLYSSLDTLRPNAVSLIDSFQISDMQLRSVLGRRDGHVYPNLFEWAKASPLNQTHVLPSVNQYLKPMMDKAKL

SEQ ID NO: 1242 - protein, 677 aa, Caenorhabditis remanei
MLNKSIMDGDNPDLTEERMKGTFDTDEMAAVIYGSEKLARRRREISEAISRIPELADIKPLPFLDRFEKVTEGSRKLAVIKEHVKELIDEDNYEEGLHLYHEVMGMEGHPLALHEVMFIPALVAQASDEQHKKWLGRAKRREIIGCYAQTEMGHGSNLRKLETTATYTPATQEFILHTPTETALKWWPGALGKSSNWAVVVANLITNGKNYGPHPFMVQLRDESTHIPLPEITVGDIGPKMAFNGGDNGFLGFNQFRIPRGYLLDRHAKVEADGSYVKPPHAKINHSAMIRVRSHMATGQGALLAHALVIAVRYSAVRRQGFLEDKSREVKVLDYQTQQHRLFPSIARAYAFIFCGFETIQLYDQLLIDVKNGDTSGMSDLHALTSGLKSVVTHYVGQGIEQARMACGGHGYSMASYISEIYGVAIGGCTYEGENMVMLLQLARYLVKSVEQIKTGKSMELGPMVAYLAEPDTKVDLTTGLAAYVKVFQHAARRQAWKATDKFHKLMESGQSRDIAWNNCAVELTRASRLHTRLYIMETFIRRVSSISDIAIKKVLIDLVNVHVNYEVLDIGTYALEHVSSTQLDSIRSQLYSSLDTLRPNAVSLIDSFQISDMQLRSVSTRHTDTQTDTLIQVLGRRDGHVYPNLFEWAKASPLNQTHVLPSVNQYLKSMMDKAKL

SEQ ID NO: 1243 - protein, 662 aa, Caenorhabditis remanei
MLNKSIMDGDNPDLTEERMKGAFDTDKMAAVIYGSEKFAIRRREITESISRIPQLADSKPFSFMTREEKISESCRKLSVLSEHWNQLIDTNNEEEALHLYREVLGLEGHAFSLHETMFIPSLVAQANDEQQEKWLGRAKRREIIGCYAQTEMGHGTNLRALETTATYYPSTQEFILHTPTETALKWWPGALGKSSNYAVVVADLVIRDTHYGAHPFMVQLRDEKTHNPLPGITVGDIGPKMAFNGADNGFLGFNQYKLPRDHMLMRHSRVEENGTYTKPPHAKIGYSSMVKVRSRMAMDQGLFMVSALVIAVRYSAVRRQGFLDDKSREVKVLDYQTQQHRLFPSIARAYAFIFCGFETIQLYDQLLIDVKNGDTSGMSDLHALTSGLKSVVTHQTGEGIEQARMACGGHGYSMASYISEIYGVAIGGCTYEGENMVMLLQLARYLVKSVELVKTGKSKELGPMMNYLAEPDTQIDLTSGPEAYVKVFQHAARRQVWKATDKFHQLMESGQSRDIAWNNSAVELTRASRLHTRLYIMETFIRRVSSISDVSIKKVLIDLVNVHVNYEVLDIGTYALEHVSSTQLDSIRSQLYSSLDTLRPNAVSLIDSFQISDMQLRSVLGRRDGHVYTNLFEWAKASPLNQTHVLPSVNQYLKPMMDKAKL

SEQ ID NO: 1244 - protein, 682 aa, Caenorhabditis remanei
MPQYQPYSQITQLLPVSRMNRYIQDGDNPDITEERKKATFDVDGFTEWYHGGAKRLQARREVEKYVEDHKELQDTRPTPFMSREELIDNSVRKVAGMAKYHEMIDMTNIEKTTYFIQMVHVRDGQAFSLHYLMFLPVLQSQASSEQLSKWMPRAVSGTIIGTYAQTEMGHGTNISKLETTATYDPKTEEFVLNTPTVSGAKWWPGSLGKFCNHAIVVANLWTNGKCEGPHPFIVQLRDMNTHKTLSNLKSGDIGPKLGINGSDNGYLLFDQFRIPRENMLMRHSKVLPDGTYVKPPHSKLAYGGMVFVRSMMVRDIANHLANAVTIATRYSCVRRQGELAPGAGEVKILDYQTQQYRIFPYMAKVIAFRIAGEELQVIFKEISKKLKKGEASQLPDIHALSSGLKALVTFEVQQGIEQCRLACGGHGYSHASGIPELLAFSCGSCTYEGDNLVLLLQVAKYLMKVVTSASPNTNGICGYLHKKSQSNVSTLSSHKTYSDHQIVQDFEHATRRVVLQAFNKLKTESSIYKSHEAWNRCSVELTKAARWHIRLYIVRILLLKVSQAPEDIRPVLRTLAKLYIFDLQVSNKGNFMENRYMTPQQIDELKSGVSGALATIRTDAVSIVDAFAIHEIELKSVLGRRDGNVYPALMEWTAHSHLNKKDVPDAFEKYLKPIMENIRAKM

SEQ ID NO: 1245 - protein, 667 aa, Caenorhabditis remanei
MSRWIQEGDNVDITNEREKGTFDTERLSAWIHGGTDVLKRRREILEFVKSVDDFKDPVPIEFLSREERILNNARKVVAMTDNTDQIDGSDFFGEGMYYQALTMGRDLHAMSLHYVMFIPTLQGQTDDEQLDEWLTKAISRAVVGTYAQTELGHGTNLSKLETTATYDPATEEFVLNSPTITAAKWWPGGLGKSSNYAVVVAQLYTKGECKGPHPFIVQLREDDTHLPLKGIRLGDIGPKLGINGNDNGFLLFDKVRIPRKHLLMRYAKVKPDGTYVAPAHSKLGYGTMVFVRSIMIKDQSTQLAAAATIATRYASVRRQGEITPGKGEVQILDYQTQQFRVFPQLARAFAFMAAATEIRDLYMTVTEQLTHGNTELLAELHVLSSGLKSVVSWDTAQGIEQCRLACGGHGYSQASGFPEIYGYAVGGCTYEGENLVMLLQVARFLMRAAEEVRKGTAKLADIGAYIGRTGAKSSRLTTHHHYTDVQLVEDLEHAARKQVFRAYDRLKKAQQHLKPEDAWNSVSVELAKASRWHVRVYLVKNFLHKVSLAPQDLKFVLVDVARLYAYDIITSSIGAFLEDGYMTSNQMNEIKEGIYECLAKIRPNAVSLVDSWDYDDKELKSVLGRRDGNVYPALLEWAQNSQLNKTEVLPSHTKYLGPMMKDARSKL

SEQ ID NO: 1246 - protein, 667 aa, Caenorhabditis remanei; identical to SEQ ID NO: 1245

SEQ ID NO: 1247 - protein, 682 aa, Caenorhabditis remanei; identical to SEQ ID NO: 1244

SEQ ID NO: 1248 - protein, 418 aa, Caenorhabditis remanei; identical to SEQ ID NO: 1238

SEQ ID NO: 1249 - protein, 676 aa, Caenorhabditis remanei; identical to SEQ ID NO: 1240

SEQ ID NO: 1250 - protein, 661 aa, Caenorhabditis remanei; identical to SEQ ID NO: 1241

SEQ ID NO: 1251 - protein, 677 aa, Caenorhabditis remanei; identical to SEQ ID NO: 1242

SEQ ID NO: 1252 - protein, 662 aa, Caenorhabditis remanei; identical to SEQ ID NO: 1243

SEQ ID NO: 1253 - protein, 418 aa, Caenorhabditis remanei; identical to SEQ ID NO: 1239

SEQ ID NO: 1254 - protein, 412 aa, Homo sapiens
MAAALLARASGPARRALCPRAWRQLHTIYQSVELPETHQMLLQTCRDFAEKELFPIAAQVDKEHLFPAAQVKKMGGLGLLAMDVPEELGGAGLDYLAYAIAMEEISRGCASTGVIMSVNNSLYLGPILKFGSKEQKQAWVTPFTSGDKIGCFALSEPGNGSDAGAASTTARAEGDSWVLNGTKAWITNAWEASAAVVFASTDRALQNKGISAFLVPMPTPGLTLGKKEDKLGIRGSSTANLIFEDCRIPKDSILGEPGMGFKIAMQTLDMGRIGIASQALGIAQTALDCAVNYAENRMAFGAPLTKLQVIQFKLADMALALESARLLTWRAAMLKDNKKPFIKEAAMAKLAASEAATAISHQAIQILGGMGYVTEMPAERHYRDARITEIYEGTSEIQRLVIAGHLLRSYRS

SEQ ID NO: 1255 - protein, 451 aa, Fluviicola taffensis
MSIFSNIKNAYRLFKQVDLEQLSALSKKVDLPEVMNSVGKLDDKQLSGLMKMLSGNQPKKELPAIDGDFYNISHTLNPEERVLQLKVRAFMETEIKPIVNDYWRRGEFPHHIIPKVAELDICGIAYEGYSNPVRSYLMEGVLAMEMARVDVSFATFFGVQSGLVMGSIFLLGSEEQKQEWLPELKNLRKIGAFGLTEPEVGSGVAGGLTMKAKRIGNSWTLNGQKKWIGNATFADVIIIWAEDEEDHQVKGFLVRKDTPGLAVEKMEDKMALRIVQNGIITLTDCLVEEVDRLQKANSFKDTANVLRMTRAGVAWLAVGCARGAYESALKYTRERKQFGKPIASFQLIQNHLVEMLTNLTAMQTMVARLSELQDQNELTDEHASLAKVFCSLRTRDIVSKAREVMGGNGILLEYDVARFVADAEAIYSYEGTKEINTLIVGRAITGYSAFV

SEQ ID NO: 1256 - protein, 452 aa, Mucilaginibacter paludis
MANVFSKAKGLFRLFHTIDIDQISTLASKIDLGEVMASVSKMDDNQLNSVVKMLKSGHHQHELPPIEGDFYHLGHTLSPEQRELQLKVRAFMETEVKPIVNEYWLKAEFPFQIIPKLAELNICGLTYQGYGGGGQSFLMEGVLAMEMARVDTSISTFFGVQSGLAMGSIYLCGSEEQKQEWLPRMQQFKAIGAFGLTEPEVGSAAAGGLTTTAKRDGDTWILNGQKKWIGNATFADILVIWARDVDDNQVKGFLLRKDTPGFSVEKMHDKMALRIVQNGIITLKDCVIHETDRLQNANSFKDTAKVLQMTRAGVAWQAVGCARGAYESALDYTRKRKQFGKPIASFQLIQNHLVEMLSNLTAMQTLCFRLSQLQDEGKLNDEHASLAKVFCSLRTRDVVSKAREVMGGNGILLEYDVARFVADAEAIYSYEGTKEINSLIVGRAITGFSAFV

SEQ ID NO: 1257 - protein, 452 aa, Mucilaginibacter paludis; identical to SEQ ID NO: 1256

SEQ ID NO: 1258 - protein, 451 aa, Fluviicola taffensis; identical to SEQ ID NO: 1255

SEQ ID NO: 1259 - protein, 452 aa, Deinococcus proteolyticus; identical to SEQ ID NO: 1110

SEQ ID NO: 1260 - protein, 648 aa, Arabidopsis thaliana; identical to SEQ ID NO: 1101

SEQ ID NO: 1261 - protein, 648 aa, Arabidopsis thaliana; identical to SEQ ID NO: 1101

SEQ ID NO: 1262 - protein, 617 aa, Caenorhabditis brenneri
MLSTLSKTARISQTRFLRLSHSAAAAKDAKPKKVPAAAVDSPSFVMNLFRGKAVTEQVFPYPLNMTDEQKETLGMVMSPLEKMLIEVNDVVKNDETSDIPRAVLDQFAELGTFGVLVPPELEGSGFNNSQMARVAEIVGAYDLGFGVVMGAHQSIGYKGILLEGTDAQKQKYLPDLATGRKFAAFALTEPTTGSDASSVRTRAELSADGKHYVLNGGKIWISNGGFADVFTVFAQVLTPIKQADGSTKDKMSAFIVERAFGGVTSGPQEKKMGIKGSNTTEVHFDNVKIPVENLLGKEGEGFKVAMNILNNGRFGIPAACTGAMKHCIQKTVDHITTRVQFGKKLEEFGNVQEKLVEMISKLYATESIVYMLSSNMDRGIKEYQLEAAIGKVLASESAWHVCDDAIQVHGGMGFMRETGLERVLRDLRIFRIFEGANDVLRLFIALTGAQHAGKHLAVQASGVGGLIGLAVSRVTGGNTGSNFGQVVDASLQDSAKALDQQIALFGQTVQGLLMKHKKGIIDRQYEMHRVANAAIDIYSSAAVLSRATYAIKNKSSSADFERKVATYYVDKAMRSSNRYLKDAGSASENAAKVATIESLAKEVCGNGGLTLQHPVEL

SEQ ID NO: 1263 - protein, 412 aa, Caenorhabditis brenneri
MLSRLPSVFGRNRVAVQARQMSFELTDTQKDIQAAALQFSKEVLLPNAVKYDKSGDFPWDIVRQAHQLGFMNPIIPEKYGGPGMNGLNTCLIVEALAYGCTGIQLAIVGPSLAVAPVYLSGTEEQKKKYLGMMAAEPIIASYAVTEPGAGSDVNGVKTKAVKKGDEYVINGSKAWITGGGHAKWFFVLARTDDDPKTPAGKAFTGFIVDGDTPGIIRGKKEENMGQKCSDTRAITFEDVRVPKENILGEVGAGFKVAMGAFDLTRPQVAAGAVGLAWRCLDESLKYSLERTTFGTPIANHQAIQFMLADMAINLELSRLFTYKAAAESDAGGLVSYYASIAKCFASDTANDAATNACQIFGGAGFNCDYPVEKLMRDAKIYQIYEGTSQIQRVVIARHMLSNFSRNKTSKMG

SEQ ID NO: 1264 - protein, 412 aa, Caenorhabditis brenneri
MLSRNFSKCTRMFSTTNKAMSTGIDFNLSADQAEFRANVRKFVADEVLPVAAEYDKTMEYPWPIIKKAHAQGYLTADIPEAYGGLGIDMVSNCIISEEMAYGCSGIATAVMANDLALTPLILCANDDIKKRFLGRMVENPFVASYAVTEPGAGSDVAGIKTKCEKKGDEYIINGSKMWITNAGHANWFFVLARSDPNPKTPSGKAFTAFVVEGDSPGLTRGRKEINMGQRCSDTRGLTFEDVRVPAANVVGAPGEGFKVAMKTFDKTRPTVAALATGVAYRCLDVATQYSLERKAFGTQIANHQGVSFLLAEMAINAELARLMTYKSGAEVDAGRPGSYYASIAKLFASDAVNQAATNAVQVFGGAGFNTEYPAEKLMRDAKIFQIYEGTSQIQRMVIARQLLARVAQNGGY

SEQ ID NO: 1265 - protein, 417 aa, Caenorhabditis brenneri
MLSRLATTSLGLSRSAPAVLATQSRQISFDLSETQKEIQAAALKFSKDVLVPNAAKFDESGEFPWEIVRQAHSLGLMNPQIPEKYGGPGMTTLETALIVEALSYGCTGLQLGIMGPSLAIAPVYIAGNEEQKKKYLGALAAEPIIASYCVTEPGAGSDVNGVKTKCEKKGDEYIINGSKAWITGGGHAKWFFVLARSDSDPKTPAGKAFTAFIVDGDTPGITRGKKEKNMGQRCSDTRTITFEDVRVPAENVLGAPGAGFKVAMGAFDMTRPGVAAGALGLSWRCLDESAKYALQRKAFGTEIANHQAVQFMLADMAVNLELARLITYKSAVDVDNKVRSSYNASIAKCFAADTANIAATNAVQIFGGNGFNSEYPVEKLMRDAKIYQIYEGTSQIQRIVISRMLLGHFAQNGTSRI

SEQ ID NO: 1266 - protein, 412 aa, Caenorhabditis brenneri
MLSRLPSVFGRNRVAVQARQMSFELTDTQKDIQAAALQFSKEVLLPNAVKYDKSGEFPWDIVRQAHQLGFMNPIIPEKYGGPGMNGLNTCLIVEALAYGCTGIQLAIVGPSLAVAPVYLSGTEEQKKKYLGMMAAEPIIASYAVTEPGAGSDVNGVKTKAVKKGDEYVINGSKAWITGGGHAKWFFVLARTDDDPKTPAGKAFTGFIVDGDTPGIIRGKKEENMGQKCSDTRAITFEDVRVPKENILGEVGAGFKVAMGAFDLTRPQVAAGAVGLAWRCLDESLKYSLERTTFGTPIANHQAIQFMLADMAINLELSRLFTYKAAAESDAGGLVSYYASIAKCFASDTANDAATNACQIFGGAGFNCDYPVEKLMRDAKIYQIYEGTSQIQRVVIARHMLSNFSRNKTSKMG

SEQ ID NO: 1267 - protein, 615 aa, Caenorhabditis brenneri
MLSTLSKTARISQTRFLRLSHSAAAAKDAKPKKVPAAAVDSPSFVMNLFRGKAVTEQVFPYPLNMTDEQKETLGMVMSPLEKMLIEVNDVVKNDETSDIPRAVLDQFAELGTFGVLVPPELEGSGFNNSQMARVAEIVGAYDLGFGVVMGAHQSIGYKGILLEGTDAQKQKYLPDLATGRKFAAFALTEPTTGSDASSVRTRAELSADGKHYVLNGGKIWISNGGFADVFTVFAQTPIKQADGSTKDKMSAFIVERAFGGVTSGPQEKKMGIKGSNTTEVHFDNVKIPVENLLGKEGEGFKVAMNILNNGRFGIPAACTGAMKHCIQKTVDHITTRVQFGKKLEEFGNVQEKLVEMISKLYATESIVYMLSSNMDRGIKEYQLEAAIGKVLASESAWHVCDDAIQVHGGMGFMRETGLERVLRDLRIFRIFEGANDVLRLFIALTGAQHAGKHLAVQASGVGGLIGLAVSRVTGGNTGSNFGQVVDASLQDSAKALDQQIALFGQTVQGLLMKHKKGIIDRQYEMHRVANAAIDIYSSAAVLSRATYAIKNKSSSADFERKVATYYVDKAMRSSNRYLKDAGSASENAAKVATIESLAKEVCGNGGLTLQHPVEL

SEQ ID NO: 1268 - protein, 656 aa, Nocardiopsis dassonvillei
MNEQALRVDEAELRGLLDGRWAHVREHMRDALRGDLYAPVYGLSMEEHRARTLAQLKALAKTDLPAYGFPASVGGRDDVGASVVGFEMLVNDLSLMVKMGVQWGLFGGAISALGTEAHHAEYLPGAMSMELPGCFAMTETGHGSDVQGLRTTAVYDPDTEEFVVHTPDEAARKDYIGNAARDGRLAVVFAQLSTGGEEHGVHALVVPIRDGRGRPMPGVRIGDCGPKAGLNGVDNGRLEFDHVRVPRTNLLNRYGDVAADGTYSSPIESKGRRFFTMLGTLVRGRISVAGGAGSAAKAALTIAVRYGDTRRQFTRPDGEGRPEREVRVLDYLAHQRKLLPALARTYALHFAQEELVTRLHELSRSPERDEHAQRELESRAAGLKAVATWHASQTIQTCREACGGAGYLSENRIPQLKADSDIFTTFEGDNTVLLQQLTKGLLTNFKDSFGDLDQLGLARFMAGKVFETVIERTAAIPLIERLVAAAPGRGEEASLYNRGWQLELLEDREKHVIEGLAARLRRSGRNGEDAFDVFNRAQDHVLAAGRAHMDRVVLEAFVAGIDRCGDTATAKLLNRLCDLYVMSVVEEDRAWFLEHERLSTSRAKAVTQAVNDLCRGLRPYAVQLVNAFGLRDEWLAAPIALGGEHARQGDPVPGRG

SEQ ID NO: 1269 - protein, 405 aa, Desulfatibacillum alkenivorans
MDYNLTKQQIALKKEFEHFFQEEMKKAPPEYWQSGQFETVYISDAGWEFYKYMKGRYAEKGWAALAWPMEYGGAGLTLMEQLLFDEAQSLYGAPRDIYGIRMFGQAVLVFATEEQRKRILPPIVSGEIQYCQGWSEPNAGSDLAALTTTAVRDGNDYVVNGQKTWTSGAHRSDKIFLLARTDPNSSRGEGLSVFNVDLGLPGIEIRPVHFMNGDHVFNEVYFTDVRVPASELIGGEENDGWRQTRATMNFERSLIAFFAGTRRRLDEFIEYVKTTKRDGRFLAENPIIRHKIAQLHVDIEVGRSLAYSTAFAELSGNMLFSAAAASESRVFGGELYQRVANVTTEIMGLYGQVESSRWAPLNGIASDGYQFNIGFNIGGGTSEIQRNIIAWIGLGMPRLKTVKTK

SEQ ID NO: 1270 - protein, 721 aa, Mycobacterium rhodesiae
MGIALTDDHRELSEVARSFLAAQKARAATRDLLADDAEETRPPFWLELAELGWLGLHVDEQYGGSGFGLPELVVVIDELGRAIAPGLFVPTVVASALVSAAGSDEQKARLLPGLVDGSVTAAVGFSCDITVSGDTASGDAGVVLGAGLADLLVLASGADVLLVERGAHGVSVDAPGSLDRARRSARVSLRDVSVAGNVLAGARSVAVALARTLFGAEAAGGASGCVDTAVEYAKVREQFGRTIATFQAVKHHCANMIVASESAVAVVWDAARAFGDDEKQFELVAAAAAALAFPAYVGNAELNIQVHGGIGFTWEHDAHLHLRRALTVQALLGGDGPVTDVFDLTQSGVSRANSLDLPAEADELRTQIRADAHQLATLDEKAQLDELIASGYVMPHWPKPWGRAAGAVEQLLIEEEFAAAGVKRPDYGITGWVILTLIQHGTPSQIERFVEKALRKDEIWCQLFSEPSAGSDAAAVKTRAVRVDGGWKITGQKVWTSGAHYCKRGLATVRTDFDVPKHAGITTVILDMAAPGVEVRPLRQITGGADFNEVFFNDVFVPDEDVVGEPNSGWTVARATLGNERVSIGGGAGTIAPAAAWLVSLAKKHGDRHAGAVQWVGKFLARDQALRLLNLRRVVRALEGAGPGPEGNITKLILAEQFQEQGTIAAALVGPDVALDGGEGEMAGRTALGSRALSIAGGTSEITRNQIAERILGMPRDPLIK

SEQ ID NO: 1271 - protein, 732 aa, Mycobacterium rhodesiae
MPIAITPEHNALADSVKSLVTRVAPSEVRHEALETPVPNPPPYWNAAAEQGLHGLHLAESVDGQGFGLLELAIAIAEFGYGAVPGPFVPSAIASALVSAHDPDTKLLAQLASGEFIATCALESGLTATRQDSTLVIRGEARSVLAGAQASVLVLPVAIDSGSEWVILDAAELEIEPVESVDHLRPVAHVRVHAVEVTADQVLSNLSQSAGRAIVTTLLSAEAVGIARWATDTAAAYAKIREQFGRPIGQFQAIKHKCAEMIATTERATAAVWDAARALDEAAEKSWDNQQTAYEFAAAVAASLAPAAAQHCAQDCIQVHGGIGFTWEHDTNVYYRRTLGLVAAFGRANEYQQKVFDTATTTGMRAINIDLDPETEQLRAEIRAEVAALKAIPREERKAAIAEGGWVQPHLPKPWGRDAKPVEQIIIAQEFTAGQVKRPQMGIAAWLIPSIVAFGNEEQKQRFLPPTFRGEMIWCQLFSEPGAGSDLASLTTKATKVDGGWRITGQKIWTTGAQYAQWGALLARTNPTAPKHSGISYFLLDMKSQGVEVKPLRELTGHAMFNTVFIDDVFVPDELVLGEVDRGWEVSRNTLTAERVSIGSSEPGFLANLDGFVDFVSGGHFDQIGHHRAGELIAEGHAAKLLNLRSTLLTLAGGDAMPSAAISKLLSMRTGQGYAEFAVSSFGIDGAIGDPEALQGKWAEWLLGSRSTTIYGGTSEVQLNIIAERLLGLPRDP

SEQ ID NO: 1272 - protein, 743 aa, Mycobacterium rhodesiae
MTLPIGTAITIEQEQLAQAVTQFAARHAPIDKTRAALDSIAAGELPTWWEEFTANGFHAVHLPEEAGGQGGTLADMACVIEAAAAALLPGPLLSTATAGAVAVLADDSAATLIADIASGATAAVVLPEDSTVQAMRDGARWRLTGSIGSTLGLIAAQRVLVAARGDDGTDLWFVLNIGSAAAGMTIEQQRGTDLCTDVGVLTLDDCPADATVAGIDTERARCVVAALTACASAGTVRKGVETAVNYIRTREQFGKPVGSFQALQHKAAVLLVNAELASASAWDAVRAIDESIGQHRLAASSAALMAVCAGPDLMLDALLMFGAIGYTWEHDTHLYWRRATSLAASLGSTTRWAREAGELARTLKRSAAINLGDVESEFRAYLAKILDEAAALANETPTDDTRAPGLAYGSQRDLLAKAGLVAPHLAAPWGVGASPVQQVIITEEFDKRPSLVRPSLGIAEWILPTILNSGTDSQRERFAWDMLRGTKRWCQLFSEPGAGSDLASLVTRAQKVDGGWLVNGHKIWTSSAHVAQFGAMLARTDPDAPKHRGISYFLVDMSSPGIEISPIKQASGHFDFNEVFLTDVFVGDDMLVGEPGHGWDLAVATMAVERTAISNYVTIDRSEALRRMADVDGPDHDSTLQALGEIEAHTTAIKAMVLRETLRLVQGQGPGPTSSIAKYAMVLLLRRAWTATLGLTGRLGMLEDSDPAVIAPYFDMPSELIGGGTAEIQLTIIASMILGLPRK

SEQ ID NO: 1273 - protein, 656 aa, Nocardiopsis dassonvillei; identical to SEQ ID NO: 1268

SEQ ID NO: 1274 - protein, 1080 aa, Caenorhabditis remanei
MLVLDLKEVFGYDTSFSLKIKRIISKRHHTLPTSTHLHLDVLYFSTTMYPTSYSYHIDRFLCHPQRVLSILFFPFIRSLFFILELIFSTIKVSGKMTIKAVIFDMGGVLLPAPMHYWKTVERAHNLRDGSVVETILSLDFYCHFKLFEIGQLTAEDLDPLFTHVYNFQNNRVGDVLPIFVEISGQIAHSTLLPEMVALVKSLRLAGYRTILITNNFFTDRAKLIPTIPLEVPLLFDDVLESCRIGLRKPEVQIYQLALERNKLQPSECVFLDDLGPNLKPARALGITTIKVVNSQQAIQDLGNVLKLDFTHPAETRDCIPREVLPVEKVNELITRSTSSDNKVTTIRKFRHGQSNPTYYIRTTKGSQYVLRKKPSGNLLPKAHQVDREFKIMNALQGLVPLPRTILYDEKTLDTPFYLMEYQKGRIFLNPSLPELTPPERRRVYEEALRTLATIHSVDYEKVGLKDFGRSDGYMERNLKRWSDAYKMSKTEDIPEMDKLEAYLKENLPKSGKSTIVHGDFRVDNLILEENEIKVKGVLDWELSTIGDPLSDLATFLFVYYVPNRMKLLPGIGDHSESDLRRMGIPTIKECLELYSKYTNTPLVDPELWTYYMAFVVFRFASIVQGVYMRSQLKNASSTEAAMLGPLVRKLAAEGNQMISKLHASKSYGQLTIIPSGMSAKAQKYYEIVRDIVHNDVIPLELELMEYYEEGPHRWTIPHPKIEKLKEKAKSLGAWNLFISEHIDPDQKYGKGLTNVEYAHICELMGRSIFAPEVFNCQAPDTGNMEVLIKYGNEEQKKKWLVPLLNGEIKSCFAMTEPDVASSDATNIQGSIVRIGNEYVINARKWFISNASHPRCRICVFMGQVAGPKKSRIFQQSMILVPMQTEGVKIVRNTHVFGSQDAPGAHPEITFTNVRVPVENMLLGEGRGFEIAQGRLGPGRIHHAMRLIGHAERAIDVMKDRLMTRVAFGRKLVQFDSLRKELALSRCEVEQARLLVLKAAHMIDTVGPKEAKSEIAMIKVVAPNMSINVIDRAMQQQGARGLTPFTPLASFYVWARSLRVADGPDAVHLETIAKIELKSRL

SEQ ID NO: 1275 - protein, 1080 aa, Caenorhabditis remanei; identical to SEQ ID NO: 1274

SEQ ID NO: 1276 - protein, 412 aa, Caenorhabditis brenneri
MLARGFGNVSAISKIATRGVSSTFYQDAFQLSDQLTEDERSLMLSAREYCQERLLPRVTEAYRNEKFDKSLIPEMGSMGLLGAPYQGYGCAGTSTVGYGLIAREVERVDSGYRSTMSVQTSLVIGPIYNYGTEDQKQKYIPDLASGKKIGCFGLTEPNHGSNPGGMETKATWDETTKTYKLSGSKTWISNSPVADVMVVWARSSRHGNKIKGFILERGMKGLTTPKIEGKLSLRASITGQIAMDDVPVPEENLLPNAEGLQGPFGCLNNARLGIAWGALGAAEECFHLARQYTLDRHQFGRPLAQNQLMQLKMADMLTEISLGLQGCLRVSRLKDEGKSEPEQVSIIKRNSCGKALEIARKARDMLGGNGIVDEYHIMRHMVNLETVNTYEGTHDVHALILGRAITGLNGFC

SEQ ID NO: 1277 - protein, 598 aa, Sinorhizobium meliloti
MPIYKAPVDDTLFILNDVLGIERYHNLPGFADVTPDMTAAILGEAAKLAEEVLFPINLSGDQEGCKRHEDGSVTVPKGFKEAYDLYREGGWLGLAAPEEFGGQGLPYTLHTAVGEFMSAANMSLMMYPGLTQGAIAAILVHGSEEQKRAYLPKMVDGTWTGTMNLTEPHCGTDLGLLRTKAAPNGDGSYSISGQKIFISAGEHDMAENVVHLVLARIEGAPDGVKGISLFIVPKFKLDASGEPGERNGVSCGAIEHKMGIHGNATCVMNYDEATGYLIGTENKGLSAMFVMMNEARLAVGMQGLSIAEVAYQNAASYARERIQGRSLSGPKAPDKKADPIIVHPDIRRTLMTIRAFNEGGRAFTLWTALKSDIAHRSDSEEERQTADDILSLMTPILKGVLTDKGFDHAVMAQQVFGGHGYIEEHGMSQYVRDARIAMIYEGANGIQALDLVGRKLAMNGGRAVMALFKEIGDFCEENRGDEKLSGYTKALKKGLNDLQAATMWFMQNAMAKPDNAGAGSTDYMHLFGLVVLGYMWARMAKTAEEKLAAGETQRADYLKNKLITARFFMERILPETELRKIRIETGADTMMALDAAAF

SEQ ID NO: 1278 - protein, 601 aa, Acidovorax avenae
MPTYTPPLRDMQFVLHEVFRVTEEFKAIPRHAEVDADTVNAVLEEAGKFAAGVAFPLNMSGDEEGCTLDKATHEVATPKGFKDAYAQYVEGGWAALSCDPEYGGQGLPFVVNQCLYEMLNSANQAWTMYPGLSHGAYEALHAHGTEEQKKLYLPKLTSGEWTGTMCLTEPHCGTDLGLLRTKAEPVAGAPEGTYKITGNKIFISAGEHDFTENIVHLVLARLPDAPKGSKGISLFVVPKYQVNADGSIGERNPIYCTGLEHKMGIHGNATAQISIDGAIGTLVGQPHKGLQAMFVMMNAARLGVGNQSLGLTEVAFQNALAYAKDRIQMRSLSGTKAKDKEADPIIVHPDVRKMLLTAKAYAEGARALQIYCTLLLDKAHSHPDEKVRKDSDELVALLTPIVKAFITDNGHIATNACMQVFGGHGFIKEWGMEQFVRDNRINMIYEGTNTVQSLDLLGRKILGNNGATLKKFGKLVGKLVEEEGVNEKMAEFINPIAYLGDQMTKFTTEIGFKGFQNPDEVGAAAVDYLRVAGHLVFGYMFARMAQVALREIAAGNTDPFYQAKLQTARFYFAKLFPETATLMRTARTGAKPLMDTDAALA

SEQ ID NO: 1279 - protein, 597 aa, Acidovorax avenae
MSYTAPVKDMLFAIEHLAGIAQVAALPGFEEAGLDTAQAVLEECARFNEGVVAPLNVAGDRNPSSWKDGRVTTTPGFKDAFRQFAEGGWQGLQHPVDFGGQGLPKTIGAACAEMLNSANMSFALCPLLTDGAIEALITAGSDALKTTYLEKLVTGEWTGTMNLTEPQAGSDLALVRTRAEPQGDGTYKVFGTKIFITYGEHDMAENIVHLVLARVAGAPEGVKGISLFVVPKFLVNADGSLGARNDVQCVSIEHKLGIKASPTAVLQFGDGGGAVGYLVGEENRGLEYMFIMMNAARYAVGLQGIAVAERAYQQAVQYARDRVQSRPVDGSLPGSAPIIHHPDVRRMLMTMRALTEGCRAMASVAAAAYDAAHHHPDAAARKENQAFYEFMVPLVKGYSTEMSLEVTSLGVQVHGGMGFIEETGAAQHYRDARILPIYEGTTAIQANDLVGRKTARDGAATALAVAAQARTTADELRAAGTPEAQAVARRLAEACDAFEEVARFIAGNTKSDPNAAFAGSVPYLMLGGNLVAGWQLGRALLKAQSLLADGQGDAAFLQAKVATARFYAEHILVRTKAQRDAIVEGAASVTALAPDAF

SEQ ID NO: 1280 - protein, 631 aa, Acidovorax avenae
MPLRSTLDFLLHDWLDAVALTQRERFADHSRETFDAVLDTCERIAREKYAPFNRLVDTEEPRMEDGRVVLPRATHEARRAYAESGMLSAAQDYAIGGMQLPYTLESAANSFFAEASISIGSNLLTVGNANLLMVHGTEAQREVFALNEFNGRWSGTMCLSEPQAGSSLSDIATRAVPDGDDFESDPLGPRYRLAGNKMWISSGDHEMTENIVHLVLAKIPGPDGRPVPGVKGISLFIVPKHLVDTSGQLTGERNDVALAGLNHKLGWRGTTNTLLNFGEGTYPVRAGQGPGGLDGRGAGAIGYRVGGPGDGLKCMFHMMNEARIGIGMAATMLGLAGYRASLQYAKDRTQGRPIVPRSAGGDGKAGKDASAPPVRLIEHADIRRMLLAQKSYGEGALALNLYCARLVDEQHTGSPEAADEARLLLEVLTPIAKSWPSEWCLEANSLAIQIHGGYGYTRDFPVEQYWRDNRLNMIHEGTHGIQAMDLLGRKVVMEGGRGLQLLAGRVNATIQRAMERPELAAHANELARALSEVGAATKAAWATGEPAEALANAVPYMQAAGHMVLAWVWLDIAVAVLARAAASAPSLAPDDAGRLGAMRYFFRYELPKIGAWLNVVRTRDMTCAEMPEDAF

SEQ ID NO: 1281 - protein, 408 aa, Caenorhabditis brenneri
MLLRNIVTRGLQLRNFSYCLNPAVGLDTDARDVLTAANEFAKKEMYPKMAEWDKKGELPMDVLKKAGDMGFGAMYCNGAFGGSDLTRLQASVIFEQLSMGCVSTAAYISIHNMCAWMVDTFGSEELKGTLIPEMAKFEKLGSYCLTEPDAGSDAASIRTTATKKGDYYVVNGSKAFISGAGTSDYYFVMMKLDGGEPGAKGIICLMIPKDTEGFSFGKKEDKLGWNSQPTRILTFEDVKVPVKNQIGKDGFGFKIAMEGLNGGRVNIASCSLGAAQRSLDLAIEHLKYRKQFGKTLSEFQYNQFKLAELATKLITSRLIVRAAAEQLENNDPEKVAMCAMAKLHATDNCFEVVNGALQMFGGYGFLKDYPIQQYLRDIRVHQILEGTNEMMRLLIGRDLLTKEIFWKS

SEQ ID NO: 1282 - protein, 412 aa, Caenorhabditis brenneri
MLARGFGNVSAISKIATRGVSSTFYQDAFQLSDQLTEDERSLMLSAREYCQERLLPRVTEAYRNEKFDKSLIPEMGSMGLLGAPYQGYGCAGTSTVGYGLIAREVERVDSGYRSTMSVQTSLVIGPIYNYGTEDQKQKYIPDLASGKKIGCFGLTEPNHGSNPGGMETKATWDETTKTYKLSGSKTWISNSPVADVMVVWARSSRHENKIKGFILERGMKGLTTPKIEGKLSLRASITGQIAMDDVPVPEENLLPNAEGLQGPFGCLNNARLGIAWGALGAAEECFHLARQYTLDRHQFGRPLAQNQLMQLKMADMLTEISLGLQGCLRVSRLKDEGKSVPEQVSIIKRNSCGKALEIARKARDMLGGNGIVDEYHIMRHMVNLETVNTYEGTHDVHALILGRAITGLNGFC

SEQ ID NO: 1283 - protein, 599 aa, Alicycliphilus denitrificans
MSDYKAPVKDMRFVMDEIVGLAEISSLPGFEEATPDMADAILEEAARFTGEVLAPLNRLGDTEGCKLEANGVVTPAGWKEAYKAFCDGGWNGLGSPAAFGGQGLPETFGIAVKEMAASANLSFSLCSMLTGGAVAALLTCASDELKAVYLEKMITGAWTGTMNLTEPNAGSDLALIRSRAEPQADGSYRVFGQKIFITYGDHDMTDNIVHLVLARLPDAPAGVRGISLFLVPKFLVNADGSLGARNDAHCVSIEHKLGIHASPTCVLAFGDNGGAVGYLLGEANRGLEYMFIMMNEARLGVGLQGIALAERAYQQALAYARERKQGRDAVTGEALVTIDRHPDVRRMLMLMKSRVEACRAVAYYTAGLLDRAHAGADAGQKQRDLFLAEFMIPIVKGGSTEMGIDVTSLGIQVHGGMGFIEETGAAQHWRDARITTIYEGTTCIQANDLILRKLARDQGATAQVVFGEVAATVRALSESERPELQAMGQRLGTALPAWIESTEWLLANAKSGISGVLTAAVPYLHMATSVCGAWMMGKAALAAAARLQEQGQGDVQFYRNKIATAGFYADQILPQVEAWAATVMAGDAAIEGIGTELFD

SEQ ID NO: 1284 - protein, 596 aa, Alicycliphilus denitrificans
MSYTAPVKDMLFAIEHLARIDQVAQIPGFEDAGLETAAAVLEECAKFNEGVVAPLSVAGDRDPSSFKDGVVTTTLGFKEAFRQFAEGGWQGLQHPADFGGQGLPKTIGAACGEMLNSANLSFALCPLLTDGAIEALLTAGSDALKATYLEKLISGQWTGTMNLTEPQAGSDLALVRTRAEPQADGTYKLFGTKIFITYGEHDMAENIVHLVLARVAGAPEGVKGISLFVVPKFMVHADGSLGARNDVHCVSIEHKLGIKASPTAVLQFGDHGGAVGYLVGEENRGLEYMFIMMNAARYAVGVQGIAVAERAYQKAVQYAKDRVQSRPVDGSVAGSAAIIHHPDVRRMLMTMRAYTEGCRGMASVAAAAYDAAHHHPDAQVRKDNAAFYEFMVPLVKGYSTEMSLEVTSLGVQVHGGMGFIEETGAAQYYRDARILTIYEGTTAIQANDLVGRKTARDGGQMARAVAAQIEKTEGELIASGTADAQAVARRLGAARQAFLDAVDFIAGGAKAHPNDVYAGSVPYLMLAGNLVAGWQLARALLVAQDLSSKGQDAAFMQAKIATARFYAEHILVKAPGQRDAIVEGAASVMALPLDTF

SEQ ID NO: 1285 - protein, 608 aa, Streptomyces griseus
MGHYKSNLRDIEFNLFEVLGRDKVYGTGPFGEMDVDTAKSILDEIARLAENELADSYADADRNPPVFDPETKTAPVPASFKKSYQAFMDSEYWRLGLPEEIGGTTSPRSLIWGYAELLLGANPAVWMYSSGPAFAGILFEEGNDEQKKIAEIAVEKQWGSTMVLTEPDAGSDVGAGRTKAVRQEDGSWHIEGVKRFITSGEHDMSENIIHYVLARPEGAGPGTKGLSLFMVPKFHFDWTTGELGERNGVYATNVEHKMGLKASNTCEMTFGDQHPAKGWLIGDKHDGIRQMFRIIEFARMMVGTKAIAALSAGYLNALEYAKERVQGPDLANFMDKTAPKVTITHHPDVRRSLMTQKAYAEGMRSLVLYTASVQDAIQEQEAAGEDAKALNGLNDLLLPIVKGYGSEKSYEQLAQSLQTFGGSGYLQEYPVEQYIRDAKIDTLYEGTTAIQGQDFFFRKIVRDQGASLNTLSEEIKKFLAGAHGNEELAPALDSLAKAAVDLEAIVGTMITDLTATGEDVKNIYKVGLNTTRLLMASGDVVVGYLLLKGAAVAAEKLPTASAKDVPFYQGKIAAAKFFAANVLPGVSTERALAESVDNSLMELDEAAF

SEQ ID NO: 1286 - protein, 598 aa, Sinorhizobium meliloti; identical to SEQ ID NO: 1277

SEQ ID NO: 1287 - protein, 599 aa, Alicycliphilus denitrificans; identical to SEQ ID NO: 1283

SEQ ID NO: 1288 - protein, 596 aa, Alicycliphilus denitrificans; identical to SEQ ID NO: 1284

SEQ ID NO: 1289 - protein, 608 aa, Streptomyces griseus; identical to SEQ ID NO: 1285

SEQ ID NO: 1290 - protein, 601 aa, Acidovorax avenae; identical to SEQ ID NO: 1278

SEQ ID NO: 1291 - protein, 597 aa, Acidovorax avenae; identical to SEQ ID NO: 1279

SEQ ID NO: 1292 - protein, 631 aa, Acidovorax avenae; identical to SEQ ID NO: 1280

SEQ ID NO: 1293 - protein, 589 aa, Thiothrix nivea
MSYVHPYQDAEFVLRHIVGFDALCTDAGLDEVNTDLAVAILDEAGKMGTEVLAPLNRVGDANPAKLGGSGVEQSPGFKEAYSQFAEAGWLSLTVREEFGGQNLPNVLGTAVNEIWQSANLAYGLCPLLSQGAMESIAHHASAALQQAYLPKMATGEWTGTMNLTEPDAGSDLAAVKTRAIAEGDHYRISGQKIFITWGDHQMTPNIVHLVLARLPDAPAGVKGISLFIVPKFMLDENGEPGERNAVQCLSLEHKLGIHGSPTCVMEFDQAVGYLVGEANKGLSYMFTMMNHARQSVGLQGLAIAERAYQQARQYAKERLQGTRRDGSRIPIIQHPDVRRMLLTMKACIEAMRALAFTASAEIDRARYAQDATQKALHAARVELLTPIVKGWLTEMSQELTSLGIQVHGGMGYVEETGAAQHYRDARILTIYEGTTGIQALDFIGRKTLADQGAALLALLQEMDQVADELREITYPDQHVCKGFENALGMGVEAREWVLSHAADDAHFAGSASVNFLMLFGYLCGGWLLVSGALQAKAMLDTGAGDTDFLQAKLLSARFYCEHVLPRTGACLAALKAGSSSIMAMSEDQF

SEQ ID NO: 1294 - protein, 589 aa, Thiothrix nivea; identical to SEQ ID NO: 1293

SEQ ID NO: 1295 - protein, 536 aa, Sulfobacillus acidophilus
MDHISYAYGTNHFDQDQELKAVLRHFWADHNVHWSTLSQFGQWAGQEIYEAVYHIDHEAPPVLIAHDLDGQRIDRVRLSPAEKRILTETAWIMASPYQGQGWPYHYALLYLVGDPGIGCILTITGQTVYALNKYAQGIPDQARIQSDLLSGKAWGATWMTESQGGSDLGANQTVAEPRGDVWLLTGDKYFASGAGLNDYAITTARPQGFPAGPKGLALFLLPRLNPKGTLNYHVRRLKDKSATRAVPSGEVELNGSEAYLIGNAAEGIYYTLENLTVSRLANAVAAMATGKKAHLEVLGRVARRTSFGRLLRDHPLIRRDLTDLAVRSAAGLALTFYGIEKFDASWRDRPPYTDRYHLTRFITHLAKNRTADHAAAMTQMGMELFGGLGFLEEYAVARWHREALITPIWEGPSNIQALDFLETIQRHKVQDSFLDDLGTRLERAGTSVATQAMAVLEERLSRLASLNGREAQWYAKDGLTVIADAAQVALLYSMAQDQGERYAKLAELYAARFLDHQEYPAWVDTDQDVWGGERHA

SEQ ID NO: 1296 - protein, 418 aa, Caenorhabditis brenneri
MSSLASKLFSKCVVGRALQAQTVRQFSAYPIDDSMFGLNEEEIALRQSIRQFADKELAPFADKIDKENGWDQLRPFWKKLGDQGLLGITAPAEYGGSAMNYFSHVIAMEELSRAAGGIALSYGAHSNLCVNQICRNGSEEQKKKYLPKLISGEHMGALAMSEAQAGSDVVSMKLRAEKKGDKYILNGTKFWITNGPDADVLVVYAKTDPSKHQHGITCFLVEKNTPGFTQSPKLDKLGMRGSNTCELVFDNCEIHKSQIMGGVGKGVYVLMTGLDYERLVLSGGPLGLMQAACDIAFDYAHQRTAFGQKIGSFQLLQGKLADMYTTLNASRSYLYMVAKAADKGNVSNKDCAGVILYVAEKCTQVCLDAIQILGGNGYINDYPAGRLLRDAKLYEIGAGTSEVRRLIIGRALNKEYSN

SEQ ID NO: 1297 - protein, 418 aa, Caenorhabditis brenneri
MSSLASKLFSKCVVGRALQAQTVRQFSAYPIDDSMFGLNEEEIALRQSIRQFADKELAPFADKIDKDNGWDQLRPFWKKLGDQGLLGITAPAEYGGSAMNYFSHVIAMEELSRAAGGIALSYGAHSNLCVNQICRNGSEEQKKKYLPKLISGEHMGALAMSEAQAGSDVVSMKLRAEKKGDKYILNGTKFWITNGPDADVLVVYAKTDPSKHQHGITCFLVEKNTPGFTQSPKLDKLGMRGSNTCELVFDNCEIHESQIMGGVGKGVYVLMTGLDYERLVLSGGPLGLMQAACDIAFDYAHQRTAFGQKIGSFQLLQGKLADMYTTLNASRSYLYMVAKAADKGNVSNKDCAGVILYVAEKCTQVCLDAIQILGGNGYINDYPAGRLLRDAKLYEIGAGTSEVRRLIIGRALNKEYSN

SEQ ID NO: 1298 - protein, 635 aa, Leptonema illini
MIEDIFADRPIANPRLNESDNFNPGLEPYDLTDYTGIRGRNFFHEDQVLQRIFLREALTQDADHNRAMYRHIEGYGDLVGTILDELAEISHKENRLGYIEHFDRSGERIDEVRYCHEQIQARKISYEYGIVNLDFHRSWEHPFTMFHRMALAYLCNQDGEAGVGCPLAMTDGMIRAIKALGTPLQKELYLPLIAGPSSESYFMCGQYVTERVGGSNVGANRTLARRLEAPAGEAPGKWLLTGEKWFCSNPGDLWVTTARVDGTNRIGLFLVPRLRTDGSKNGYTLLRKKDIIGSRGKITAECLYENCEVEELGRPAHGIANLIRYVINISRIHVGAAAIGMSRRALMEALAYVRRRTAYGKRVVDFPVTKVMLAKMSILHTTVTLANFRSFKALDKKDPISELLTPMLKYISTVNATWTVRQSILLHGGNGILGDFSCLPRLLNDSVINETWEGAHPLIQEHVLKALSREKVRSALDQHIESVLARETNGGERSDLFRDLRQLYADWKQNLEQSAEWIDLNRKYITESLFYVYGLSLLIEEAVFDPALVSQKKGIPQELLWTGPEYDPLLVRPGENADRRNPEAMIRLENRIYAHMARGLIEIYRRGVDGATDPEGVFMNMKMLDGILAYMGVNE

SEQ ID NO: 1299 - protein, 573 aa, Leptonema illini
MALFHPLNETWDQYDETTRKIFRATVDFFEKKGKRALKHEDHEVIWYQDFLDFLKSEKVFYYFLTPAEYGDSADCRWDSARNTAYSEILGFYSLSHWYTWQVSILGLGPIWIGKNEEVKRKTAAKLKEGGVFAFGLSEKEHGADLIASDMMLIPENGAYVARGDKYYIGNGNCAAYVSVFGKIAGRREEFVFFVVESEHPKYECTGNVVRSQKYVAEFVLHDYPITENEILSRGRDAWDASLATVAFAKFNLGLAAIGIATHAYYEAINHASARRLYGTYVTEFPHIIQLFTEAYARLEAMRLFAYRAKDYMKEASADDRRYLLYNPMVKMKVTMQGEEVINLLWDVIAARGFEKDTYFESATRDIRMLPKLEGTAHVNMVLVIKFMQSFLFEKNRKSPPPVDFGPSQDGFLFSQGSTTKGLEQVLPGDYQAVYSRFDTPNLNIFRRQIESLKAFLAECGPDKDQSKDLDFMLTLGEIFTLVAYGHLILEQLELDTGKNPKSSDVSDLIDVIFDFMIRDFSRHSVTLYGKPSATDAQQKACLSMIERPLTGKDVFDRVSQRALSLNGSYTMPE

SEQ ID NO: 1300 - protein, 760 aa, Alicycliphilus denitrificans
MIDLSSRIDALSDDERMVRDAAAAYSSRDPEYRRVRGLRGQLPSYDAAAWRELAEMGWTGCRLPESVGGLQLGFAQLALLLEQHGRALAPEPLTAAALLGGGALLGGDNEPLKQEWLPRLAAGDWTPTLAWQEAAGSQSVQPTATRATQRDGHHVLDGRKCFVPIGETADAFIVSAAAADGCALYLVDRDAPGLAIRSQTRVDGGTWSELTLTAVPARAVVASAAVALPALERVLDEGRLAVSAELLGVMGRALEITVDYIKVREQFGKPIGSFQALQHRAVDMFVLVELSRAVVRQSAQRFDAGENANERALAASQAKARCSDAALKVAKGCVQLQGGIGYTDECNIGLFLKRAMVLAAWLGDASTHRRRYGERAGDPSEEAEASDPLRRDVRSFLAANFPPEWRFPATRMSIKETVSWQRKLAEKGWAAPGWPTEHGGTGLSAYDQLAMAEEFDRHGVSIAPNMGITMLGPLLIRYGSEEQKRNYLPRILSGELRWCQGYSEPGAGSDLAGLRTKAVLDGDEFVVNGHKIWTSFAHEADMIFMLVRTDPEAKKQEGISFLLADMKSPGITVRRIRNLGGSSEFCEVFFDNVRVPKQNLVGGLNRGWTMAKSLLGSERILIGNPRLAKAPLQLLHRLMKARGLLQQPAARARFDELRLDVEDLGASYVRMAEVLRRGDELGAEVSMLKIWITEAMQRVTDLLLEAGAEDATLDASTTLPDGTQMHIANQYFASRPATIYGGSSEIQRNILAKAMLELPG

SEQ ID NO: 1301 - protein, 635 aa, Leptonema illini; identical to SEQ ID NO: 1298

SEQ ID NO: 1302 - protein, 573 aa, Leptonema illini; identical to SEQ ID NO: 1299

SEQ ID NO: 1303 - protein, 760 aa, Alicycliphilus denitrificans; identical to SEQ ID NO: 1300

SEQ ID NO: 1304 - protein, 536 aa, Sulfobacillus acidophilus; identical to SEQ ID NO: 1295

SEQ ID NO: 1305 - protein, 830 aa, Frankia sp.
MLIELSSEQEILRDTTARYLEREAAPDALRRLRDDPEGFGRDYWRAGAELGWTALVVDDEFGGGSVSGSPVVDLSLIAYEFGTHAAPGPLVATNVVAAALSRALTAAAAAGRSDAASGHAEVLDALLAGEAVGAWCLAEPAPHDRLGTVTLTVRADGDEVVLDGVKRPVEAAAWASHLLVTGRTGDGLTQVLVPADAAGVTVTPMHSLDLTRRFAAVTFDGVRLPRAAVVGEFAGSDEDVRRQLQLALVLVTAEMVGALQRAFDMTVDWAFDRYSFGRPLASYQALKHRFADMKMWLEATHAAVDAAAAAVDAGSPQADELVSVAKALGEPGVELLQDCVQLHGGIGITFEHDLHLFLRRGAVNRALFGTPDEHLGRLAAVAIAQAAAPSDDTQPQEAPAAQGAGPVAARANAAGDLEDLDSFRERARRFIQGNLKQDETVRTLRRTLTDEQELAEVARARKLQRMLFDAGLAGITFPREYGGQGLTAAHQEVLNEELAGYEFPRHLQVPTLSPCAAVILEFGTEEQKLRHLPAILRGDEIWIQFLSEPSGGSDVAGALMSAVREGDEWVLNGSKIWSTGAWWSDWALCLARTNWDVPKHRGLSVFMLPIHQPGIEISRIEMLNGSMEFCQEYLTDVRVPDSERLGDVDGGWTVGTSWMMYERQANNSPFTTRPSHTRRGSAGIDAPLVPIAARLGRLDDPRTRELIGEARLLSVVREQLNRRLAAGMTTGRMHSQSSAIGRLFAGHFGTRRDTITFEIAGGIGAAWTDDDPAAGCGLDYLVRTISTVAGGSTEIARNVISERVLGMPREAAPDHGIPFRNVPRGGRTRS

SEQ ID NO: 1306 - protein, 830 aa, Frankia sp.; identical to SEQ ID NO: 1305

SEQ ID NO: 1307 - protein, 408 aa, Caenorhabditis remanei
MTNMVNKAQGLGLNLITKIAGSDLLDQFKLRKFIERSLYQGSKAGFKTLSATQKAFKSDSNVTKQRLPNQQKSLFDLSLTEEQQMTVDAMDQFASEVLYQLAHQADHDEKFPVELWQHSTDLGLNYYALPEVIFHLLQVCSLLLVSSMQSHNGGSEKVQSVYLANFANDTDIQATFAVQEATPAFNPLRLKTKATANNGQFSITGEKTLVLLGATADLFLVSADFKGQADVFVVKRDPSITVKKSPAMGLKATETVTLKFDNTPAQRLGDEDFNYPAFLDLGNLMWCAMAVGSCEAVKDYSIKYANERTAFGEPISHRQSVAFMIADMAIEIDAMRMLILNAASLAEAGQPFHREAYLARLLCAEKSMKIATDGVQILGGHGFTKEHPAERWYRDLRATAVLHSGLHA

SEQ ID NO: 1308 - protein, 408 aa, Caenorhabditis remanei; identical to SEQ ID NO: 1307

SEQ ID NO: 1309 - protein, 462 aa, Arabidopsis thaliana
MEKAIERQRVLLEHLRPSSSSSHNYEASLSASACLAGDSAAYQRTSLYGDDVVIVAAHRTPLCKSKRGNFKDTYPDDLLAPVLRALIEKTNLNPSEVGDIVVGTVLAPGSQRASECRMAAFYAGFPETVAVRTVNRQCSSGLQAVADVAAAIKAGFYDIGIGAGLESMTTNPMAWEGSVNPAVKKFAQAQNCLLPMGVTSENVAQRFGVSRQEQDQAAVDSHRKAAAATAAGKFKDEIIPVKTKLVDPKTGDEKPITVSVDDGIRPTTTLASLGKLKPVFKKDGTTTAGNSSQVSDGAGAVLLMKRSVAMQKGLPVLGVFRTFAAVGVDPAIMGIGPAVAIPAAVKAAGLELDDIDLFEINEAFASQFVYCRNKLGLDPEKINVNGGAMAIGHPLGATGARCVATLLHEMKRRGKDCRFGVVSMCIGTGMGAAAVFERGDGVDELRNARKVEAQGLLSKDAR

SEQ ID NO: 1310 - protein, 591 aa, Pseudonocardia dioxanivorans
MTYHPPFRDMRFALHEVLDTASVLSSAGIEIDRDTIDGVLEGAGEICARVIAPLNGPGDVQGVRRDDEGVHTPDGFQEAYERYVAGGWPSVDADEHHGGGGLPLVVGSLIKEMLASANPSWALYTSLSAGVYRCINANADEELKQAFLPNLASGRWTGTMCLTEPHCGTDLGLLTTRAVPRGDGAYRISGTKIFITSGDHDLTDNIVHLVLARTPDAPAGTRGISLFAVPKRRITDDGEPGPANGVHCDGLESKMGLHGSATCVLRFDDAVGHLVGEESRGLAAMFVMMNGARLGTGVMALGVAETAGQAALAFSRERLQSRAPGSLHDPAQPADPIIDQPDVRRMLLTQQAWVGGSRLFLYWLSLQTDLRREATDLGVRVQADDLLSLLTPVAKAFVSDRAVEVSSLAMQVLGGAGYITDNGVEQSLRDARILPIYEGTNGVQAHDLLARKVIGDGGRRMKQLLEMVSQFTDRIAGTPELAPFGTALSTLTEQIRELNTELIAGAEQDELRVGTSAVDYLDLVGHYLIAWFWAQAAETVVTLGDAATAYHERQLALAHFYIDKMLPTTAALVLRARSSTAVLMNPAAIAG

SEQ ID NO: 1311 - protein, 493 aa, Caenorhabditis brenneri
MHRAIFRLQKLPKYTVRSLSNAVKPEKPEKIAEISEKSKYAIRTLDNSAPIEKRSLSRGFAMNKFEKDFMIYPEYTDSDDLRNIDGFVDVLRKSLELSVNSKQIEKDRNLSPEILETLRSNAIFSCSIGKPFGGIQMNQKDISKVFEELSIDFNVFSTAHISLIVSNLLTIYGSDEQKSKYLRLISEGKLRPSIAIVKDTNGGRVEMTQGPSGKSMIEGQNLRVIGHHNANFYVVFANNAGSQTCFLLDESELGTTDTIKFQRDETIGLKGIDIGRIELTALVSDKHVLGQTGGGAEIAAEMSGSGRMPFAAATVGMAKRALRELSLWCNRTPSRRTDRSTLADDTRSQRIVTDLALKVYALESSLYYLSGLIDEGLSIVVDIENSLISMLTRDVLQSIISCQLELVGVASSDSAFPHEKIFRDITTLLATLDESPDIEQIGLATIATWATSTSHKRIVSTLKRWLKQEKEADEMRNPGLTHYIAEHAHPSLQ

SEQ ID NO: 1312 - protein, 598 aa, Sinorhizobium meliloti
MPIYKAPVDDTLFILNDVLGIERYHNLPGFADVTPDMTAAILGEAAKLAEEVLFPINLSGDQEGCKRHEDGSVTVPKGFKEAYDLYREGGWLGLAAPEEFGGQGLPYTLHTAVGEFMSAANMSLMMYPGLTQGAIAAILVHGSEEQKRAYLPKMVDGTWTGTMNLTEPHCGTDLGLLRTKAVPNGDGSYRISGQKIFISAGEHDMAENVVHLVLARIEGAPDGVKGISLFIVPKFKLDASGEPGERNGVSCGAIEHKMGIHGNATCVMNYDEATGYLIGTENKGLSAMFVMMNEARLAVGMQGLSIAEVAYQNAASYARERIQGRSLSGPKAPDKKADPIIVHPDIRRTLMTIRAFNEGGRAFTLWTALKSDIAHRSDSEEERQTADDILSLMTPILKGVLTDKGFDHAVMAQQVFGGHGYIEEHGMSQYVRDARIAMIYEGANGIQALDLVGRKLAMNGGRAVMALFKEIGDFCEENRGDEKLSGYTKALKKGLNDLQAATMWFMQNAMAKPDNAGAGSTDYMHLFGLVVLGYMWARMAKTAEEKLAAGETQRADYLKNKLITARFFMERILPETELRKIRIETGADTMMALDAAAF

SEQ ID NO: 1313 - protein, 600 aa, Sphingobium chlorophenolicum
MPSYTAPVRDTRFVLDHVVGLDRHANLPGFENATADLVEAILTEGGKIAAEVLFPLNAVGDKEGCTRHPDGSVTTPTGFKAAYDAYVEGGWTTLHAPAEFGGQGLPIVVATAVSEYMVAANQSFKMYDGLTNGAVEALIAKGSDEQKQTYIPNMVSGKWSGTMNLTEPHCGTDLGLIKTRAVPQADGSYIITGTKIFISAGEHDLTENIIHLVLAKTPDAPEGSKGISLFVVPKFLLNVDGSPGERNALSCGSLEHKMGIHGNATCVMNYDGATGWLVGEENKGLAAMFIMMNAARLGVGLQGLGQAEIAYQNAALYAHERRQGRALTGPKDLDEKADTLFVHPDVRRMLMEAKALTEGLRALMLWGALQVDLAHHAATEEERQAADDLLQLLTPVIKGYGTDKGFDVAVTAQQVFGGHGYIWENGVEQFVRDARIAQIYEGTNGIQAMDLVGRKLAMNGGRALQSFLKIVADEVADAKGDEKLAPLAEALEKASGQLGAATMWLMQNAMKNPDNAGAGAVHYMHILGIVATGLMWLRMAKAATSLLAAGAEDAPFLEAKLVTARFFAERILPDAGALRRKIEGGAESLMALDPEMFLPA

SEQ ID NO: 1314 - protein, 596 aa, Stenotrophomonas maltophilia
MSSYTAPLSDLRFALHDVLKVEPLFARLGFTDATADVVDAVLEEAGRFSATVLAPLNSVGDEIGCVLDQATGEVTTPPGFKQAYDQFVDGGWTGLTASPELGGQGLPHTLGVPLNEMINAANLAWGNFPLLSHGAIEALKQHGEAWQHEAFLKPLIEGRWTGTMCLTEPHCGTDLGLLKTKAEPNADGSYSITGTKIFITAGEHDLTGNIVHLVLAKLPDAPPGAKGISLFVTPKFKVDREGNVGERNALRCGSIEHKMGIKGSVTCVMNFDGAQGYLVGQPHKGLQAMFTMMNTARLGVGLQGIGLSERAYQNALKYSRERLQSRALSGARFPDKPADPILVHPDVRRMLLTVKSLVEGSRLLALHAATLIDVAHHAEDAAERERADTLVSFLTPISKACQTEWGIENTYNALQCFGGHGYIREHGMEQLARDARITTLYEGTTGIQALDLIGRKTASSQGAGLKLMLAEIEAFAKEHEGNEALAEFIGPLRAKAAEWGKLTLDVLQRAAANPDELGAASYDYLFYSGYVVLAYWWARSVAAADASAHGAAFAQGKRETARFYFARVLPRTLSHAAAIQAGAAPLMAMDDERFGA

SEQ ID NO: 1315 - protein, 597 aa, Runella slithyformis
MAQYYSRRNLNFLLYEVFNATELTHYPYYSAHDRETFDMTIDAVTQIGDTLMFPHFRDLDRNQPELKNGKVTVHPKVGEYLKAMGDAGLIGTGFSFEDGGQQLPEIVNSVLGFILMAANNGMMYTGLTSGAARLIATFASEELKQTYVEKMLGGKWQGTMALTEPQAGSSLSDITTSATPQADGSYRIKGQKVFISAGDHDQCENIIHLMLARIDGAPKGTKGISLFVVPKYRLDGADNDVTSTGIYHKLGQRGVPAMHLTMGDNDDCHGWLVGEPHRGLNYMFQMMNEARIGVGMTGAAIASAAYEASLQYAKERPQSRRLNQKTALDSPQIPIIQHPDVKRMLLLQKAVVEGSLSLLMETARCADIAHASEDPEEKEKYHLMLELLTPVAKTYPTEMGMVAVSNGLQVLGGYGFTEDFPLEQLYRDIRITPIYEGTTGIQSQDLLGRKMTMKGGKPVQFLFGEVAKTIAEAETHENLKPYAQKLKAELGRLQEVTMALMPFAMQGDIERFLMDATLYMEMFGINTIAWQWLKQAVVAQRTIVTQNPDGEELAFYEGKIHTMKFFFHYEVPKTLGLAVRLKDNEVLTIATEKEVVL

SEQ ID NO: 1316 - protein, 452 aa, Pedobacter saltans
MSNIFSKAANIYNLFKSIDFKQLEALSKKVDLEEVMAQFGKMDEKQLAGLMKMMKGGGKKKELPPIDADFYDLSGKLSPEDRELQMKVRQFMETEVKPIVNRYWNRAEFPFDIIPKVAELNICGITFEGYGCPNRSFLMEGIIASEMGRIDASIATFFGVQSGLAMGSIYVCGSEEQKQKWLPRMQKLELIGSFGLTEPEVGSAAAGGLTVTAKREGNKWILNGQKKWIGNATFADVNIIWARDLDDNQVKGFIVEKGNSGFKADKIENKMALRIVQNGLITLTNCEVTEENRLQNCNSFKDVAKVLRMTRAGVAWMAVGCARGAYESALKYTRERIQFGRPIASFQLIQNHLVEMLSNLTAMQTLVYRLSELQDNNQLTDEHASLAKVFCTLRMRDVVSRAREVMGGNGILLEYDVARFVADAEAIYSYEGTKEINSLIVGRAITGFSAFV

SEQ ID NO: 1317 - protein, 585 aa, Shewanella baltica
MNPYQAPLTDMRFLLEQVFDAPNTWAQLPEIAEMVDIDTANAILEEAAKISSELIHPLNRTGDEQGVLHQDNQVITPDGYKAVYEQYSQGGWIGLCGDPEFGGMGMPKMLGILVDEMAYSACNAFTLYGSLTAGAALCINAHGSEELKQAYLPKLYSGEWAGAMDMTEPQAGSDLRNIRTRALPQDDGSYAITGSKIFITGGDHDLTENVIHLVLAKLPDSKGISLFLVPKISVNTDGSLANANGVSVGSIEHKMGLKGSATCVMNFDNAQGFLIGEPNRGLVCMFTMMNYERLAIGIQGLGSAQAAYQMAADYAKERNQGVAAGGSPTGSESDPIIVHGDVRRMLLTIRAMTEAGRALSVFTGQQLDLAKYAQDEVKAKAARYVGLLTPVAKAFLTDRGLDATIMAQQVFGGHGYIRETGIEQLVRDTRIAQIYEGTNGIQAIDFLGRKVTGDNLAALNEFVADLKAQMRAFTHVDAVKVAAVCARLDALVIVAESINEHKVAQPALINACAVDFLDAFGYTLYGFYWLAMVDKVADHEDKAFAEQKAYLAKFYFDKLLPKADYHIAQVRAGDATTMAMPAELF

SEQ ID NO: 1318 - protein, 650 aa, Shewanella baltica
MRSIYGFAVRLCKQKSVAAVGVLSFSANLAKVVRAPKWSDHLVELQSNKKREAIMPVYQAPLRDYQFILNEMLHIYQQDALKGFDEIDPDLVDAILQGMADFSTEVMLPLNSIGDLQGCKLVDGKVITPEGFDNAYRQFVDNGWPTLTCDPEYGGQGLPEVVGIFATEIQTATNMAFAMYPGLTHGAYAAIHAHGSDALKQKYLSKLVSGEWTGTMNLTESHAGTDLALLRTKAVPVSEGVFAITGEKIFISSGDHQLTDNIVHLVLARLPDAPEGVKGISLFAVPKVLVNSDGSLGAPNTLYASGLEHKMGIHGNSTCVMVFEAALGELVGEPHQGLRAMFTMMNQARLGVGVQGLGVSEIAYQNALAYAKDRLQSRALSGAKAPEKAADPILVHGDVRRMLLSQKAFNEGARALVGQQALWLDEAERHTDPAKAKAASQLAALFTPVVKGFITNRGFNACVDAQQVFGGHGYIHEWGMEQFVRDSRIALIYEGTNGIQALDLVGRKLLSDRGAAMQQWSALVTEFIKSHSTNAAMQPYVSGLMDCAGDLQKASGYLATHAATNPDIIGAASMAYLELFGVTALAWMWARSAAVALAALEQGTEETAFYQAKLKTADFYMAYWAVQGRSLRKQIEQASEMLTQLDEAIF

SEQ ID NO: 1319 - protein, 596 aa, Methylobacterium extorquens
MPSYRAPVEDTLFLLNDVLAIHRYDNLPGFADASADLAQAVLSEGGRLAGEVFAPLNLSGDREGCARREDGSVVTPKGFKAAYDAYAAGGWMGLSLPEEFGGQGLPHVLNTAMQEFVSGANLALSMYPGLTQGAIAALLVHGSPEQKATYLPKMVEGAWTGTMNLTEPHCGTDLGLLKTKAVPNGDGSYSLTGTKIFISAGEHDLSENIVHLVIARIEGAPSGTKGISLFVVPKFLVNADGSVGERNAVACGSIEHKMGIHANSTCVMNYDGAKGWLVGQENRGLAAMFVMMNEARLAVGVQGLGQSEAAYQNAVTYAQERLQGRSLTGAKAPDKAADPIIVHPDVRRTLMQIRAFNEAARALMLWTALNSDIAHRSQDAAERQAAEDMLGLMTPVVKGVLTDRGFANAVEAQQMFGGHGYVEEWGMSQFVRDARIAMIYEGANGIQAMDLIGRKLPKDGGRAMMAFLTEVQTFIKDHGEDEGMKPFVAPLQPALNDLQAAVMWLMQNAFSKPDNAGAAATDLMHLLGQVVLGYMWAKIARAALAKKAEGADVERMDAKLVLGRFFMERMLPETSLRLARIKAGAETTMALPAEAF

SEQ ID NO: 1320 - protein, 585 aa, Shewanella baltica
MNPYQAPLTDMRFLLEQVFDAPNTWAQLPEIAEMVDIDTANAILEEAAKISSELIHPLNRTGDEQGVLHQDNQVITPDGYKAVYEQYSQGGWIGLCGDPEFGGMGMPKMLGILVDEMAYSACNAFTLYGSLTAGAALCINAHGSEALKQAYLPKLYSGEWAGAMDMTEPQAGSDLRNIRTRALPQDDGSYAITGSKIFITGGDHDLTENVIHLVLAKLPDSKGISLFLVPKISVNTDGSLANANGVSVGSIEHKMGLKGSATCVMNFDNAQGFLIGEPNRGLVCMFTMMNYERLAIGIQGLGSAQAAYQMAADYAKERNQGVAAGGSPTGSESDPIIVHGDVRRMLLTIRAMTEAGRALSVFTGQQLDLAKYAQDEVKAKAARYVGLLTPVAKAFLTDRGLDATIMAQQVFGGHGYIRETGIEQLVRDTRIAQIYEGTNGIQAIDFLGRKVTGDNLAALNEFVADLKAQMRAFTHVDAVKVAAVCARLDALVIVAESINEHKVAQPALINACAVDFLDAFGYTLYGFYWLAMVDKVADHEDKVFAEQKAYLAKFYFDKLLPKADYHIAQVRAGDATTMAMPAEFF

SEQ ID NO: 1321 - protein, 596 aa, Shewanella baltica
MPVYQAPLRDYQFILNEMLHIYQQDALKGFDEIDPDLVDAILQGMADFSTEVMLPLNSVGDLQGCKLVDGKVITPEGFDNAYQQFVDNGWPTLTCDPEYGGQGLPEVVGIFATEIQTATNMAFAMYPGLTHGAYAAIHAHGSDALKQKYLSKLVSGEWTGTMNLTESHAGTDLALLRTKAVPVSEGVFAITGEKIFISSGDHQLTDNIVHLVLARLPDAPEGVKGISLFAVPKVLVNSDGSLGAPNTLYASGLEHKMGIHGNSTCVMVFEAALGELVGEPHQGLRAMFTMMNQARLGVGVQGLGVSEIAYQNALAYAKDRLQSRALSGAKAPEKAADPILVHGDVRRMLLSQKAFNEGARALVGQQALWLDEAERHTDPAKAKAASQLAALFTPVVKGFITNRGFNACVDAQQVFGGHGYIHEWGMEQFVRDSRIALIYEGTNGIQALDLVGRKLLSDRGAAMQQWSALVTEFIKSHSTNAAMQPYVSGLMDCAGDLQKASGYLATHAATNPDIIGAASMAYLELFGVTALAWMWARSAAVALAALEQGTEETAFYQAKLKTADFYMAYWAVQGRSLRKQIEQASEMLTQLDEAIF

SEQ ID NO: 1322 - protein, 650 aa, Shewanella baltica; identical to SEQ ID NO: 1318

SEQ ID NO: 1323 - protein, 585 aa, Shewanella baltica; identical to SEQ ID NO: 1317

SEQ ID NO: 1324 - protein, 585 aa, Shewanella baltica; identical to SEQ ID NO: 1317

SEQ ID NO: 1325 - protein, 650 aa, Shewanella baltica; identical to SEQ ID NO: 1318

SEQ ID NO: 1326 - protein, 594 aa, Alicycliphilus denitrificans
MSTYAAPVRDMLFTMKEIGGLDAICTQPSHEETTPDLVEAILHEAASYAAGVLDPLNRSGDQQGARWHDGAVSSADGFGDAWKSFCDNGWAGMPAAAEWGGQGLPVLVSTAVLEMWKSSNLAFSLCQMLTLGAVEAIAHHGSDALKRRFLEPMVAGRWTGTMNLTEPQAGSDLAALRSRAMPEGDHYRVSGNKIFITWGEHDMAENIVHLVLARLPDAPAGVKGISLFLCPKFLANDDGTLGERNDLACTSIEHKLGIHASPTASMCFGERGGAIGYLIGEPHQGLACMFTMMNHARLNVGLEGVGVSERAYQHARAYALERVQGRPALAGSGTIAGHPDVRRMLMDMKARTEAMRALAYFCAGQMDRAAGHPDAQERTRAQALVGLLTPVVKGWCTDNALGIASDGMQVHGGMGYVEETGAAQYLRDARITTIYEGTTGIQANDLIGRKLAREGGATLKALLRRIDADAHRLIESPGPALAQIGGALAAAAHALEQATDWLLAHSDAQPQHCAAGAVPFLRLAGTVIGGWLSARMAEAAAAQLAAGTGDAGFLAAKLATGSHYAAHVLVQALMLRDIVTGGAGSTLALAVDQL

SEQ ID NO: 1327 - protein, 598 aa, Alicycliphilus denitrificans
MPTYNPPLRDMQFVLHEVFQVSDEFKAMPRHADVDADTINAVLEEAGKFAAEVTFPLNVSGDTEGCTLDQQTHEVTTPKGFKEAYAKYVEGGWAALSCDPEYGGQGLPHVVNQCLYEMLNSANQAWTMYPGLSHGAYEALLAHGTDAQKKTYLPKLVSGEWTGTMCLTEPHCGTDLGLLRTKAEPQADGTYRITGNKIFISAGEHDVAANIVHLVLARLPDAPKGSKGISLFVVPKFHVNADGSLGARNPIYCTGLEHKMGIHGNATAQIAIDGAVGTMVGEPNKGLAAMFVMMNAARLGVGNQSLGLTEVAFQNALAYAKDRLQMRSLSGVKAKDKEADPIIVHPDVRKMLLTAKAYAEGARALQIYCTLLLDKAHHHPDEKERKGCDELVALLTPIVKAFITDNGHIATNACMQVFGGHGFIKEWGMEQFVRDNRINMIYEGTNTVQSLDLLGRKVLGNQGATLKKLGKLIGQLVAEEGVNEKMAEFINPIAILGEQMTKFTTEIGFKGMQNPDEVGAAAVDYLRVAGHLVFGYLFARMAQVSLRAIAAGSQDPFYVAKLQTARFYFAKLFPETVTLMRTARAGAKVLMDTDAALA

SEQ ID NO: 1328 - protein, 597 aa, Rhizobium sp.
MPVYKAPVNDTLFILNDVLGFDRYNNLPGFEDATPDMVEAIVGEAAKLAEEQLFPLNLSGDQEGCTRHDDATVSVPKGFKEAYDAYCQSGWLGLAVPPEFGGQGLPYTLHVAVGEYMSSANMALMMYPGLTQGAIAAILVHGSDAQKQTYLPKMVEGTWSGTMNLTEPHCGTDLGLLRTKADPQADGSYKISGQKIFISAGEHGMTDNIIHLVLARIEGAPEGTKGISLFIVPKFMVGDDGSVGARNAATCGAIEHKMGIHGNSTCVMNYDEATGYLIGAENKGLSAMFVMMNEARLGVGLQGLSIAEIAYQNAANYARERIQGRSLSGVKASEKKADPLIVHPDIRRTLLTIKSFNEAGRAFTLWTALKSDVAHRSGDAAEKQTADDILGLMTPILKGVLTDKGFDHAVMAQQVFGGHGYIEEHGMSQYVRDARIAMIYEGANGIQALDLVGRKLGANGGRAVMALFKEIGDFCEENRVDESLSFYTKSLKKGLNDLQAATMWFMQNAMAKPDNAGAGSTDYMHLFGVVVLGYMWAKMAKAANEALAAGTGDADFYRNKLLTGRFYMEKVMPETALRKTRIEAGADSLMEMAADAF

SEQ ID NO: 1329 - protein, 599 aa, Pseudomonas fulva
MSDTLLSARNLAFELYEVLDAEALSQRPRFSEHNRETFDAALGTARSIAENLFAPHNRKNDEHEPQYVDGGAKLIAEVKPALQAFNEAGFLNATRDFELGGMQLPNLLSQACFAHFQAANIATASYPLLSMAAANLIEAFGDDVQKRRFLQPIIDGRFFGTMALTEPHAGSSLADIRTRAEPAGDGSYRLKGNKIFISGGDHDLSENIVHLVLARLPDAPAGVKGISLFIVPKFLVNDDGSLGARNDVTLAGLFHKMGWRGTTSTALNFGDQGNCVGYLVGKPHAGLAYMFQMMNEARIGVGMGAVMLGYAGYLYALDYARQRPQGRLPDAKQAGGQVAIIEHADVRRMLLAQKAYVEGGFDLVLYCARLVDDSQTLEDAGQREEAAQLLDLLTPIAKSWPSEYCLQANALAIQILGGHGYTRDHPVEQYYRDNRLNPIHEGTHGIQSLDLLGRKVGQHGGAGLQALRQRILDTCQRAEPFSELDALRQPLQTLLERLSEITLGLLGDLQQGRINTALADSALYLKVFGHLVLGWRWLEQAVRAEQGRLADHGADADFYEGKLQAARYFLLREVPSCHHDLDILARRDDTCLAMQGAWF

SEQ ID NO: 1330 - protein, 579 aa, Pseudomonas fulva
MWQYKAPLRDMRFVLEHWLQAPAVWAELPAFTDVDLPLALQVLEEAARFSSGVLAPLNASGDRQGCRWQAGEVGTPDGFAAAYRAYVEGGWPALACAPEHGGQGLPQLLDAALQEMLYASNHAWAMYTGIAHGAYLCLRANAPQALRERYLPVIVSGEILPTMCLTEPQAGSDVGLLRCRAELQGDGSYRLTGSKLFISGGEHDLTDDILHLVLARLPDAPASTRGISLFLVPKRLDDGRRNAVRCDGIEHKMGIKGSATCSLSFDSAQGWLIGEANRGLAALFVMMNSARLHVGLQGLGHAEAAWQNAADYARERQQMRAPRRPKGVAAAAVDPIHYHPAMRLALLRLRTVSQGLRAIGYWGAHLLDQAEHAEQEAEREQAARLAGLLTPVIKAFFTDQGFNLASEALQVFGGYGYTGEYAIEQTLRDSRIAMIYEGSNEIQANDLLLRKVLGDGCVALDELLAVFEQEAAAGGEYAERLNALCAKWRGLVSGIFNHAQGDDEYPYRIAGDFLHLLGWSLLAFAWARSARLAALLRAEDPWYQEKLDSAAFFFTYLLPETELRLARIDAARAPLAFLS

SEQ ID NO: 1331 - protein, 601 aa, Pseudomonas fulva
MPDYKAPLRDIRFVRDELLGYDAHYQSLPGCQDATPDMVDAILEEGAKFCEQVLSPLNRVGDTEGCTWSESGVKTPTGFKEAYKQFVEGGWPSLAHDVEHGGQGLPESLGLAVSEMVGTANWSWGMYPGLSHGAMNTISAHGTEEQQHTYLTKLVSGEWTGTMCLTEPHCGTDLGMLRTKAEPKADGSYSISGTKIFISAGEHDMADNIVHIVLARLPDAPAGTKGISLFIVPKFLPNAEGGVGERNGVTCGSIEHKMGIHGNATCVMNFDSATGFLIGPPNKGLNCMFTFMNTARLGTALQGLAHAELGFQGGIKYARERLQMRSLTGPKAPDKAADPIIVHPDVRRMLLTMKAFAEGNRAMVYFTAKQVDIVKYAQDEEQKKAADGLLAFLTPIAKAFMTEVGFESASHGMQIYGGHGFISEWGMEQNLRDCRISMMYEGTTGVQALDLLGRKVLMTQGEALKGFTKIVHKFCQANEGNEALKAFVEPLAKLNKEWGEVTMKIGMAAMKDREEVGAASVDYLMYSGYACLAYFWADMARVAAEKIASGEGDQAFYKAKLQTAQFYYARILPRTRTHVAAMLSGASNLMDMSEEDFALSY

SEQ ID NO: 1332 - protein, 591 aa, Pseudomonas fulva
MADYKAPLRDMRFVLNEVFQVSKLWAQLPALAEVVDEETANAILEEAGKITAGMIAPLNRASDEEGCTWANTEVRTPAGFIEAYRAYAEGGWVGVGGDPQFGGMGMPKVISAQVEEMVNSSSLSFGLYPMLTAGACLSINAHASEELKQTYLPNMYAGVWAGSMCLTEPHAGTDLGIIRTKAEPQADGSYKVSGTKIFITGGEHDLTENIIHLVLAKLPDAPAGPKGISLFLVPKFMVNADGSLGERNAVSCGSIEHKMGIKASSTCVMNFDGATGYIIDAPNRGLAAMFTMMNYERLGVGIQGLSTGERSYQSAIEYARERIQSRAPTGAVAKDKAADPIIVHPDVRRMLLTMKAFNEGGRAFSSYVAMQLDTAKYSEDEATRKRAEELVALLTPVAKAFLTDLGLETTIHGQQVFGGHGYVREWGQEQLVRDCRITQIYEGTNGIQALDLVGRKIVANGGAFCQHFTEEVRAFASDVALAEEFKAPLLEAVEILETQTAALLARAQGNPNEIGAASVEYLHLFGYTAYAYMWAMMAKAAQGKEGQDDFYASKLGTARFYFARLLPRIHSLNASVGAGSDSLYLLAAEQF

SEQ ID NO: 1333 - protein, 596 aa, Stenotrophomonas maltophilia; identical to SEQ ID NO: 1314

SEQ ID NO: 1334 - protein, 598 aa, Sinorhizobium meliloti; identical to SEQ ID NO: 1312

SEQ ID NO: 1335 - protein, 601 aa, Delftia sp.
MPSYNPPLRDMQFLMHEVFKVTDDYQQMTAHAEVDADTINAVLEEAGKFAANVTFPLNISGDAEGCVLNKETHEVTTPKGFKEAYQKYVEGGWPSLSCDTAYGGQGLPFAVNSAVYEMLNSANQAWTMYPGLSHGAYEALHVHGTEEQKKLYLPKLTSGEWTGTMCLTEPHCGTDLGLLRTKAEPVAGAPEGTYKITGNKIFISAGEHDFTDNIVHLVLARLPDAPVGSKGISLFVVPKFVVKADGSLGERNPIFCGALEHKMGIHGNATAQINIDGAIGTLVGQPNKGLQAMFVMMNAARLGVGNQSLGLTEVAYQNALAYAKDRLQMRSLSGTKAKDKPADPIIVHPDVRRMLLTAKAYAEGGRALVTYCAFLIDKEFNHPDEKVRKDSAELVALLTPIVKAFITDNGWTATTMSQQVYGGHGFITEWGMEQFVRDARINMIYEGTNGIQALDLLGRKVLGNQGASLKKFGKLVAQLVEEEGVNEKMAEFINPIAYLGDQMTKFTTEIGFKGMQNPDEVGAASVDYLRVAGHLVFGYFFARMAQVALREIAKGNTDPFYQAKLQTARFYFAKLLPETATLMRTARAGSKSLMDTDAALA

SEQ ID NO: 1336 - protein, 596 aa, Delftia sp.
MTYSAPLKDMLFAMEHLAQIDQVAQLPGFEEAGLETAQAVLEECAKLCEGVVAPLNLPGDVAPSSLKDGVVTTTAGFKQAFRQYAEGGWQGLQHPQDFGGQGLPKTIGAACVEMLNSANLSFALCPLLTDGAIEALLTAGSDELKATYLEKLVTGEWTGTMNLTEPQAGSDLALVRTKADPQPDGSYKVFGTKIFITYGEHDMAENIVHLVLARVAGAPEGVKGISLFVVPKFLVNKDGSLGARNDVHCVSIEHKMGIKASPTAVLQYGDNGGAIGYLVGEENRGLEYMFIMMNAARYAVGVQGIAVAERAYQHAVAYARERVQSRPVDGSVKASATIIHHPDVRRMLMTMRAYTEGCRAMAATAAAAYDASHHHADAQVREANAAFYEFMVPLVKGYSTEMSLEVTSLGVQVHGGMGFIEETGAAQYYRDAKILTIYEGTTAIQANDLVGRKTARDGGQTALAIAGQIEKTEAELAASGTPEALAVARQLAAARQAFVEAVHFVSGQAKAEPNAVYAGSVPYLMLAGNLVAGWQMGRALLVAEQLLHKGQDEAFMRAKIATARFYAEHILVKAAGLRDAIVHGGDSVMALPMDAF

SEQ ID NO: 1337 - protein, 596 aa, Delftia sp.
MSAQASHCSHYQPPLEDIRFVQQHWLSAEADWRRMPAHEALDQETADMVVEAAGRFCADVLAPLNGTADLQGCRLEEGRVRTPDGFPEAYAAFVEAGWPALACAPEAGGQGLPQLLDAALHEMLASANHGWTMYPGILHGAYACLHAHGDAHLRATYLPHIVSGRWLATMCLTEPQAGSDLGLLRSQARPRGDGSYRLDGSKIFISGGDQDMSENIVHLVLARLPDAPAGTRGLSLFLAPRGIPQDGGGFLPNAIHCDGIEKKMGIKGSATCAMRFEGAQAWLVGQPHQGLAAMFVMMNSARLHVGLQGLGHAEMAWQLARAYAAERRQMRAQPRPADAQGPADPIALQPAVQRMLGDLRVWTEGMRAIAGWVAHQLDLAEQAPDAAERAQAHALASLLTPVVKSFFTERGFALASEALQVFGGYGYVHEYRIEQTLRDARIAMIYEGTNQIQALDLLQRKVAASGGAALAPLLAALREEAAACEAAGMEPGLAGALRSWSDRTEALTGALCARAAGDAPLLARCAEDYLRLVGTLCMAFAWARAARVSQPLADPALRRSKADSAAWFFAHGLLDAEHWLRRTESAARTPLPAAVA

SEQ ID NO: 1338 - protein, 601 aa, Marinomonas posidonica
MPEYKAPLRDIKFVTEEVLDIYGHYAKLPGAEEATPDMVSAILEEGAKFAERVLSPLNRVGDQQGCQFNDGDVTTPEGFKEAYQQYVEGGWPSLSHPEDMGGQGLPDSLGMLVTEMIATANWSWGMYPGLSHGAMNTIEQHGTEEQRQTYLSKLVSGEWTGTMCLTEPHCGTDLGMLKTKAEPKEDGSYAISGTKIFISAGEHDMADNIVHIVLARLPDAPAGTKGISLFIVPKFNVDASGEKADKNQVSCGSIEHKMGIHGNATCVMNFDGATGFLIGPPNRGLNCMFTFMNTARLGTAMQGLAHSEWALQNSVAYAKDRLQMRSLSGPKAPEKAADPIIVHPDVRRMLLTQKAFAEGGRALIHYCSMLVDSTKHGTDDEKAEADELMSLLTPIAKAFLTETGFEAANQGLQVFGGHGFIAEWGMEQNVRDCRISMLYEGTTGIQALDLLGRKVLMTQGATLRRFTKIVHKFCKEHKGDKRFKSYITALDKLNSEWGDVTMKIGMKAMRNKEEVGAASVDYLMFSGYVVLAYFWARMAVTARTKLAEGTDEVGFYTAKLQTATFYYERILPRTKAHAEAMLSGADNLLAMEEDNFLFLNA

SEQ ID NO: 1339 - protein, 599 aa, Pseudomonas fulva; identical to SEQ ID NO: 1329

SEQ ID NO: 1340 - protein, 579 aa, Pseudomonas fulva; identical to SEQ ID NO: 1330

SEQ ID NO: 1341 - protein, 601 aa, Pseudomonas fulva; identical to SEQ ID NO: 1331

SEQ ID NO: 1342 - protein, 591 aa, Pseudomonas fulva; identical to SEQ ID NO: 1332

SEQ ID NO: 1343 - protein, 594 aa, Alicycliphilus denitrificans; identical to SEQ ID NO: 1326

SEQ ID NO: 1344 - protein, 598 aa, Alicycliphilus denitrificans; identical to SEQ ID NO: 1327

SEQ ID NO: 1345 - protein, 600 aa, Marinomonas mediterranea
MPEYKAPLRDIKFVTEEVLDINNHYANLAGAEEATPDMVAAILEEGAKFAERVLSPLNRIGDEQGCTFKDGEVTTPEGFKEAYQQYVEGGWPSLSHEESVGGQGLPESLGMMVTEMIATSNWSWSMYPGLSHGAMNTLEQHGTDEQKQTYLTKLVTGEWTGTMCLTEPHCGTDLGMLKTKAEPNSDGSYAISGTKIFISAGEHDMADNIVHIVLARLPDAPAGTKGISLFIVPKFNVNETGDVADRNAVSCGSIEHKMGIHGNATCVMNFDGAKGFLIGPPNRGLNCMFTFMNTARLGTALQGLAHAEWAYQNSVVYAKDRLQMRALSGAKSPDKAADPIIVHPDVRRMLLTQRAFAEGGRALIHYSSLLVDKTTKGSDEEKAEAEELLSLLTPIAKAFLTETGFESANQGLQVFGGHGFIAEWGMEQNVRDSRISMLYEGTTGIQALDLLGRKVLMTQGATLRRFTKIIHKFCKEHKGDKRFKGYINALSKLNSEWGDVTLKIGMKAMKNKEEVGAASFDYCMYSGYVVLAYFWARMAVTAQVKLDEGSSEQGFYTAKLQTATFYYERILPRTRGHVETMLSGADNLLAMEEDNFLFLG

SEQ ID NO: 1346 - protein, 452 aa, Pedobacter saltans; identical to SEQ ID NO: 1316

SEQ ID NO: 1347 - protein, 600 aa, Sphingobium chlorophenolicum; identical to SEQ ID NO: 1313

SEQ ID NO: 1348 - protein, 591 aa, Pseudonocardia dioxanivorans; identical to SEQ ID NO: 1310

SEQ ID NO: 1349 - protein, 599 aa, Frankia sp.
MAESVLLSRRNLDFLLYEWLDVTALTSRERFAEHGRETFDAVLDLAEQVATEHFYPHLRAADTHEPTFDGERVSMIPQVGVALDVFAKTGLAAATFDAELGGAQLPDVVASACFAWFQAANISTFAYPFLAVGNSNLLVTHGTPEQVDRYVRPQLEGRFYGTMCLSEPQAGSSLSDITTRAEPRPDGTYRLFGNKMWISGGDHELSENIVHLVLAKIPGGPAGVKGISLLIVPKFLVEDDGSLGERNDVTLAGLNHKLGYRGTTNTLLNFGEGRHRPGGEPGAVGYLVGEPHKGLSYMFTMMNSARVHVGAGAMALGYAGYLKALKYAKERPQGRPPAGKDPRSPQVPIIEHADVRRMLLAQKSYVEGALALVLYAGKLLDDERTAPTQAERDQAHLLLDTLTPIVKSWPSQWCLEANSLAIQVHGGYGYTREYDVELHFRDNRLNPIHEGTHGIQGLDLLGRKVAIGGGAGLAALVGTARATVTAATAAGGELADLGAQLSSALDRVVEVTGVLHGAGDPDVTLSNATVYLEAVGHVVVAWLWLAQALAADGLDGAFYDGKRQAARYFFRYELPRTGPQLDLLASLDRTTLDTDPSWL

SEQ ID NO: 1350 - protein, 599 aa, Frankia sp.; identical to SEQ ID NO: 1349

SEQ ID NO: 1351 - protein, 585 aa, Shewanella baltica
MNPYQAPLTDMRFLLEQVFDAPNTWAQLPEIAEMVDIDTANAILEEAAKISSELIHPLNRTGDEQGVLHQDNQVITPDGYKAVYEQYSQGGWIGLCGDPEFGGMGMPKMLGILVDEMAYSACNAFTLYGSLTAGAALCINAHGSEALKQAYLPKLYSGEWAGAMDMTEPQAGSDLRNIRTRALPQDDGSYAITGSKIFITGGDHDLTENVIHLVLAKLPDSKGISLFLVPKISVNADGSLANANGVSVGSIEHKMGLKGSATCVMNFDNAQGFLIGEPNRGLVCMFTMMNYERLAIGIQGLGSAQAAYQMAADYAKERNQGVAAGGSPTGSESDPIIVHGDVRRMLLTIRAMTEAGRALSVFTGQQLDLAKYAQDEVKAKAARYVGLLTPVAKAFLTDRGLDATIMAQQVFGGHGYIRETGIEQLVRDTRIAQIYEGTNGIQAIDFLGRKVTGDNLAALNEFIADLKAQMRAFTHVDAVKVAAVCARLDALVIVAESINEHKVAQPALINACAVDFLDAFGYTLYGFYWLAMVDKVADHEDKAFAEQKAYLAKFYFDKLLPKADYHIAQVRAGDATTMAMPAELF

SEQ ID NO: 1352 - protein, 596 aa, Shewanella baltica
MPVYQAPLRDYQFILNEMLHIYQQDALKGFDEIDPDLVDAILQGMADFSTEVMLPLNSVGDLQGCKLVDGKVITPEGFDNAYRQFVDNGWPTLTCDPEYGGQGLPEVVGIFATEIQTATNMAFAMYPGLTHGAYAAIHAHGSDALKQKYLSKLVSGEWTGTMNLTESHAGTDLALLRTKAVPVSEGVFAITGEKIFISSGDHQLTDNIVHLVLARLPDAPEGVKGISLFAVPKVLVNSDGSLGAPNTLYASGLEHKMGIHGNSTCVMVFEAALGELVGEPHQGLRAMFTMMNQARLGVGVQGLGVSEIAYQNALAYAKDRLQSRALSGAKAPEKAADPILVHGDVRRMLLSQKAFNEGARALVGQQALWLDEAERHTDPAKAKAASQLAALFTPVVKGFITNRGFNACVDAQQVFGGHGYIHEWGMEQFVRDSRIALIYEGTNGIQALDLVGRKLLSDRGAAMQQWSALVTEFIKSHSTNAAMQPYVSGLMDCAGDLQKASGYLATHAATNPDIIGAASMAYLELFGVTALAWMWARSAAVALAALEQGTEETAFYQAKLKTADFYMAYWAVQGRSLRKQIEQASEMLTQLDEAIF

SEQ ID NO: 1353 - protein, 729 aa, Saccharomonospora paurometabolica
MTLGLTEEHTQLRDAVRAFAARHVTAEVVRAAVDADTDGVPPFWTALAGQELLGLHLPEEHGGSGFGLLETAVVVEELGRALTPGPVVPTVTASAVLHRAGHHAHLPDLATGRGVGAVGLGAGTLALRWEADGTAVASGTPDPVSGGATADVFVLPAHDDGGTTWVVLSRAEVETTELVSHDPTRRLARVHVPEIRLSPDSVLSGTEAELPREVAAVLLAAEASGLAEWATTTAAGHAATREQFGRPIGQFQGVKHRCARMLVRAEQARVCAWDAARALDADTGVGAVSAETSLAAAVAGASSVEAAFATAKDCIQVLGGIGFTWEHDAGLVLRRAQSSRLLLGPTATWHRTVARAALAGVRRGMGVELPPEAETVRSRIRAELEPARERDAEGARRYLAEHGYTAPHLPEPWGKGADGLTQLVIDEELAAADLSPVDMVIGNWVVPTLIEHGSAQQQQRFLPSTLRGETVWCQLFSEPGAGSDLAALRTRAEKVEGGWRLSGQKVWTSAAREAHWAICLARTDPSVRKHKGLSYFLVDMSAPGIEIRPLRELTGDALFNEVFLDEVFVPDDALVGEAGDGWKLARTTLANERVALSRGSSLGDGGETLLELAVADGTPDADRLAELGALLADAQSGGLFRLRGVLRSLTGGQPGAESSVGKFLGVEHAQRVWETVMDWRGVDALVGPSSRGGSAWMFLNTRCLSIAGGTTEIQLNIIGERILGLPRDP

SEQ ID NO: 1354 - protein, 600 aa, Marinomonas mediterranea; identical to SEQ ID NO: 1345

SEQ ID NO: 1355 - protein, 729 aa, Saccharomonospora paurometabolica; identical to SEQ ID NO: 1353

SEQ ID NO: 1356 - protein, 598 aa, Mycobacterium rhodesiae
MQSELLSRRDIDFLLFEWLGVDELTKHERFAEHSRETFEALLDLCEQLAARYFATHNKKSDANEPSFDGETVTTIPEVKEAWDAFAQADLLGISMDRRIGGAQLPVTVGQAAFAWFSAANASTAGYLFLTMANANLLAKFGTDDQVESFVQPMQSGRFSGTMALSEAQAGSSLADITTRAEPQSDGTYRLFGSKMWISGAEHELTENIVNLVLAKIPGGAAGTKGISLFIVPKYLVDADGSIGERNDVALVGLNHKMGQRGITNTVLNFGEGASTPAGKPGAVGYLVGEPHRGLTYMFTMMNEARLGVGMAAVALGYTGYLKSLRYARERQQGRPLTVKEPLAPQVPIIEHADVKRMLLAQKAYVEGGLALLLYCSKLIDIQHTSDSEQERANAELLLDILTPVAKSWPSQWCLEANSLAIQVHGGYGYTREYDVEQHYRDNRLNMIHEGTHGIQSLDLLGRKVRQRGGAGLMVLGAAIGKTVANAAALGGDAAHQAEQLDTAWQRLVAVTRDVLASGDIEAAMANSVVYLEAFGHIVVAWIWLQQMIAAQDCVGDFYDGKRHAARYFFQYELPKTGPQLDLLASLDRTTLTMRDSWF

SEQ ID NO: 1357 - protein, 601 aa, Delftia sp.; identical to SEQ ID NO: 1335

SEQ ID NO: 1358 - protein, 596 aa, Delftia sp.; identical to SEQ ID NO: 1336

SEQ ID NO: 1359 - protein, 596 aa, Delftia sp.; identical to SEQ ID NO: 1337

SEQ ID NO: 1360 - protein, 601 aa, Marinomonas posidonica; identical to SEQ ID NO: 1338

SEQ ID NO: 1361 - protein, 718 aa, Mus musculus
MAEYLRLPHSLAMIRLCNPPVNAISPTVITEVRNGLQKASLDHTVRAIVICGANDNFCAGADIHGFKSPTGLTLGSLVDEIQRYQKPVVAAIQGVALGGGLELALGCHYRIANAKARVGFPEVMLGILPGARGTQLLPRVVGVPVALDLITSGRHISTDEALKLGILDVVVKSDPVEEAIKFAQTVIGKPIEPRRILNKPVPSLPNMDSVFAEAIAKVRKQYPGRLAPETCVRSVQASVKHPYEVAIKEEAKLFMYLRGSGQARALQYAFFAEKSANKWSTPSGASWKTASAQPVSSVGVLGLGTMGRGIAISFARVGIPVVAVESDPKQLDTAKKIITSTLEKEASKSGQASAKPNLRFSSSTKELSSVDLVIEAVFEDMNLKKKVFAELSALCKPGAFLCTNTSALDVDDIASSTDRPQLVIGTHFFSPAHIMRLLEVIPSRYSSPTTIATVMSLSKRIGKIGVVVGNCYGFVGNRMLAPYYNQGYFLIEEGSKPEDVDGVLEEFGFRMGPFRVSDLAGLDVGWKVRKGQGLTGPSLPPGTPTRKRGNTRYSPIADMLCEAGRFGQKTGKGWYQYDKPLGRIHKPDPWLSEFLSQYRETHHIKQRSISKEEILERCLYSLINEAFRILEEGMAASPEHIDVIYLHGYGWPRHVGGPMYYAASVGLPTVLEKLQKYYRQNPDIPQLEPSDYLRRLVAQGSPPLKEWQSLAGPHSSKL

SEQ ID NO: 1362 - protein, 438 aa, Homo sapiens
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 1363 - protein, 438 aa, Homo sapiens; identical to SEQ ID NO: 1362

SEQ ID NO: 1364 - protein, 412 aa, Desulfosporosinus acidiphilus
MFDFLLTDDQLQLQKEASNFVKEKVPKQLILDMDEEKVIYPVEYLQKLGEAKLMGLRFAPEYGGRGLGWVDEIGVLEEIGVLGTSLACLYSLPSIVGEAISRFGSEDLKLRYLKPTLEGTRYTAEALTEPRGGSDFFGATTIAVKDGDDYILNGQKRFVVGAEGADYFMVYAKTNPEGKSHESMSAFIVDRGPGVEVAHVYGLMGTRGGGAGRVVFKNVRVPRANLLGKEHGAAEIFYQMMIPERMTSAAGALGMARAALEVAALYSTKRKAFGQKIKDFQGVSFKVADSITRLDAARSLVYAAAKAIDSGIPSSQGRRMVSEAKKFATETAWAVVNDAMQMMGGIGYTNVFPVERLLRDTRLIMIWTGTNEVMNLIIQHEYYKELHTQMQNHRAIEEDAQNAHLNEEKVYE

SEQ ID NO: 1365 - protein, 416 aa, Pseudonocardia dioxanivorans
MRGVPTNAIRDISPSDRVLDYTSRFRTFLDAEVAPLEQELHSADAGTPWNPRLDDKGRMHPLVWEARREVQRRSAKAGLYNPHIPAELGGGGFGRVEMQHVEEYVYHASGLGLGLAALAWTEGANPALTHVSDVARGRYLDPLMAGEVTTAFANTEREVGTDVLAMGTRARRDGSDWILDGTKAWITNAHFADFVQVVAVTEAGAGTRSLSMFLVDADAPGFHRGRDIPTMLNDGLTGELHLDGVRVPAENVVGEVGDGFALAMTWINWRRMCRGGMCAGWGTWLLERATERARTRESGGRPIGELQAVQHLLADMDADVFAARSASLVGQVELDELGPFDIPAHRDVPRLVSLIKVVNDEAFFRVADRAVQVHGGTGLLLGSAEEKLFRVARNLRIPAGTVEIQRNAIARGLLRP

SEQ ID NO: 1366 - protein, 450 aa, Truepera radiovictrix
MALKDMGKVMALASKIDMAKVAKLSEKVDLNELLGLVSNMDEKTLKQMMKLAAPKTPKAPPEINGDFYDIGALLTPRQREIQLRVRAFMEREVEPIINDYWQRDEFPKELIGKFRELDLIKEIFDDEGNRTPDAAVLEGITGMEMARVDVSTTTFFGVHAGLAMCSILVGGSEAQRREWLPRMRRFEVIGAFGLTEPEVGSAISQGMTTTCRREGDTWVLNGEKYWIGNATFSDITIVWARDEADNQVKGFIVRRDNPGFSVRKIANKIALRAVENGHITLQNCRVPESDRLQNATSFRTTADVLRMTRAGVAWQGVGCAMGAYEKSLAYAQKRLQFGRPIANFQLVQNLLVQMLGNVTAMQTMCFRLAQLQDAGVMTDEQASLAKVFTAKRCRETVALARELHGGKGILLDHHVARYFADTEAIYSYEGTNEINTLVVGRAITGTGAFV

SEQ ID NO: 1367 - protein, 412 aa, Desulfosporosinus acidiphilus; identical to SEQ ID NO: 1364

SEQ ID NO: 1368 - protein, 570 aa, Runella slithyformis
MTVTLNTFPWLKFYPPGMPYEIAPEVYPSLLEMMEEGFSQYAARPAYACMGKQITYAQLDKMSNDFAAYLQSVGLKTGDRIAIQMPNVLQYPVAMFGALRAGLTIVNTNPLYTPREMEHQFKDSGAKAIIILANFADKLEKVLPATQIKHVFVTQIGDMLGFPKKQIVNFVVKNVKKMVPPYHLPQAVSFTDAVQQGASMSYTKPSVNQLDLAFIQYTGGTTGVSKGAMLTHRNIIANVEANCVYLSPMLKTIPENQPNVIVAALPLYHVYALTCNALSALKNGGMNLLITNPRDMEAFIKELKKYKVTVFTGLNTLYNGLMNHPKFGEIDFSQLKITSAGGMALQKVVAERWYKLTGNLPTEGYGLSETSPVLSANPLDPTLNRIGTIGIPFPSTEMRILREDDTWADVGEPGEICAFGPQVMPGYYNRPDETAKVMLTDPADGRQWFKTGDIGVMDSDGYFKIVDRKKDMVLVSGFNVYPNEVEDVVAQCPGVLEVACVGVPDEKTGEAVKIFVVKKDESLTKEQVIAFCRENLTAYKCPKHIEFRPELPKTNVGKILRRALRDEPVK

SEQ ID NO: 1369 - protein, 452 aa, Leadbetterella byssophila
MSIIQDIRQVIALLKQVDLKQLKALNEKVDLAGAMQQLSKMDAAQLQGLMKMLNSGGKRNKPLPEPNPDFYELSDKLTAEQRALQLKVREFMETEVAPIVNEYWLRDEFPFELIPKMGDLGLAGVTFEGYGCPNLPYMMEGVLAMEMARVDASIATFFGVQSGLSMGSIYLCGSEEQKQEWLPKMNRMEKIGAFGLTEPEVGSGAAGGLTTTCKQTADGWVLNGQKKWIGNATFADVIIIWARDVDSGEVKGFLVRKENPGVHVEKIKGKMALRIVQNGLITLKDCIVEEKDRLPHANSFKDTANVLRMTRAGVAWMAVGCARGAYENALEYTKTRKQFGKPIASFQLIQNHLVEMISNLTAMQTLVYRLSELQDEDKLKDEHASLAKVFCTLRTRDIVRGAREVMGGNGILLDYNVARFVADAEAIYSYEGTKEINTLIVGRSITGFSAFV

SEQ ID NO: 1370 - protein, 450 aa, Truepera radiovictrix; identical to SEQ ID NO: 1366

SEQ ID NO: 1371 - protein, 452 aa, Leadbetterella byssophila; identical to SEQ ID NO: 1369

SEQ ID NO: 1372 - protein, 645 aa, Caenorhabditis elegans
MAAQIYGGEMRARRRREITAKLAEIPELHDSMPLPYMTREEKIMESARKLTVLTQRMSEIIDPTDAGELYHLNNEVLGIEGNPMALHGVMFIPALNAQASDEQQAKWLIRALRREIIGTYAQTEMGHGTNLQNLETTATYDIGTQEFVLHTPKITALKWWPGNLGKSSNYAVVVAHMYIKGKNFGPHTFMVPLRDEKTHKPLPGITIGDIGPKMAYNIVDNGFLGFNNYRIPRTNLLMRHTKVEADGTYIKPPHAKINYSAMVHVRSYMLTGQAIMLSYALNIATRYSAVRRQGQIDKNEPEVKVLEYQTQQHRLFPFIARAYAFQFAGAETVKLYERVLKEMKSGNVSLMADLHALTSGLKSVVTHQTGEGIEQARMACGGHGYSMASYISEIYGVAIGGCTYEGENMVMLLQLARYLVKSAALVKSGKASQLGPLVAYLGARSEPTSLIDRVPNGGITEYIKTFQHIAKRQTLKAANKFFGLMENGEKREIAWNKSSVELNRASRLHTRLFIVEAFARRVNEIGDITIKEALSDLLHLHVNYELLDVATYALEDGFMSSTQLDYVRDQLYFYLQKIRPNAVSLLDSWEFSDRELRSVLGRRDGHVYENLFKWAKESPLNKTDVLPSVDTYLKPMMEKARQSKL

SEQ ID NO: 1373 - protein, 700 aa, Mus musculus
MGSLPEEKDSALWSDTPKGPLSAYRARASFNSGELLLFWDGQDVIHFKKTIFSTLENDPLFARSYGADLPLEKLRELNFLRCKRVFEYGFFKVEELLKNPLKILVLINCLGMYDWSLANKCVLHMLVFGTTVFVSGSEKHFKYLEKIYSLEIFGCFALTELSHGSNTKAMRTTAHYDPDTQEFILHSPDFEAAKFWVGNLGKTATHAVVFAQLYMPDGQCHGLHSFLVQIRDTKTLLPMTGVMVGDIGKKLGQNGLDNGFAMFNKVRIPRQNLLDRTGNITSEGTYNSPFKDVRQRLGASLGSLSSGRISIISMSVVNLKLAVSIAIRFSATRCQFGPTDKEEIPVLEYPLQQWRILPYLAAAYALDHFSKTIFMDLIEVQSARLRGDHSDQQAELGREIHALASAGKPLASWTAQRGIQECREACGGHGYLAMNRFGDLRNDNDPNCTYEGDNNVLLQQTSNYLLSLLEPPLQDGAHFTSPLKTVDFLEAYPGILGQKFLGSSKADWMDSAAPLAAYRWLVCYLLQESHRRYCQEKKSRGSDFEARNNSQVYGCRPLALAFMELTVMQRFHEHIYSSGLSPSLRTVLGRLSTLYGLWCLSQHMALLYRGGYISGEQTGRAMEDAILTLCEQLKDDAVALVDVIAPSDFVLNSPIAKADGELYKNLWAAVLQQNGVLERAAWWPEFSANKSVADRLKSQL

SEQ ID NO: 1374 - protein, 681 aa, Mus musculus; identical to SEQ ID NO: 345

SEQ ID NO: 1375 - protein, 409 aa, Alicycliphilus denitrificans
MNASTPTTRLAAAGPALPEMPFEGSPLAAQLIAALRDFLHGELVDLARSHGIDHEHSPDKALLRQVWRRSHALGFYGMSLPPSMGGKELSVLDQVLIKEAIYATGSPFAPHVLGELSGPPRIGALVRKATPWQMEQFIAPVARADKAICFALTEAGAGSDAGALQTRATQDGDHYVLHGRKRFISGSPFADCAVLLASTAPEGAAEREISAFFVDLHAPGVEVVSGYKTMAGQSHTGDIVLDGARVPAAQLIGERGRGLALALGRITVNRLMHCPAMLGLAQVALRDARDYALERRQFGRSIAQFQAIQHMLADMATQWAAARALMVQTARAIDAGIDARAQASMSKLFCSEAAFGIADRAVQIHGGEGIVQGRRVEFLFRMLRMYRVLTGTSEIQRNTIARELLATPA

SEQ ID NO: 1376 - protein, 677 aa, Gordonia bronchialis; identical to SEQ ID NO: 454

SEQ ID NO: 1377 - protein, 412 aa, Desulfitobacterium dehalogenans
MFDFLLTPGQKLLQEEAARFVKEKVPKQLILDMDEEKVTYPKEYLMDLGQAKLLGLRFAEQYSGRGLQWVDEVSVLEEIGVLGTSLACLYSLPSIVGEAINHFGSEVLKNRYLKPTLEGKLYTAEALTEPRGGSDFFGATTLARREGDFYILNGQKRFVVGAEGADYFMVYAKTDPEGPAHQSISAFIVDRGPGVEVEHIYGLMGTRGGGAGRVVFKDVKVPAENLLGVENGAADIFYQMMIPERLTSAAGALGMARAALEVASDYSTKRKAFGRKIKDFQGVNFKVADSITRLDAARALVYATARAVDSGVPGNVARRLVSEAKKFATDSAWAVVNDAMQIMGGIGYTNIFPIERLLRDIRLIMIWTGTNEVMNLIIQHEYYKERRENLQPHRSLEEDAVNAHLTEEKVYE

SEQ ID NO: 1378 - protein, 409 aa, Alicycliphilus denitrificans; identical to SEQ ID NO: 1375

SEQ ID NO: 1379 - protein, 534 aa, Marinithermus hydrothermalis; identical to SEQ ID NO: 1208

SEQ ID NO: 1380 - protein, 416 aa, Pseudonocardia dioxanivorans; identical to SEQ ID NO: 1365

SEQ ID NO: 1381 - protein, 412 aa, Desulfitobacterium dehalogenans; identical to SEQ ID NO: 1377

SEQ ID NO: 1382 - protein, 721 aa, Frankia sp.
MGIAIGEEHRALARTTQSLLSSRDARAAGRALLDADEEHLPGFWKEFADLGLLGVHLPEEFGGGGFGLPELVVILEETGRAVAPGPVLPTVLASAVIAASGGPEARARLLPGLAAGTAVGAVGLGGDLDLDSDGRMSGRSGVVPGGALADFVLLAVGEDLVVVSTADPGVTDEALGSLDRSRRSTRLRLTEARVAPGDVLPGALAHAQAIMRTLVAAEASGGAHECVEVAAAYAKVREQFGRTIGTFQAVKHHLANMLVAAELATAAVWDAARAAAGPTEEFELSAAVAATLAVPAFVRNAELNIQVHGGTGYTWEHDAHLLYRRAITSKAIVPPGTAAADVTRLGGAGVSRTAPAFDLPAQAEAARPEIRALAAELAALPDDERRRRLADTGYLQPHWPRPWGLGASAGLQLVIEQEFRAADLKVPNLMITGWVILTLVQHGTQDQVARWVRPALYGEEQWCQLFSEPGAGSDAAAVRTRAERVQGGWVLGGQKVWTSDAHRCRYGLATVRTDPSASKHAGITTMVVDMATEGVQVRPLRHLTGDHYFNEVVLTDVFVPDADVVGKPGKGWNVARATLGNERITLSGNLGGTTADQMFALYRQHGHRVPGAETRLGEHVAEAIAVRLLDLRRVVRALDGSGPSPEGNVTKLVTAEHGQRAATLLTEFAGQDVALDDGFGGTAGRSLLATRALTIAGGTSEIARNQIAERILGLPRDPLLS

SEQ ID NO: 1383 - protein, 746 aa, Frankia sp.
MSIGLTEDHEALASSIRGFVARHAPSAAIRADLDAYAAGGPFPGWDGLVELGLTSLHLPEEHGGAGAGYLELAVALEETARALLPGHLLPSVLTSGLLARNASDELRKRTLPGLAAGARAASALTAAGPRATPGSDGGHTVSGVTVPVLGAAGAELLLLGARVAASTAAANTVGTVATTDAAAGGEVWFVVDAAAPGVRVEPADAVDLTRGVARVHLDAVAVGAEQVVAIDAEQVRVLAAVLFAAEAVGIARWLLTTGVEYVKVREQFGRPVGSFQAVKHRCARMLVRTETMTAAAWDAARAVEQGDEQLALAAAEAAILCLAGATELGLETVTLLGGIGYTWEHDTHLYWRRAMTLESLLGPVATFEHRLGNLVATSGQARDFDLELPEADPAFRARIAGILDEVAALPEGERQRRLADEGLVLPHYPRPYGLAATPVEQIVIQQEYERSGVAQPRTVIGEWAMPTVLAHGTEEQKRTLVPATLRGEITWCQLFSEPGAGSDLAALSTRAEKAEGGWRINGQKVWNSMADRADYGILLARTNQDAPKHRGISYFLLDMRTPGIEVRPLREANGNYLFNEVFFTDVLVPDDRLVGEVDKGWALARTTLGNERVAMGGMRELRLDMPAMAASGELAARADDVHRDIGALYAHAYALSAMSLRGTLRTLSGLRPGAEASVAKVAASFLNTDVATRTLRWFGPAAASAEGPGAAAVHQYLSVPPHLIGGGTIEIQLNVIAERVLGLPRG

SEQ ID NO: 1384 - protein, 727 aa, Frankia sp.
MSIGLDDDHAALADSVRGFVARHAPSERVRAGLADWPGGAAPDYWRDVTEQGLTSLHLPEELDGAGAGAVALAVVVEETARGLLPGPLLPSLLTSSVLARYGGDELRKRVLPALAAGATAATALSTHGLTASVDADGGYRVSGSTVPVLGAPRATLLLLGAATPDGGELWFTAEPGPGVEVVAGAPVDHTRAVGTVTLTDLAVGQESVVAAGAGQVRAVAAVLFAAEAVGLARWCVSTGVDYVKVREQFGRPVGSFQAIKHKCARLFVDVETMSAAAWDAARALDENDEQLAVAAAGAAVACLPRATEIGLETITLLGGIGYTWEHDAHLYWRRAMTLESLLGPAADWEHRLGELVAGTSRDFDIDLSGADPAFGERVAGVLAEVAALPADGPARRERLVAEGLVVPHYPRPYGIAASPIEQLVIQREYERSGVAQPRLIIGDWALPTILAHGTDEQKEAFVPPTLRGELVWCQLFSEPGAGSDLASLSTRAQKVDGGWRLNGQKVWTSNAHEAHFGICLARTDPAAPKHKGISYFLVDMTSPGLEVRPLREANGGYLFNEVFFNDVFVPDDRLVGEVNQGWGLARTTLGNERVSISGMQHIPTDLLDLAASGTLAAAPRDVTREVGLTFAAAHTLAALALRTTLRSLSGLRPGAQASVSKVASGVLVTRIAERAMRWLGPAAAAADGPGGQRTQRYLTVPPQLIGGGTVEIQLNVIAERILGLPRG

SEQ ID NO: 1385 - protein, 727 aa, Frankia sp.; identical to SEQ ID NO: 1384

SEQ ID NO: 1386 - protein, 746 aa, Frankia sp.; identical to SEQ ID NO: 1383

SEQ ID NO: 1387 - protein, 721 aa, Frankia sp.; identical to SEQ ID NO: 1382

SEQ ID NO: 1388 - protein, 401 aa, Desulfotomaculum gibsoniae
MDFSLPEEYVMLKQMVRKFTEKEMFPLEQTIINREAERGLSDTPVIPPEDEKRLLEKTNELGLWGIDVPEKFGGQELGYLAKVIVVEEMNRSIVPLTLPPDAPNLNYLLSCCNEQQYEKYLLPYARGEKISALAMTEPNAGTDAGGIQLRADRRGDKWVLNGSKMFISFAHKADFFITIAVSDREKGKRGGFTAFLVDKDTPGLTVVRNIPVIGEMVSYELVYDNVELDESQVLGEVGQAFIPLQNRFGVRRMELGARCCGMADRLIKLMIEQANIRTTFGKPLADRQAVQWWITNSTMDLHAARLMVYHAAWKADQGIKDLRLEAAMVKVFCTEMLTRIADRAIQVHGGLGLSKEMPIEYIYRLVRILRIVEGPSEIHRWLVARELTKKNKVYDTFALER

SEQ ID NO: 1389 - protein, 412 aa, Desulfosporosinus meridiei
MFDFLLTEAQKELQNEAIAFVKEKVPKQLILDMDEEKVVYPVEYLKDLGRANLLGLRFSPEYGGRGLNWVDEIGVLEEIGILGTSLACLYSLPSIVGEALARFGSEDLKQRYLKPTLEGKIYTAEALTEPRGGSDFFGATTVAVRHGEDFILNGQKRFVVGAEGADYFMVYAKTNPEGKSHESMSAFIVDRGPGVEVGHVYGLMGTRGGGAGRVVFKDVRIPGKNLLGQENRAAEIFYQMMIPERMTSAAGALGMARAALQVATAYSTKRKAFNHTIKDFQAVSFKVADSITRLDAARALVYTTARAIDSGVPAAQGRRLVSEAKKFATNTAWDVVNNAMQIMGGIGYTNVFPIERLLRDIRLIMIWTGTNEVMDLIIQHEYYKELKTELLNHRLIEEDALNAHLSEEKVYE

SEQ ID NO: 1390 - protein, 401 aa, Desulfotomaculum gibsoniae; identical to SEQ ID NO: 1388

SEQ ID NO: 1391 - protein, 418 aa, Saccharomonospora paurometabolica
MDFPLPEELVALLADLDGFIDAEIVPLQQQDDNDRFFDHRREYARTDFDAGGTPRPEWEELLAEMTRRADRAGWLRYGLPEEVGGGGGSEFEMAVIREHLAARGLGLHNDLQNESSVVGNFPVVHMLLRFGTQQQRDEFLQPVLSGDLRIAFGLTEPEHGSDATWLETTAVRDGDDWVLNGGKRFNSGMHTATHDVVFARTSGEPGDARGITAFLVPTDTPGFSVDSYWWTFNMPSDHAEVSLTDVRIPSSAILGQEGAGLEAAQCFVHENRIRQAASGVGAARYCIDRSVEYARERVTFGVPLARRQAIQWPLVELHTEAEMVRELVRRTAWEMDRRPHDEISDRVSMCNYRANRLVCDAADRAIQVHGGFGYTRHAPFEHIYRHHRRYRITEGTEEVQMRKVAAHLFGFAGPDKRP

SEQ ID NO: 1392 - protein, 412 aa, Desulfosporosinus meridiei; identical to SEQ ID NO: 1389

SEQ ID NO: 1393 - protein, 418 aa, Saccharomonospora paurometabolica; identical to SEQ ID NO: 1391

SEQ ID NO: 1394 - protein, 414 aa, Mycobacterium rhodesiae
MDFTLPDHLPAVLAEMDAFIEAEIKPLEREHMQYFDQRREFARTDVENGGIPRREWEDLLDEMRRRADAAGWLRYGLPSKFGGRDGTNVDMAVIREHLAHKGLGLHNDLQDESSIVGNFPQVIMMDRFGTDEQKSEWIEAMLTGQRSMAFGLTEPDHGSDATWLETRAERDGDHWVINGSKRWNTGVHRATHDLVFARTSGEPGQARGITAFLVPCNAPGFEVPFYWWTFNMPTDHGEVELRDVRVPADAVLGELDHGLEVAQTFLHENRIRQAASSLGAAQHCIDRAVEYAGKRVTFGKPLAVNQAVQWPLVELQTEAQMVRLLVRYAAWELDRNHHLEVSDKVSMANYRANRLVCEAADRAMQVHGGIGYSRHEPFEHIYRHHRRYRITEGAEEIQMRRVAQRMFKFGKPAR

SEQ ID NO: 1395 - protein, 701 aa, Mycobacterium rhodesiae
MSATITDEQFAARELVRSWAASSGALAAVRDVEHGTPDAWRPIYRGLAELGLFGVAVAEDAGGAGGSVQDLCAMVEEAARALIPGPVATAAVATMLVTDAELLEALMSGAATAGLSLAADLTLDGDTVSGTAQYVLGADTSGVLLLPVGDDVVVVDAAADGVTLELLAATDFSRPLARVTFNAAPAATLAGSRRRFEDLTATVLAAETAGVARWTLDTAVEYAKVREQFGKPIGSFQAIKHMCAEMLLRSQQAAVAAADAAVAVSGEDDKQLAIAAAIAAAIGVESAKANAKDCIQVLGGIGITWEHDAHLYLRRAYSIGQILGGRPAWLRRVSALTLVGVRRELHIDLESVAHLQPEIAAAAAQVAALPADKRQPALAETGLLAPHWPKPYGREASPAEQLLIDSELAKVDVQRPDLVIGWWAVPTILEGGTPAQIEKFVPATLCGDIIWCQLFSEPGAGSDLAALRTKAVRTEGGWKLTGQKVWTSAAQKAHWGVCLARTDPNAPKHKGITYFLIDMRSPGLLVRPLREITGDELFNEVFFDEVFVPDEMVVGTVNDGWRLARTTLANERVAMAQGTALGNPVEEMLRTVAERELDTALAEQTAKLILSAQAGSLLDQRIAQLAVAGHDTSAEASARKLIGVRHRQALAEFRQELCESGGLVVDGFVHDFLNTRCLTIAGGTEQILLTLAGERLLGLPR

SEQ ID NO: 1396 - protein, 552 aa, Caenorhabditis remanei
MNTAENWQTHEISNQFDELQNYNLLTTDQVLQEILQRYGSQDQQRLTEFSQIAGSTEYYEYADLANRHTPELHSFDARGRRKDFLEFHPAWHKWMRLNRQFDTHAHPFNHPQSSSKWVDWAARFFLSGQVECGNLCPNSMTLGSIPLIQNEPELWAKVGEKLLSTEYDERDIPISQKKSIWLGMGMTEKQGGSDVRANETRAVPVAESGRGQAYLLTGHKWFFSAPMCDAHLVVAKTEQDGLACFFVPRWLEDGTKNPVQVQRLKDKVGNRSNSSSEVEFKNAWGIMIGEAGRGIPTIIEMANYTRLTCSVGSSAMLRQALVQCIAYTRQRKAFGKHLAEQPLMQAVLADLALETEAAMQLSFHLAHCYESDDELSLAWRRIMTPAAKFWVCKRTVELTGEMMEVFGGNGYVDTGIMARIFKEAPVNTIWEGSGNVMCLDVLRAIQRDRESIEVLFKSFAQVASQDSILQDELQALFKLFSGLQADELQFMARSLVSRLVILAQAILLKQHAPDFVADAFIATRYSAFYGRVVGMLDAQAVDVKRLLDRALA

SEQ ID NO: 1397 - protein, 552 aa, Caenorhabditis remanei; identical to SEQ ID NO: 1396

SEQ ID NO: 1398 - protein, 620 aa, Caenorhabditis brenneri
MHRAIFRLQKLPKYTVRSLSNAVKPEKPEKSAEISEKSKYAIRTLDNSAPIEKRSLSRGFAMNKFEKDFMIYPEYTDSDDLRNIDGFVDVLRKSLELSVDLKQIEKDGNLSPEILETLRSNAIFSCSIGKPFGGIQMYQKDISKVFEELSIDFNVFSTAHISLIVSNLLTIYGSDEQKSKYLKLISEGKLRPSIAIVKDTNGGRVEMTQGPSGKSMIEGQNLRVIGHHNANFYVVFANNAGSQTCFLLDESELGTTDTIKFQRDETIGLKGIDIGRVELTALVSDKHVLGQTGGGAEIAAEMSGSGRMPFAAATVGMAKRALRELSLWCNRTPSRRTDRSTLADDTRSQRIVTDLALKVYALESSLYYLSGLIDEGLSIVVDIENSLISMLTRDVLQSIISCQLELVGVASSDSAFPHEKIFRDITTLLATLDESPDIEQIGLATIATWATSTSHKRIVSTLKRWLKQEKEADEMRNPGLTHYIAEHAHPSLQMACQELEFSMSRINNVVSKLMTSQGKNIEQDYGSLEALVTVLKNNLVMVATISRASRSYSIGLRNADIELAWATIICSRLSRASWFELDALSDLFGLVRFNPSLLNAGRAVFDLGGYIIESPLEKNW

SEQ ID NO: 1399 - protein, 410 aa, Sinorhizobium meliloti
MTDPKRFAPVLAKAEELGKRFALTARHYDETGEFPFANFDALHEAGLLGLVTATEHGGLGGGLTDALAVVSAIARGEPSTALVLSMHYNQHYSVRTSGKWPPHLVERVTRANREGVALINAAQVEPRVGSPSHGSLPETIARRVGDHWRITGHKTYATGIPLLRWVAVLAVTDEPEPRLGSFLVPTSADGIRVEKTWNATGMRATNSDDLILDDVAIPLEDVLEIAPAGEGLKRDERMGAWYFSLVPAIYDGAARGARDWLIDFTTSRAPASLGAPLSTVPRIQDGLGEIEVLLTVNRRLLRSIAEDFDSGRAFGADAAAVKHTVIANAITVTTLALELGGNPGISRDNPLERHHRDALSGKAHAPQNNLIRMMLAKAAFSRHAATHAVALDPVPVRSHQQPRLAVVGRS

SEQ ID NO: 1400 - protein, 593 aa, Sinorhizobium meliloti
MYKAPVEEIAFTLKHVAGMAEALDAGTFGELGEDLVDAILGEAGRFASEEVAPLGDAGDRQGSRLVDGAVKTPEGWRELYRNWIAGGWNGLTAPEAFGGQNLPHMLHVAAMEMWNSGSMAFALAPTLTMGAIEALEKHGTDALKATFLPKMVSGEWMGTMNLTEPHAGSDLGVLKTRAERRDDGTYRILGQKIFITWGEHDFTDNIVHLVLARLPDAPAGTKGISLFLVPKFLVNEDGSLGERNDVFCHSLEHKLGIHGSPTCTMIYGDGKFGREKGAIGYLVGEENRGLACMFTMMNNARLAVGMQGVAIAEAATQKAIAYAKERTQGRAPGWSGDGMSPIIEHPDIARTLLTMKALTQGSRAIAYACAHAVDMAHAAQGEDARQWQERSSLLTPIAKSFATDAGVDVASMGIQVHGGMGFIEETGAARYLRDARIAPIYEGTNGIQAIDLVTRKLPLSDGAQVRGFIAELREVAAAVAASNREGFGETAARLDAAVADLEGATDWLLSRLRDGKLAEALAGATAYQRLFGLVLTGVYLAKGGLAEAGDGGQDRRVALCRFAAENLLSETSALKDRVVNGAESLAAARSILD

SEQ ID NO: 1401 - protein, 593 aa, Sinorhizobium meliloti
MYKAPVEEIAFTLKHVAGMAEALDAGTFGELGEDLVDAILGEAGRFASEEVAPLGDAGDRQGSRLVDGAVKTPEGWRELYRNWIAGGWNGLTAPEAFGGQNLPHMLHVAAMEMWNSGSMAFALAPTLTMGAIEALEKHGTDALKATFLPKMVSGEWMGTMNLTEPHAGSDLGVLKTRAERRDDGTYRILGQKIFITWGEHDFTDNIVHLVLARLPDAPAGTKGISLFLVPKFLVNEDGSLGERNDVFCHSLEHKLGIHGSPTCTMIYGDGKFGREKGAIGYLVGEENRGLACMFTMMNNARLAVGMQGVAIAEAATQKAIAYAKERTQGRAPGWSGDGMSPIIEHPDIARTLLTMKALTQGSRAIVYACAHAVDMAHAAQGEDARQWQERSSLLTPIAKSFATDAGVDVASMGIQVHGGMGFIEETGAARYLRDARIAPIYEGTNGIQAIDLVTRKLPLSDGAQVRGFIAELREVAAAVAASNREGFGETAARLDAAVADLEGATDWLLSRLRDGKLAEALAGATAYQRLFGLVLTGVYLAKGGLAEAGDGGQDRRVALCRFAAENLLSETSALKDRVVNGAESLAAARSILD

SEQ ID NO: 1402 - protein, 579 aa, Sphingobium chlorophenolicum
MSADLDKLPSRDLLAFQLFDWLDTGSGEERETLMAMIDATQRVAAEAFLPHYRQGDIEEPRLEADGVHVLPAIHQAMALYAQMGLFGASFPEELGGLGLSCTASLAIHAGFAAANVSTAGYPMLTAANARLIAAFGTPAQVDRFARPQIEGRWFGTMCLSEPQAGSSLGDIRTRAVADGEDELGGRYRLSGNKMWISAGDQNVSENIVHLVLAKIAQQDGGLPEGSKGISLFIVPKILPDGTRNDLAVAGLNHKMGFRGTANCLLNFGEGAGAVGWRVGGEGQGLAQMFMMMNEARISVGMGAAALAYRGYRQSLRYAQERLQGRAVGVRNGAPIPIFNHPDVRRMLLQQKAYAEGALALCLYCARLVDQGGEDAETLLALLTPVAKSWPSEFGLIANDLAIQVHGGYGYTRDFDVEQLWRDNRLNPIHEGTTGIQAIDLLGRKILLSDGRPLALLRDRIGDTAGRAMETAEWAPAAAALLDYWRHVEDVVAGLRALGGAEAYDDATLFLRAFGHGVLAWLWLDQVLHARGHADSAMESGVAFACRFFFESELPQADAWLRIVGQHGDLARTMPDEAFA

SEQ ID NO: 1403 - protein, 592 aa, Sphingobium chlorophenolicum
MTQYAVPLEDYRFVFDALGLGELTEFDGWDMAQQDVVQQIVQEAGRYGADILFPLNRQADEIGAKFENGVVTVPPGFQEAYAQFREGGWPALTGPVEYGGQGLPFYLQYILTEIMAATCMSFAQYTGLTHGAAMAIEAHASEELKALYLPKLISGEWSGTMCLTESHSGTDLGLIKTRAVPAKDGSYAITGGKIFISAGEHEMVDNIVHLVLAKLPDAPPGVRGISLFLVPKYLPDENGAPGARNGVSAGSIEHKMGMKGAVACVMNFEDATGWLVGEPHRGLHAMFTMMNVERLLLSAQGQGAAELAYQSSLAYARDRVQGRALSGAKYPTLAADPIIVHPDVRRMLLTMKAHAEGGRALALWVMKHVDIAERHPDPAEREKASDLVALMTPVVKVWLSDNGSEAANLGVQTFGGHGYIREWGMEQIVRDIRILQLYEGANGIQALDLVARKLPMKGGSLLLRLTDPIDAHIETYASSADHAEFIQPLVAIRAKLEQATALLRAKAESDPEELGAGSMDYLKIVGYAAQTFIWSKLAIEASERRGENAAFYSSKLATARFYIGKLLPFADAHLVGLEAGAEPLMALDAEYF

SEQ ID NO: 1404 - protein, 576 aa, Sphingobium chlorophenolicum
MFSYVPPIDDYRFLLTQVLGFDRAMAETGKDVDADLAAAVLEEAGRMCAERLHPINRHGDEEGSRLIDGEVHTPEGFADAWRDFVAAGWPSLAAAPEYGGQGLPFILQLWLDEMLAAANMSFGLFPGLTRGACEAIAAHADDSLKATYLSRMVSGEWTGAMALTESGAGTDLALLKAKAVPDADGGYAVTGQKIFISSGDHDFGGNIIHLVLARLPDAPAGVKGISLFLVPKYLPDADGNFTVRNAMSVGALEKKMGIHAQPTCVMNYDGATGWLVGEPHRGLAAMFTMMNAERLMVGIQGLGIAGAAYQQAAGYAKERLQGRSADGTREPVAIIEHADVRRMLLNIRAFVEGARALGGWTALQLDRAHHHEDAAERAKADGLVALLTPVVKAAFTDYGFESAVQAQQVFGGHGYIREWGMEQYVRDARIAQIYEGTNGVQAMDLVGRKLPMAGGAVVEGFFALVADDLGAAGASGIAVSTREALALLREVTASLRGAGVEAAGAAAADYLRLFALVSMGWMWTRMAAAEGDTPLHDAKRAVADFFAQRMLPQVRGLAGSIAAGEATIMALAADAF

SEQ ID NO: 1405 - protein, 605 aa, Desulfosporosinus acidiphilus
MEFKYNVRDLKFILKEWLPTKEVLECDRFKDLYSLEDIDQILTEGYKVCREVISPINVVGDRNPAVFNNGVVTSPPGYKEVFQFIQKNGWGSSSECSKLEGGMPLIIYKSVFEMIAAACPAMGSNIKLTSGAANVIINFGSEDDKKRFLPKMLSGEWQGTMNLTEPSAGSDVGDALTKSYPTDDPKVYKIKGTKMFITAGDGSICENTIHLVLARPPQGCQGSAGLGLYIVPKFWVNEDGSLGKLNDVTTVAVEHKMGLKGSATCMLNYGENDECFGIMLGAPPDEKGRSQGLAMMFRMMNESRIGTGHNANAQASSAYAQASLYACQRIQGYIKGERVPIIKHPDVRRMLMDMKAHTEGIRAMIFKGYFNLDIAENSADKDKAQKSAERAAILTPLIKCYGSETAVLMNCEAMQVLGGVGYTQEFPLEQSLRDSKILTIWEGTSFIHAQDLVKRKMRMGDGKPFLSWMKDIESFITVNEGTAGLEREFINLSQAYHCLAEVKNLYDFWHLNKKDELIGLYALRTLYICSMVMVASCLLEQSLAAQRTMAELSADHYDFNFYQGKIACAKYYANNILPGVFNLTEIIRNTDLSIQECPEDSLIVN

SEQ ID NO: 1406 - protein, 619 aa, Pseudonocardia dioxanivorans
MTTRRPSGNGGDHAMGHYRSNLRDLEFNLFEVFRVQEDALAADSEVDLDTLRGVLSELDTVATGPLAESFVDADRNPPVFDPATHSVTLPQSLKDAYKVLWDGEWWRLSLPAELGGYGIPPSVQWAAAELILGSNPVAFMYMAGPNFASILHRNGTDEQKHWAELMIGRGWGATMVLTEPDAGSDVGAGRTKAIQQADGTWHIEGVKRFITSAEQDMTENIMHLVLARPEGAKAGTKGLSLFLVPKFHFDSQTGEPGERNGAFVTGVEHKMGLKGSTTCELTFGQHGVPAVGWLLGDVHDGIAQMFQVIEYARMMVGTKAIGTLSAGYLAALEYAKERVQGADLTQMLDKTAPRVTITHHPDVRRILMLQKAYAEGLRALYTYTATYQDRIRAGGDTALAEKVNDLLLPVVKGVGSERASEMLLLSLQTLGGSGYLQDYPIEQYIRDAKIDSLYEGTTAIQSLDLVFRKIVRDNGQALLHVAGEIQAFLAADSGNGRLKEERELLARALGDVQGMLGAFTATLKGSAQDPTELYKVGQHSVRFLMAVGDLLVAWLLLRQATVALEKLGGEVSAKDTAFYEGKIGAAHFFAKTVLPRLTADRKIVENADNALMELPEAAF

SEQ ID NO: 1407 - protein, 600 aa, Pseudonocardia dioxanivorans
MGVPSLLLSRPDLDFLLHDWLQVEKLTARPRFAAHDRDTFAAVLDLAHDVATEHFAPHRKISDSREPEFDGERVHLPDEVGAALRVLADTGMIGATMDEAVGGMQLPHTVAQACFLWLHAANVGSAAYPFLSVANANLLLAHGSPEQIDTWVRPIVEGRFMGTMCLSEPQAGSSLSDVTTRAEPQPDGTYRLTGTKMWISGGDHELSENIVHLVLARVPGSPPGVKGISLFVVPRFLVAPDGSIGERNDVVLAGLNHKMGYRGTVNTLLNFGEGRHTPGGRAGAVGYLVGEQNRGLAQMFHMMNEARVGVGAGATALGYAGYLHALDYARSRPQGRPVAAKDPAAPQVPIIAHADVKRMLLASKSYVEGALALVLYCARLLDEEQTADDPADRERAHLLLEMLTPVAKSWPAQWCLAANDLAIQVHGGYGYTREYDVEQLYRDNRLNAIHEGTHGIQAIDLLGRKAVMQGGAGLALLAETIAATTGRAARADGLAAEFAGALDAAVARIVAVTATLWAVGDLEVTLANASVYLEAVGHVVVGWLWLEQLLAVGDRTDDLAQGKRAAARFFLRHELPRTGPWLDLLVSADRTTVEMRDAWF

SEQ ID NO: 1408 - protein, 605 aa, Desulfosporosinus acidiphilus; identical to SEQ ID NO: 1405

SEQ ID NO: 1409 - protein, 608 aa, Streptomyces violaceusniger
MGHYKSNLRDIEFNLFEVLGRDTVYGTGPFAEMDVETAKSVLAEISRLSEHELAESYTDSDRNPPVFDPKTHTAPLPESFKKSYRAYMEAEWWRLGVPEELGGTACPRSLLWGSAETILGSNTPIWMYASGPAFAGVLHDEGTEEQLKIAQLMVDRQWGSTMVLTEPDAGSDVGAGRTKAAQQEDGSWHIEGVKRFITSGEHDLSDNIIHFVLARPEGAGPGTKGLSLFVVPKYDFDWDSGELGERNGVYATNVEHKMGLRASNTCELTFGADHPAKGWLLGDKHDGIRQMFKIIEFARMMVGTKAMATLSTGYLNALEYAKERVQGPDLAAFTDKTAPRVTITHHPDVRRSLMTQKAYAEGLRALVLYTASVQDEILVKEAAGEDASAVSRLNDLLLPIVKGYGSEKAYEQLAQSLQTIGGSGYLQEYPLEQYIRDAKIDTLYEGTTAIQGQDYFFRKIVRDQGQALTVVSEEIKKFLAEAAGGEELEAARDQLAQAAVDLEAIVGAMLTDLAATEQDVSSIYKVGLNSTRLLLASGDVIIGYLLLRGAAVATEKLGTASTKDRSFYAGKIAAAKFFAQEVLPGVSVQRSLAESVDKSLMDLDESAF

SEQ ID NO: 1410 - protein, 667 aa, Caenorhabditis brenneri
MSAPLIDKYRKMATFDWRKLKAAVEGEEHVRLKAEVVAKMKSEPIFHRDYRVLSREEHREVVHQRWKKIVEWGLFKDPYSDLENFHALTETLEAYDQGTSARLFLHGNVFGAAVKSMGTERHKELVEKIENNEIVGAFCLTEIGHGSNTAEVQTTATFDRGELVFNSPNVGAIKCWAGNLSHSATHVVVYAQLHVDGKNEGLHGFVIQVRCPRSFQTLPGITIGDMGSKPGCWQGVENGWMEFKNHRAPLSALLNKGCDITPDGKYVTSFKSASEKQSVSLGTLSVGRLGIIAKGMMACTFASTIAIRYSVARRQFGPEKGVENEVPVLEYPLQQYRLFPYLSAAICIRIFQKTFVERFTEYMMRVMMGEKSEELSEFSKEVHALSSGAKPVATWLGVESLGEARKACGGHGFLHMSRLNTLRDDNDPSQTFEGENFMILQQTSNILLGKVRSLGSIDTPMSTMSFLNKNPSKFSSWTSNPVDDVLSAYRYLAYHLLQMTASDAQKLKNSGKNAFEVRNEIQVHRAVNLSVAYTEHTMIDWVQQFLKDVEDVTVKNVLQKVINLFSLFLLERHLATLYITGYASGGKFGEELREKLRLAVAEIKPESMALVDSIAPDDFILHSALGASDGRAYDHIMEEFRKYTNEQPRWVCDLAQFLQKRSQHAKL

SEQ ID NO: 1411 - protein, 707 aa, Caenorhabditis brenneri
MPLNKLIQDGDNQDLTQERFKATFDTDELAAVFNGGEDRLQRIREVRDELTKRGHLFDALPAAHRTRAERMEDVSRKVRNSAQGFQMTRKMKSDFFEFASLYSEYETNFFIHNFLRFLHPSNYSLLKNLMENVSDFADFTNNADMLIITRDVMGIEGFPLALHNLMFVPTIQNQADDEQQEWWLMDALQGKIIGTYAQTELGHGTNLSAIETTATYDKSTEEFIIHTPTTTATKWWPGGLGTSCTHVILVANLIIDSKNHGLHPFFVPIRDRNSYSSMPGVRVGDIGTKMGVNCVDNGFLAFDNYRIPRRNMLMKHSKVSKEGVYTAPSHPKVGYTTMLYMRSEMITHQAYYLAMAMIISIRYSAVRRQGEIKPGTQEVQILDYQTQQYRLFPGLARCFAFMTAATTVRQMTESCIKELSHGNSDVLADLHALSCGLKAVVTHQSSQSIDQARQGCGGHGYSDASYLPTLYTCSVGACTYEGENMVMLLQLSKYLMKAAAKAEEGAVMAPLVAYLAKSDPIENGDKYGKLLNHFEHVARHRVMHAYRQMIEEEKQGIERDYAFANHSVDWTKAARAHTKLFIARGFVKKVQEVSNEAVRDVLNTLAELYLSYELIEMSSDLTTNGYLPETEVQQIRHQVYDSMRKIRPNAVSIVDSFDICDRELRSVLGRRDGHVYDNLYKWAQMSPLNQKNLPHVEKYLKPMTSKL

SEQ ID NO: 1412 - protein, 614 aa, Frankia symbiont
MGHYKSNLRDIEFNLFEVLGVDNTLGHGPFADMDRDTAHEALAELDRLATGPIAESFADADRNPPVFDASSGSVTLPESFKKSYAQLMEGQWWRLFVPPHLGGMGAPPSVAWAASELVLGANPAVFMYMSGPTFAAILDRLGTAEQKDLARLAIERQWGATMVLTEPDAGSDVGAGRTRAVPQPDGSWHIEGVKRFITNGDWDVPENIFHLTLARPVGHGPGTKGLSMFLVPKFLVDPNTGEPRERNGVHVSNVEKKMGLKVSATCELRYGEKQPAVGWLVGDVHDGIAQMFEVIEYARMMVGTKAIATLSTGYLNALEFARTRVQGADLTRLLDKTAPRVTVIHHPDVRRMLMVQKAYAEGMRALVLYTATIQDRVALAQAAGTRDELAERLNDLLLPIVKGVGSERSYELLATSLQVLGGSGYLQDYPIEQYIRDAKIDTLYEGTTSIQGQDFFFRKIVRDRSTALGALLGEIQAFAKGDAGDGSLRREREVLGVALDNVQSMVGTLVGFLTSVAEDPRNVYKVGLNTTRLLMSVGDLVIGWLLLRQAEVAENALAARGAAGTLSARERAFYAGKVSAARWFAANVLPELSARLGVLAATDLDLMDLPEEAF

SEQ ID NO: 1413 - protein, 587 aa, Methylobacterium extorquens
MSYRAPVEEMAFTLRHVAGLDAVLAQSGAEIGPDDAVAILEEAGRLAGNVIAPLNRVGDRHGTPFSDGRVTTAPGWASAYRAFVEGGWNGVLAAPDYGGQGLPHLIAAACTEMWNGANLAFGLCPLLTAGGVEALAAHGSDELKGRYLEKLVSGEWTATMNLTEPQAGSDLSALRTRAEAQGDGSYRITGAKIYITYGEHDLADNICHLVLARLKDAPAGTRGISLFLVPKVLPDGSRNDLRCSGIEHKLGIHASPTCSMAFGDAGGATGWLIGEENRGLACMFTMMNSARLNVGLQGVGVAEAAYQKALDYARERRQGRAPGSPEPVSAIVAHADIQRTLLTMKAYTAASRGICYLTAQGLDAADGPEGKAAHDRASLLTPVAKAFSTDIANEVTSLGVQVHGGMGFVEETGAAQLMRDARILGIYEGTNGIQAIDLVTRKLPLNGGATVGAQIASMRRVAEGLLKDGTPGFGHAAARLREGIGSLDRATSFLLKALASNRPQEALPGATPYLRLFGLVQGAACLATAGLASSAAVKAGETDPAHAARIALARFFAENLLPAAGGLEQAILSGGDFADDPAFALAG

SEQ ID NO: 1414 - protein, 597 aa, Alicycliphilus denitrificans
MSVLSRELDFQLYECLKADSLTSRDRYHGQSKEDYASVLSAAERLAGDYFAPHYAKGDANEPQFVEGAAHTIAETGEAWRAFAEAGFLSAHWDAEEGGIQLPEPVFRAAMAHFFTANVATMGYPFLSIGAANLLRTFGSEELKRLYLPLMASGICAGTMALTEPGQGSALGDIKTVAEPADDGSYRISGHKMFISGGDQDFSDNIVHMVLARIKGAPAGVKGISLFLVPKFIPRADASRGERNDVALAGLLHKMGWRNTTSTVLSFGEKGGATGWLLGEPNRGLAHMFQLMNEARIGVGLIAACLAYRGFTESLAYARERPQGRLPSCKNPLSPQVRIIEHADVKRLLLTQKAYAEGALALCLQASAWFEDQHSHPDQTRRELAGHLLDLLTPVVKSWPSRYGCRSNDMAIQVLGGSGYTREYPVEQLYRDQRLNPIHEGTEAIHGLDLLSRKVRQADGVGLRAFLNLMRQESDAAEAPLQVLAQALRQGADGLEAVTAKLVAAQSSQPDLALAHATEYLDAFGRVTQGWIWLKQARVAHQALHTADKGSDALHYYRGKLQAARHYFETELPLVHVQFELLTSLPGTTLEMKDEFFL

SEQ ID NO: 1415 - protein, 633 aa, Alicycliphilus denitrificans
MSPQGMPPIISSMTTSLRSTLDFLLYDWLRAASLTARPRFADHSRETFDAVLDTCERIAREKYAPFNRTVDTQEPRFDGEKVILPQCTHDARQAYADSGMLGAAQDYELGGMQLPYVVESAANSFFACASISIGSNLLTTGNANAILVHGTPMQQRVFAANEFNGRWAGTMCLSEPQAGSSLSDIATRAEPDGAGFEADPLGPRYRLRGNKMWISAGDHELTENIVHLVLAKIPGPDGKPVPGVKGISLFIVPKKLVDTEGKLTGERNDVALAGLNHKLGWRGTTNTLLNFGEGRYPVRAGQGGGLDGRGAGAIGYLVGKPGEGLKCMFHMMNEARISIGMAATMLGLAGYYASLDYARTRLQGRPIGSGGKDASSPQVRLIEHADVKRMLLAQKSYGEGALALNLYCARLVDEGRTGDAGAAADARLLLEVLTPIAKSWPSEFCLEANSLAIQIHGGYGYTRDFPVEQYWRDNRLNMIHEGTHGIQAADLLGRKVVMQGGAGLQLLARTVAVTIAKARQRPGLAAWAGQLEQALRDVIDATRAAWATGNAGEALANAVPYMQAFGHVVLAWMWLDVADSVLAKDASLSIAASVGRMGAARYFFHYELPKTGAWLAVVCTRDATCADMAEDAF

SEQ ID NO: 1416 - protein, 568 aa, Desulfatibacillum alkenivorans
MLLLNPKNYQDRNYPDERSKEIMLKTIEFFENKGLAKMKEDYYAADFTDDFTEFIKKEGIFETLFLPKGYGSEDQYYSTYRMYEFSEITGFYGMPYWYTYHVSTLGLDPVFLGDNEELKHRAVETLRKNPLCAFGLSEKEHGADIYSSEMKLYPQEDGTYLARGSKYYIGNGNKASTITVFGKIADTDEYVFFVADSQHEKFELVKNVIHAQNYVSEFILHDYPVTDADITTRGPKAWDDMLNTINICKFNIGSGATGIVTHSFYEAINHAAHRNVYGKFVTDFPHVKRLFLDSYCRLAGMKLFGLRATDYMRAASKEDKRYMLYNPIMKMKVAIQGEEVHEMLWDIIAAKGFEKDNYFSQAVVDLRGFPKLEGTRHVNMALIAKLLPNYFFNPKEYPEVGRITDNRNDDHLFDQGPTRGYGKIQFHDYNIAYNSVDLPNVNIFKKQIKAFADWLMLSGMDLGKQMLNDFDFLLAVGEIFTIVAYGQLIIESAKLENLDDDLLDEIFDVFVRDFSRYALAVNGKPTSTPEQKEAILKCIQSPVVDDDKFNRVLEKHVYSLIDAYTMNP

SEQ ID NO: 1417 - protein, 531 aa, Desulfatibacillum alkenivorans
MSLPDRNNPYSFNAFLDWRENVDYYADDPFAQKVVRTFCGDMAGEVDAAARETSKKASFKWRKLSEALAWPEKRPYMKHYDGHRNRIDRIERPMETQIVEKEVFGEALFSKNTHPWVKLIKMFLMYQNGEYCVSCPLTCTEGLVAVIEPFADTPELKAILNHCKEGVDGEFAIGAQYLSEIQGGSDVPSNLVEAVEEDGVWKLYGTKFFCSAAHADYAMVTAKPKGSEKVGLFVMPSWLPGDKKKERRNSFTIDRIKWKMGTSELPTAELTMNGAVAYQVGPLDRGLANMVGVVLTYSRLTVGLSGASSMIRVWREASKYCEFREAFGVNINFFPMVMGQLADMEKTAKRTLAGAFRLYKEVLDLPGGFLGASKDEDDAMKKKRFMVRELVMLQKICTSWDCPDVVRAAMSMFGGHGVMEDFSALPRLYRDAAVNELWEGPRNVLLTQMHRDLQKAAAWLPPRELVGNILAGRDEGLIKEFQDEIEQIFKHPNLFEMSPETIAVCKQWDSFCHGLYHAYQDQALEMVESQD

SEQ ID NO: 1418 - protein, 592 aa, Rhizobium sp.
MYKAPVEEIAFTLKHVAGLAKAIDDGKLGDLSDDLVDAILSEAGRFASDEVAPLAEIGDAQGARMVDGKVIVPDGWADLYRHWAEGGWNSLTAAEEFGGQALPHMLNVAALEMWNSGSMAFALGPTLTMGAVDAVTVHGADSLKQTYLPKMVSGEWTGTMNLTEPHAGSDLGVMKSRAERRDDGTYRIFGQKIFITWGEHEITENIIHLVLARLPDAPAGTRGISLFLVPKYLVNEDGSLGARNDLHCHSLEHKLGIHGSPTCTMIYGDGKFGDEPGAIGYLIGEENKGLNCMFTMMNNARLAVGMQGVAICEASTQKAVQYAKDRTQGKAPGWTGQGMSPIIEHPDVARMLVTMKALTQGARAICYTCAHATDMSHHEEGEAARHWAERAALLTPIAKSFATDAGVEVASLGIQTHGGMGFIEETGAARFWRDSRIAPIYEGTNGIQAADLVTRKLSLSNGAQVRGFIQELKDTVSAVRTSNLEGFGETADRLEASLADLEETTEWLLAQLAAGNASTALAGATPYQRLFGLALTGVYLAKGALADEEHGRDNRLALCRFAAENIIAETAALKDRVINGAASLEAARALFA

SEQ ID NO: 1419 - protein, 815 aa, Pseudomonas fulva
MLAVWLLVLVLGTAYLAHRRTAPLPALAIVAAYLLIMGAYSHAPGWLMVIFWLLWLAVALPLALPELRRKHFTKPLFAWFQKVLPPMSKTEKDAIEAGTVWWDGELFSGRPDWDKLLAYPKARLTEEEQAFIDGPTEELCAMVSEWQIGQRMDLPPEAWDHIKRHGFFALIIPKEYGGKGFSAYAHSQVAMKLATRSGDLASTVMVPNSLGPAELLLHYGTEEQRNHYLPRLARGEDIPCFALTGPLAGSDAGAMPDSGVICKGQWNGEEVIGLRLNWEKRYITLGPVATLLGVAFKAYDPEHLLGDKEELGISLALIPTDTPGVNIGRRHVPLGAAFMNGPNSGKDVFIPLDYLIGGPDYLGKGWMMLMNCLSVGRSISLPAVGTGAAKFTSLVTGQYSQVREQFNVPLSAFEGIQEALARIGGNAWLMDSARILTANAVDLGEKPSVLSAILKYHLTERGRECITHAMDVHGGKGIIMGPSNYLGRSWQGAPIFITVEGANILSRNLMIFGQGAIRCHPYVLKEMALAGREDRDQALLEFDDLLMQHIGFAVSNAASTLILSLSLGLLGKVPGDRISRPYFRALNRLSAAFAMLADLSMMLLGGELKRRERLSARLGDVLSHLYLASAALKRYHDQDYPEHVRPLLHWALEESLGKAESAIDALLSNFPNRLLGSALRVLVFPFGRRHQGPDDQLDAQVAAIIGRHAGDPALEAVLEGCFRPTSTEDPVGALQHAFNLLQETAPLQKKLHKAVKAGQVRETPGQNEIETAVAAGVLSAEEGQQLQRAEQARRVVIDVDDFSKEELLPSDGKVR

SEQ ID NO: 1420 - protein, 614 aa, Frankia symbiont; identical to SEQ ID NO: 1412

SEQ ID NO: 1421 - protein, 579 aa, Sphingobium chlorophenolicum; identical to SEQ ID NO: 1402

SEQ ID NO: 1422 - protein, 593 aa, Sinorhizobium meliloti; identical to SEQ ID NO: 1401

SEQ ID NO: 1423 - protein, 593 aa, Sinorhizobium meliloti; identical to SEQ ID NO: 1400

SEQ ID NO: 1424 - protein, 614 aa, Delftia sp.
MRLRSTIDFLLYEWLRADALGERERFADHSRDTFDAVLDTCERIAREKYAPFNRTVDTQEPQFDGEKVILPQCTHDARQAYADSGMLSAAQDYDIGGMQLPYTVEAAANSFFAAASISIGSNMLTSGNANAIMAHGTDMQKQVFAINEFNGRWAGTMCLSEPQAGSSLSDIATRAEPDGADFESDALGPRYRLKGNKMWISAGDHELTENIVHLVLAKIPGPDGKPVPGVRGISLFIVPKKLVDTEGQLTGERNDVALAGLNHKLGWRGTTNTLLNFGEGRFPVRGGAGAVGYLVGKPGEGLKCMFHMMNEARISIGMAATMLGLAGYHASLDYAQSRPQGRPIKGAPGAAGKDATRPQSRIIEHADVKRMLLAQKSYCEGALALNLFCARLVDEQHTGTPESVAEARLLLEVLTPISKSWPSEFCLEANSLAIQIHGGYGYTRDFPVEQYWRDNRLNMIHEGTHGIQAMDLLGRKVLMEGGKGLQLLATRINDTIQRAMARPELAGHANELAKALQEVGATTKAAWATDDPQQALANAVPYMQAFGHTVLAWTWLDVSLAVLAKDAALAEPANAGRMAAMRYFFRYELPRIGAWLKVVRERDMTCAQMSEEAF

SEQ ID NO: 1425 - protein, 589 aa, Marinomonas posidonica
MSEYQYPYNDILFSLLSVADIEKLTPYLDEPVDQELLEAILGEAGKLSEQVIAPINASGDSEGSRVENGEVIEAKGFKDAFKAYTEGGWVGLSGDPEYGGQGLPSFIATAVNEGVQSANLAFSLCPLLSHGAIEAISSHASEALKAEYLPKMLSGEWAGTMNLTEPSAGSDLAAIACKAEVDGDAFRVKGQKIFITWGDHQMSDNIIHLVLARLPNAPSGVKGISLFLVPKFLLDDAGNPSQRNDVQVVSVEHKLGIHASPTCVMSFGEQEGALGYLVGEENQGIKAMFTMMNNARQGVGLQGLAIAERAYQQALSYAKDRKQGMKADRSGKAAIIEHPDVLRMLMTMKSQIDAMRSLVYVAAIENDLSHLADGEVKQKAVARTALYTPIVKGWITEQAQEITSLALQVHGGMGFIEETGVAQHARDARILPIYEGTNGIQAIDLIGRKLYSDKGVAMTALLEEISADIKLWSSSGLADQLRKIEAALEQAQKATQTCLQSMEKNSTLGTASAYSYMMLMGYVIGAWLQVKALYSSQRHDGFDQSQKQSWAHSVSFYCDQILPRATSYFQAIESGRDSVESLTESSFIR

SEQ ID NO: 1426 - protein, 815 aa, Pseudomonas fulva; identical to SEQ ID NO: 1419

SEQ ID NO: 1427 - protein, 597 aa, Alicycliphilus denitrificans; identical to SEQ ID NO: 1414

SEQ ID NO: 1428 - protein, 633 aa, Alicycliphilus denitrificans; identical to SEQ ID NO: 1415

SEQ ID NO: 1429 - protein, 619 aa, Pseudonocardia dioxanivorans; identical to SEQ ID NO: 1406

SEQ ID NO: 1430 - protein, 600 aa, Pseudonocardia dioxanivorans; identical to SEQ ID NO: 1407

SEQ ID NO: 1431 - protein, 582 aa, Marinomonas mediterranea
MSDYRYPYKDVLFALNHVANIGRLNDLVDEPLSQDLLEAILTESAKLSEQIIAPLNWSGDQQGAELREGEVYEAEGFKEAFRSYVEGGWASLSGDEVYGGQGLPSTLATAVNEGIQSANLAFSLCPLLSNGAIEALEKYGSQLLKDTYLEKLVSGEWTGTMNLTEPNAGSDLAAIRTKATPHEDHFLIQGQKIFITWGDHQMSENIVHLVLARLPDAPEGVKGISLFVVPKFLVDENGALGRRNDVSVASLEHKMGIHASPTCVMAFGETSGAVGYLVGEPNQGLKAMFAMMNNARQGVGLQGLAIAERAYQQALEYAQERVQGYDSSRKNRVAIVAHPDVKRMLMTMKSLIDASRLLIYVAAVENDVSKLAVGDQAKTAAELTALYTPVVKGWITEIAQEVTSLAVQVHGGMGFIEETGVAQHARDARILPIYEGTNGIQAIDLIGRKLLGDNASAMATLINQIVADVHASQSKYSEAVLSEVALFKQTTTVCLESMKENSTLGTYNAYPYMMQFGYVLGAWLMLKAQAETALEGESASNEERLRCASIDFYCQQILPRARLFGSMIENGTEDVDVSIFKQ

SEQ ID NO: 1432 - protein, 608 aa, Streptomyces violaceusniger; identical to SEQ ID NO: 1409

SEQ ID NO: 1433 - protein, 592 aa, Sphingobium chlorophenolicum; identical to SEQ ID NO: 1403

SEQ ID NO: 1434 - protein, 576 aa, Sphingobium chlorophenolicum; identical to SEQ ID NO: 1404

SEQ ID NO: 1435 - protein, 410 aa, Sinorhizobium meliloti
MTDPKRFAPVLAKAEELGKRFALTARHYDETGEFPFANFDALHEAGLLGLVTATEHGGLGGGLTDALAVVSAIARGEPSTALVLSMHYNQHYSVRTSGKWPPHLVERVTRANREGVALINAAQVEPRVGSPSHGSLPETIARRVGDHWRITGHKTYATGIPLLRWVAVLAVTDEPEPRLGSFLVPTSADGIRVEKTWNATGMRATNSDDLILDDVAIPLEDVLEIAPASEGLKRDERMGAWYFSLVPAIYDGAARGARDWLIDFTTSRAPASLGAPLSTVPRIQDGLGEIEVLLTVNRRLLRSIAEDFDSGRAFGADAAAVKHTVIANAITVTTLALELGGNPGISRDNPLERHHRDALSGKAHAPQNNLIRMMLAKAAFSRHAATHAVALDPVPVRSHQQPRLAVVGRS

SEQ ID NO: 1436 - protein, 410 aa, Sinorhizobium meliloti; identical to SEQ ID NO: 1399

SEQ ID NO: 1437 - protein, 623 aa, Frankia sp.
MGHYRSNLRDIEFNLFEVLGVDRTLGTGPFAEMDRETAHEVLAELERLAAGPLGESFADADRNPPQFDPATGTVRLPESFKKSFASLQEGEWWRLFVPAHLGGLGAPPTVAWAASELILGSNPAVFMYMAGPTFAGILDRLGTDWQKKLAGWAIERQWGATMVLTEPDAGSDVGAGRARAVAQPDGTWHIEGVKRFITSGDWDVPENIFHMVLARPEGHGPGTKGLSMFIVPKFMPDPNTGAPGDRNGVYVTNVEHKMGLKVSATCELSFGERAPAVGWLVGDVHNGIAQMFQVIEHARMMVGTKAIATLSTGYLNALEFARTRVQGADLTQASDKTAPRVTIINHPDVRRMLMAQKAYAEGMRALTLFTASFQDTVAAAEAEAGVPGIHDALSGAAGPDAERAARMNDLLLPIVKGVGSERSYELLASALQVLGGSGYLQDYPIEQYIRDAKIDTLYEGTTSIQGQDLFFRKIVRDKGQALTALLIDIQTFAKGDAGNGALARERDQLAAALEDVQSMVGGMVGFLTTAADDKREVYKVGLNSTRLLMSLGDLIIGWLLLRGAEVALTALADSPGPRDVRFYQGKVAAAKWFAANVLPELHARRVMLESTTLDLMDLPEESF

SEQ ID NO: 1438 - protein, 623 aa, Frankia sp.; identical to SEQ ID NO: 1437

SEQ ID NO: 1439 - protein, 815 aa, Shewanella baltica
MTTLLWIIAMILVLGALAYLRVSLLTATIAAAVVMTAGWTLDVVGPISWIVFLVVALPLNISAFRQNVISRPLMKVYRGIMPEMSSTEKEAIEAGTTWWEADLFAGNPNWKKLHNYPVARLSADEQAFLDGPVEEVCRMVNQHQVSHQLADLPADVWQYLKDNGFFAMIIKKKYGGLEYSAYAQSRVLQKLAGLSSELASTVGVPNSLGPGELLQHYGTPEQQNHYLPRLAKGLEVPCFALTSPEAGSDAGSIPDFGIVCKGQWEGEEVLGMKLTWNKRYITLAPVATVLGLAFKLRDPEHLLGDKEELGITCALIPTDMEGVETGRRHFPLNCMFQNGPTHGNEVFVPLSFIIGGPKMAGQGWRMLVECLSVGRGITLPSNSAGGVKTAALATGAYARIRRQFKLPIGKLEGIEEPMARIGGNAYLMDAVTTLTTTGIDLGEKPSVISAIVKYHLTDRMQKCVIDAMDIHGGKGVCLGPNNYLGRGYQAAPIAITVEGANILTRSMIIYGQGAIRCHPYVLAEMESAFDTESGQGLANFDAAIFGHIGFATSNFIRSFWLGLTSSRFSNAPYSDKTKRYYQQMNRFSANLALLSDLAMATLGGNLKRKERISARLGDLLSQLYLASATLKRYEDEGRQTDDLPLVQWAVEDALYKLQASLDDLLDNFPMGLGGALRVVMFPFGRPLKRPSDVLDHKVAKIMQTPCESRDRLGKGQFWTNSEHNAVGIQEQTLLDIIASEPLHDKVCKASGKRLPFMWLDKVAAEGKALGVLSDDEVNLLERAEIGRMKSINVDDFDPAELRPEVVSTTSQERAA

SEQ ID NO: 1440 - protein, 617 aa, Saccharomonospora paurometabolica
MGHYKSNVRDLEFNLFEMLGVQERLGKGVLSDSDEETARGVLTELNNLAVGPLAESFADADRNPPVYDPKTFSATLPESFKESYRALWDGEWYRIGLTNNLGGFGLPPTVQWAAAELMLGSNPALYMYMAGPNFAMILDRNGTEEQQRWAQLMIDRAWGATMVLTEPDAGSDVGAGRTKAVQQEDGSWHLEGVKRFITSGDQDMTENIMHLVLARPEGPGIEPKPGTKGLSLFLVPKYHFDTHTGEPGERNGAYVTNVEHKMGLKVSTTCELTFGQHDIPAKGWLLGEVHDGIAQMFQVIEYARMMVGTKAIATLSTGYLNALEYAKERVQGADLTRQTDKTAPRVTITHHPDVRRSLMLQKAYAEGLRAVYLYTAAYQDQIWVGEDGSVDADTLSLAERVNDLLLPIVKGVGSERATEQLVQSLQTLGGSGFLQDYPIEQYIRDAKIDSLYEGTTAIQSQDFFFRKIVRDKGQALGHLANEITATIESDRGNGRLKAERALLKTALDDVQGMVGTMIGYLTSGQEDVRNVYKVGQHTVRLLMSAGDLLVGWQLIKQAEVAVEKLDNGASGRDASFYQGKIAVASFFAKQVLPELTARRAVVDAADNDLMEVDEAAF

SEQ ID NO: 1441 - protein, 582 aa, Marinomonas mediterranea; identical to SEQ ID NO: 1431

SEQ ID NO: 1442 - protein, 617 aa, Saccharomonospora paurometabolica; identical to SEQ ID NO: 1440

SEQ ID NO: 1443 - protein, 588 aa, Hyphomicrobium denitrificans
MTYQAPVDDIVFALKTAAGLDDLLQRGLYVGLDADTIGAVIEEAGKFGAEVLAPLNASGDKVGSKFTDSAVTTPPGFRDAYRQFAEGGWSSLPCAETFGGQGLPQIVSAAVGEIWNASNVSFGLCPLLTQGAIHAIEAGSSDAIKAKYLPKMVAGTWTGTMNLTEPHAGSDLGPLSTRAEPQSDGTYRITGTKIFITYGEHDMAENIIHLVLARLPNAPAGTRGISLFLVPKFLVHDDGSLGGRNDVVCAGIEHKLGIMASPTCVMKFGEKGGATGYLIGEENRGLATMFVMMNAARLGVGLQGVGVAERATQQAIAYARERRQGKSFTHNGSGASPIIEHADVRRMLLTMKAMTQAARMICFATARELDIAHLSNVDAERKAALDKAALLTPLAKAFSTDIANEVASLGIQVHGGMGFIEETGAAQYLRDARILPIYEGTNGIQAIDLVTRKLPLQGGAVVASYLAELADVIASVRVSNRPEFGSMAQRLTEALTGLQCATLWMGLNLKSKPEAAHASATPYLRLMSLTAGGTYLAKGALSEDAASPRVAVARFFAENLLTEAAGLAESVQNGADSVLIDAHGALFA

SEQ ID NO: 1444 - protein, 615 aa, Mycobacterium rhodesiae
MTHYRSNLADIRFNFFEVFGRDRLLGTGPWADLDVETAVDMLGAGAELATTELAKSFADTELGDITFDPATGTVSLPDTFKKSYAKYVDAEWWRMDVDPAVGGISVPPSLRWAMAEFTMGSNPAILFYAQGWPLAQVLYEQGNEAQKRIAAWMIERHWGATMVLTEPDAGSAVGSAKTKAIPQPDGSWHIEGVKRFITNGDYDMVENIVHFVLARPVDTAGAGGPGTKGLSLFIVPKFHIDPETGDLGKRNGAVVTNVEHKMGLKASATCELTFGQKDPAVGWLVGDVHRGISQMFEIVEYARMLVGTKAMATLSTGYLNALEYAKTRVQGQDLVSKGDPCAPSVPIIRHPDVRRSLMLQKAYAEGMRALLGFAASVLDDIELARHEGKDLTAALARKDLLLPIVKGFCSEQGYAKLSETLQVFGGSGYLCDYPAEQYLRDSKIDTIYEGTTAIQGIDLFFRKILRDNRSALNALLDEIDAEVAEVGKASELVLVSQRLAQGLVDVRSAVDALMEYSAKAKQDPQMVYLIGLQTTRLVMMLGELLVGWLLSRQALIATSRLAGSPLEDSARSFYEGKVTAARFFAVERLPMLGIERQALEYPANEDIMALQDESF

SEQ ID NO: 1445 - protein, 611 aa, Mycobacterium rhodesiae
MSHYKSNVRDQVFNLFEVYGIDKAFGEGKYTELDADTAKEMLAEMSKLAAGPLADSFVEGDRNPPVFDPETHTVTLPDAFKKSMRALIDGGWDKVGLAEELGGMPVPRALQWALIEHVLGANPAAYMYAMGAGMCEIFYNNGTDEQKKWAVMAAERGWGATMVLTEPDAGSDVGAGRTKAVQQEDGTWHIDGVKRFITSGDSDDLFENIMHLVLARPEGAGPGTKGLSLFFVPKFHFDPETGEPGERNGVFVTNVEHKMGLKVSATCELSLGQHGTPAVGWLVGDVHDGIAQMFDVIEQARMMVGTKAIATLSTGYLNALEYAKERVQGADLTQMTDKTAPRVTITHHPDVRRSLMTQKAYAEGLRALYLYTATFQDAAVAKAVHNVEPDLAAKVNDLLLPIVKGVGSEQAYAKLTESLQTFGGSGFLQDYPIEQYIRDAKIDSLYEGTTAIQAQDFFFRKIVRDKGVALAHVAGEISGLIANEAGNGRLKTERELLAKALEDVQAMAASMTGYLMAAQEDASSIYKVGLASVRFLMSVGDLVIGWLLQRQAAVAIAALDGGATGADRAFYEGKIAVASFFAKSVLPQLTSTRLVIETIDNDIMELDEAAF

SEQ ID NO: 1446 - protein, 614 aa, Delftia sp.; identical to SEQ ID NO: 1424

SEQ ID NO: 1447 - protein, 589 aa, Marinomonas posidonica; identical to SEQ ID NO: 1425

SEQ ID NO: 1448 - protein, 410 aa, Sinorhizobium meliloti; identical to SEQ ID NO: 1435

SEQ ID NO: 1449 - protein, 589 aa, Thiorhodococcus drewsii
MSYVHPYRDAEFVLRHLVDFDALCATAGLDEVNADLAVAILEEAAKLGSEVLAPLNRVGDQEGARMDAQGVEETPGFKEAYGQFAESGWLSLSAAEEVGGQNLPNALNTAVNEIWHSANMAFALCPMLSQGAMESIAHHADETLQALYLPRLATGEWTGTMNLTEPDAGSDLAAIKCKAIPDGDHYRISGQKIFITWGDHRMTENIVHLVLARLPDAPPGVKGISLFIVPKVLVEENGDLGAPNQVRCLSLEHKLGIHGSPTCVMEFDAAIGYLVGEPNKGLAYMFTMMNHARQAVGLQGLSISERAYQGALQYAQERLQGTRRDGSRVAIIEYPDVRRMLMTMKSATEAMRALAMVASAEVDRFRYASDPAEKASHFARLELFTPIVKGWLTEMSQELTSLGIQVYGGMGYVEETGAAQHYRDARILTIYEGTTGIQALDFIGRKTLSNNGEALQLLLDEMQSTAEALRSSGYPDASLVAALDQSLEHGVKARAWILEQAASDRDLAGSASFNFLMLFGYLCGGWLMAREALQARALSEAGEGDPSFLEAKMTTARFYCEHLLPRTQSYLAAVLAGSDSIMALTVDQF

SEQ ID NO: 1450 - protein, 591 aa, Marichromatium purpuratum
MSSYQHCYRESDFVLRHLIDFDGLCVENDFEGVDLDLANSLIDEAARFGAEVLAPLNAVGDREGARMGEGSVVETPGFATAYRQFAEGGWQSLKVDERHGGQGLPDVLNAAVSEIWHAANLSLALCPMLTEGAIEALAEHGDESLCARYLPRLSSGEWTGTMNLTEPDAGSDLAAIKTRAVPEGDAYRISGQKIFITWGDHRMTDNIVHLVLARLPDAPPGVKGISLFVVPKYRLDAHGEPAEANGVRCLSLEHKLGIHGSPTCVMAFDDAWGELVGEPHRGLAYMFTMMNRERQVVGLQGLAIAERAYQQARLYAMERLQGTRRDGTRVAIITHPDVRRMLMTMKSGIEAMRALVLETAAEADRARGANEDARRAHHQARLELFTPIVKGWITEFAQELTSLAIQVHGGMGFVEETGVAQHYRDARILTIYEGTTGIQALDLISRKLLADKGRALGVLFDEMEETLGVLRQADEASLVVLVDPFADGLAAARRACDWVLRGAPDDRQLVGAVSVELLMLLGYLCGGWMQVRSALAAQRAIEDGEGDALFLDAKLKTARFYCEHVLARTQAALTSVLAGSTSLMALDAEQF

SEQ ID NO: 1451 - protein, 591 aa, Marichromatium purpuratum; identical to SEQ ID NO: 1450

SEQ ID NO: 1452 - protein, 589 aa, Thiorhodococcus drewsii; identical to SEQ ID NO: 1449

SEQ ID NO: 1453 - protein, 635 aa, Clostridium sp.
MFFKTTEQHENLRTKIREFAEEEIKPIAFMLDQENKFPSEIVQKLAQMGVMGIPYSKEYGGAGLDVLSYAIAVEELSRVDGGTGVVLSAHTSLGTYPIAAYGTEEQKQKYLVPLAKGEKLGAFGLTEENAGSDAGGTETTAVLEGDHYILNGEKIFITNGGEADIYVVFAVTTPNIGTRGISAFIVEKGSEGFSFGKHYDKMGIRSSATAELIFNDVKVPKENLLGKEGDGFKIAMSTLDGGRIGIASQALGIAQGAYENALEYSKERIQFGKPICQQQIISFKLADMATKLRAARLLIYSAAELKENHEAYSMESAMAKQYASDVCLEIVNDALQIFGGSGYLKGMEVERAYRDAKICTIYEGTNEIQRVVIAAHIIGKMPKNEQVTKTSQSGPITGYRKKVIFKDGTLKEKVNALVEALKADGYDFTVGIPMNTPISKADRVVSAGQGIGEKKNMRLIEDLAAQAGATVGSSRPVAETLKYVPLNRYVGMSGQKFNGNLYIACGISGAGQHLKGIKDATTIVAININPNAKIFKNADYGIVGDLMEVLPLLTSALDNGEPKKEAPPMKKMKRAVPKKVVPTWKHYVCNGCGYEYDPGIGDPEGEIVPGTLFENIPEEWTCPACGEEKDMFIEV

SEQ ID NO: 1454 - protein, 754 aa, Zobellia galactanivorans; identical to SEQ ID NO: 466

SEQ ID NO: 1455 - protein, 667 aa, Caenorhabditis brenneri
MSRWIQDGDNVDLTNERKKATFDTERMSAWIHGGAEVLKRRREILAFVKSVDDFNDPVPVEFLSREERILNNARKVVAMTGNTDQIDGSDFFGEGMYYQALTMGRDLHAMSLHYVMFIPTLQGQTDDDQLDEWLTKAISRAVIGTYAQTELGHGTNLSKLETTATYDPATEEFVLNSPTITAAKWWPGGLGKSSNYAVVVAQLYTKGECKGPHPFIVQLRDDETHIPLKGIRLGDIGPKLGINGNDNGFMLFDKVRIPRNALLMRYAKVKPDGTYVAPAHSKLGYGTMVFVRSIMIKDQSTQLAAAATIATRYAAVRRQGEISPGKGEVQIIDYQTQQFRVFPQMARAFAFMAAATEIRNLYMTVTEQLTHGNTELLAELHVLSSGLKSVVSWDTAQGIEQCRLACGGHGYSQASGFPEIFGYAVGGCTYEGENIVMLLQVARFLMKAAEGVKKGTANLADIGAYIGKTGGKTSRLTTHHHYTDKDLIEDLEHVARKQVFRAYDRLKKAQDHLRPEDAWNSVSVELAKASRWHVRLYLVKNFLNKVSLAPQDLKFVLTDVARLYAYDIITSSIGAFLEDGYMTSQQINEVKEGLYECLAKLRPNAVSLVDSWDYDDKELKSVLGRRDGNVYPALLEWAQNSQLNKTEVLPSYHKYLGPMMKDARSKL

SEQ ID NO: 1456 - protein, 650 aa, Caenorhabditis brenneri
MNSYIKEGDNPDITEERKKASFNVDALTTFYHGGDKQLQNRREVEKYIEDHKELQDTRPTPFMSRDELIDNSLRKIAGMAKFNEMIDMNNIDRTTYFLQLVHVRDSMAFSLHYLMFLPVLNSQASPDQLSEWLPKSLSGTIIGTYAQTEMGHGTNLSKLETTATYDPKTSKWWPGSLGKFCNHAIIVANLWTNGVCEGPHPFFVQIRNLETHESLPNIKLGDIGPKLSLNGSDNGYLVFDHFRIPRNNMLMRYSKVLPDGTYVKPPNAKLAYGGMVFVRSMMVKDIANHLANAVTIATRYSCVRRQGEMKIGAGEVKILDYQTQQYRIFPFMSKVFAFRFAGQQLQEIYKEISKELKMGKLSQLADIHALSSGLKALVTFEVQQGIEQCRLACGGHGFSHASGIPELAAFSCGSCTYEGDNIVLLLQVAKFLMSNCTNSVSSGVCAYLQEKNSSKSSDLTTHQQYSDKQIIQDFEHVARKSVLRAFDKLRLTSQTCQKHEAWNRCSVELCKAARWHVRLYIVRNFLATIAIAQDELKPVLRALAQLFIFDLQVSNKGDFLENGYMKIQQIEELKEGVWQAMSTIRNDAVSIVDAFAIHEFELKSVLGRRDGNVYPGLFEWAKHSQLNKNDVHPAFDKYLAPIITKIRSRM

SEQ ID NO: 1457 - protein, 630 aa, Caenorhabditis brenneri
MSAPLIDKYRKMATFDWRKLKAAVEGEEHVRLKAEVVAKMKSEPIFHRDYRVLSREEHREVVHQRWKKIVEWGLFKDPYSDLENFHALTETLEAYDQGTSARLFLHGNVFGAAVKSMGTERHKELVEKIENNEVCISIRDSAHSHSATHVVVYAQLHVDGKNEGLHGFVIQVRCPRSFQTLPGITIGDMGSKPGCWQGVENGWMEFKNHRAPLSALLNKGCDITPDGKYVTSFKSASEKQSVSLGTLSVGRLGIIAKGMMACTFASTIAIRYSVARRQFGPEKGVENEVPVLEYPLQQYRLFPYLSAAICIRIFQKTFVERFTEYMMRVMMGEKSEELSEFSKEVHALSSGAKPVATWLGVESLGEARKACGGHGFLHMSRLNTLRDDNDPSQTFEGENFMILQQTSNILLGKVRSLGSIDTPMSTMSFLNKNPSKFSSWSSNPVDDVLSAYRYLAYHLLQMTASDANKLKNSGKNAFEVRNEIQVHRAVNLSIAYTEHTMIDWVQKFLEDVEDSTVKNVLQKVLNLFSLFLLERHLATLYITGYASGGKFGEELREKLRLAVAEIKPESMALVDSIAPDDFILHSALGASDGRAYDHIMEEFRKYTNEQPRWVCDLAQFLQKRSQHAKL

SEQ ID NO: 1458 - protein, 676 aa, Caenorhabditis brenneri
MTMVFLNKEIRDGDNPDLTEERKTATFDTNKMAEVIYGSEKLARRRREISQAVSLIPELADSKPLPFLSRNEKILESTRKVTALNEHLPRLINMNDEDEAWHIHSEVIGFEGNPLALHHSLFIPPLVIQGSDEQHEKWLGRAKRREIIGCYAQTELGHGSNIRKLETTATYSLSTQEFILHTPTINALKWWPGALGKSSNHAVVVASLIIKEQNYGPHLFMVQIRDEQSHEPLPGIAVGDIGPKMAFNGADNGFLGFNNFRIPRGNLLNRHCNVEVDGTYVRPPHDKMNYAGMIRVRSRMAAEQGTFMAQALTIAVRYSAVRRQGFLENKSQEVKVLDYQTQQHRLFPAIARSYAFIFCGFETIQKYETLQNEMNSGNVSLMADLHALTSGIKSVVTYQTGEGIEQARMACGGHGYSMASYISEIYGCAIGGCTYEGENMVMLLQLARYLVKSVELAMRGKPGDLGPMVAYLAYPDIKVDLVTGPEAYVKMFQHISKRQSIKATEKFHRKMESGVSRDEAWNQCAVELTRASRLHTRLYIIETFIRRVDSIEDLSIKMVLTDLMNLHLNYELLDVASYALEDGFMSSTQMGFIKNQLYSSLEKIRPNAVSLVDSFQFSDLQLRSNLLNFLFQVLGRRDGHVYQNLFEWAKSSPLNQTEVLPSVTQYLKPMMEKAKL

SEQ ID NO: 1459 - protein, 667 aa, Caenorhabditis brenneri
MAFLNKEIRDGDNQDLTEERRTATFDTDKMAEVIYGSEKLARRRREISHAVSRIPELADSRPLPFLDRFEKVTEGTRKLSVLDRHLAELIDVNDNGEALHLYHEVMGMEGHPLALHEVMFVPALIGQASDEQYEKWLGRAKRREIIGCYAQTELGHGSNLRKLETTATYTPSTQEFILHTPTITALKWWPGALGKSSNYAVVVADLIIKDKSYGPHPFIVQLRDEKTHQPLPGITVGDIGPKMAFNGGDNGYLGFDNFRIPRENLLNRHSRVEADGTYVRPPHAKIGHSAMIRVRSHMATGQGWLLGHALTIAIRYSAVRIQGFLEDKSHEVKVLDYQTQQHRLFPAIARAYAFIFCGFETIRLYDQLILDMNSNGNTSGMADLHALTSGLKSVVTHFVGQGIEQARMACGGHGYSMASYISEIYGVAIGGCTYEGENMVMLLQLARYLVKSVELVKSGKANQLGPMVAYLAVADHKVNLATGPDSYVKMFQYISKRQSWKATEKFLKFMENGDSRDVAWNKTAVELTRASRLHTRLYIMETFIRRVESVTDIPVKSALTDLLNLHLNYELLDVASYALEDGFMSSNQMDFIKNQLYSSLEKIRPNAVSLVDSFQFSDMQLRSVLGRRDGHVYQNLFDWAKSSPLNKTDVLPSVTQYLKPMMEKAKL

SEQ ID NO: 1460 - protein, 676 aa, Caenorhabditis brenneri
MVNYLNKTIQPGDNPDLTEERATATFNTNDMAAQIYGAEKRARRRREITAKIATMPELHDSKPYPFMTREEKILESARKLTILTEKMSEIIDPTDAAELYHLNNEVLGLEGNPMALHGVMFIPALSAQASDEQQAKWLTRAVKREIIGTYAQTELGHGTNLQNLETTATYDVATQEFVLHTPQITALKWWPGNLGKSSNYAVVVAHMIIKGKNYGPHPFMVQLRDEKTHAPLPGVTVGDIGPKMAYNIVDNGFLGFNQYRIPRTNLLMRHTKVEPDGTYIKPPHAKINYSAMVHVRSYMLTGQAIMLAMSLTIATRYSSVRRQGQIDKNQPEVKVLEYQTQQHRLFPSIARAYAFQFAGAETVKLYERVLREMKDGNVSLMADLHALTSGLKSVVTYQTGEGIEQARMACGGHGYSMASYISEIYGVAIGGCTYEGENMVMLLQLARYLVKSAALIKSGQSSQLGPLVAYLGAKSEATSLIDRVPNSGFTEYVKTFQHIARKQTLKAAEKFFGLMERGEKREIAWNKSSVELNRASRLHTRLFIVEAFVRRVNEVGDLTIKEALTDLLHLHVNYELLDCATYALEDGFLSSTQLDYIRDQVYLYLGKIRPNAVSLCDAWEFSDIELRSVLGRRDGHVYQNLFEWAKSSPLNKTDVLPSVNQYLKPMMEKARQGSKL

SEQ ID NO: 1461 - protein, 667 aa, Caenorhabditis brenneri
MSFLNKEICDGDNPDLTEERRTATFDTDRMAQVIYGSEKFAARRRQITKSISRIPALQDTKPLAFMTREEKITEACRELDVLSDHWEQLIYVNDEEEALHLHREVIGMEGHPFALHETMFIPTLVSQASDEQQEKWLGRARKREIIGCYAQTELGHGSNLRKLETTATYSPSTQEFILHTPTITALKWWPGALGKSSNYAIVMADLVIKNKSYGPHPFIVQLRDEKTHQPLPGITVGDIGPKMAFNGADNGFLGFDHFRIPRGNLLMRHNRVEPDGSYLKPPHAKIGYSSMVKVRSRMAMDQGLFMAQALVIAVRYSAVRRQGFLEDKSQEVKVLDYQTQQHRLFPSIARVYAFIFCGLETIQLYEKLILDVNKNGDTSGMADLHSLTSGLKSVVTHFTGQGIEQARMACGGHGYSMASYISEIYGVAVAGCTYEGENMVMLLQCARALVKAVELVEEGHPEKLSPMMAYLTKPSVTVDLTVGPEAYVKIFQLIAKKQAFKATEQLHKFMVAGDSRDVAWNKSAVELTKASRLHTRLYILKTFIRRVESITDISVKAALTDLLNLHLNYELLDVASYALADGIMSSTQMDFIKNQLYSSLEKIRPNAVSLMDSFQFSDLQLRSVLGRRDGHVYQNLFEWAKSSPLNQSEVLPSVTQYLKPMMEKSKL

SEQ ID NO: 1462 - protein, 408 aa, Caenorhabditis elegans
MLSTLSKSARLNQTRFIRLSHSAAAAKDAKPKKVAAVDSPSFVMNLFRGKAVTDQVFPYPLNMTDEQKETLGMVMSPLEKMLVEVNDVVKNDETSDIPRAVLDQFAELGTFGVLVPPELEGSGFNNSQMARVAEIVGAYDLGFGVVMGAHQSIGYKGILLEGTDAQKQKYLPDLATGRKFAAFALTEPTTGSDASSVRTRAELSADGKHYVLNGGKIWISNGGFADVFTVFAQTPVKQADGSTKDKMSAFIVERAFGGVTSGPQEKKMGIKGSNTTEVHFDNLKIPVENLLGKEGEGFKVAMNILNNGRFGIPAACTGAMKHCIQKTVDHITTRVQFGKKLQEFGNIQEKLVEMISKLYATESIVYMLSSNMDRGIKEYQLEAAIGKIQLKYWISKLLCLDKQFKDYS

SEQ ID NO: 1463 - protein, 562 aa, Caenorhabditis elegans
MALHGVMFIPALNAQASDEQQAKWLIRALRREIIGTYAQTEMGHGTNLQNLETTATYDIGTQEFVLHTPKITALKWWPGNLGKSSNYAVVVAHMYIKGKNFGPHTFMVPLRDEKTHKPLPGITIGDIGPKMAYNIVDNGFLGFNNYRIPRTNLLMRHTKVEADGTYIKPPHAKINYSAMVHVRSYMLTGQAIMLSYALNIATRYSAVRRQGQIDKNEPEVKVLEYQTQQHRLFPFIARAYAFQFAGAETVKLYERVLKEMKSGNVSLMADLHALTSGLKSVVTHQTGEGIEQARMACGGHGYSMASYISEIYGVAIGGCTYEGENMVMLLQLARYLVKSAALVKSGKASQLGPLVAYLGARSEPTSLIDRVPNGGITEYIKTFQHIAKRQTLKAANKFFGLMENGEKREIAWNKSSVELNRASRLHTRLFIVEAFARRVNEIGDITIKEALSDLLHLHVNYELLDVATYALEDGFMSSTQLDYVRDQLYFYLQKIRPNAVSLLDSWEFSDRELRSVLGRRDGHVYENLFKWAKESPLNKTDVLPSVDTYLKPMMEKARQSKL

SEQ ID NO: 1464 - protein, 624 aa, Homo sapiens; identical to SEQ ID NO: 434

SEQ ID NO: 1465 - protein, 758 aa, Streptomyces griseus
MATGPGTGIRTGTGIGITEEHRALAHSVRGRLAGAAPPGEVRALLDAGGPAVPGARPAHWKALAAQGLTGIHLPEAYGGGDGGLLDLAVVLEEAAYASLPGPYLATVLTSAVLRHAVAAGAGQQARPLRELAAGDRTAALALAPGTLTATPAEGGHRLDGTAPPVLTAEAADLLLLPAATPDGERWFLVDAATEGLAVRPHRSADPTRPTAEVRADAVHVPAPRALPLDSALVRDLAAVLLAADACGTAARSLDTAVGHATVREQFGRPIGAFQAVKHLCADMLVRIEQARALTWDAARAADESARAAEEGAEGADGTGAGARGLTAALAAATAPEAAYTCAKDAIQILGGIGFTWEHDAHLQLRRAVLARQLLGTADAHRLRAARLAEAGARRELALELPAEAARHRAEARPHLAAARGLTPRDARRALAPTGYAAPHLPAPYGLGAGPVRQLAIQQEARDQGIRLSALSIATWVVPSLLAYGTDEQRERYLPATLRGDLQWCQLFSEPGAGSDLAALRTRAVRTDEGWRITGQKVWTSAARTADHGILLARTDPDAPKHRGLTYFLVDMRNVEGVDIRPLREITGEALFNEVYFDDVLLPADAVVGEVGGGWRVARDTLGNERVHMADQMTFDSGLEALIARSAGLDDTTRARIGALAAEAHALACVGLRGTLQQVAGREPGAGASVRKLVQTLHQQKVAELTLELLGPDGAVDEPAAGERALHGFLMSRCLTIAGGTTQIQLNVVAERILGLPRD

SEQ ID NO: 1466 - protein, 405 aa, Streptomyces griseus
MTAFSLEPEQTAWCEELRTLAAQELRPLAEKGEPGRVNRPLLAALGELGLLGRMLASGALDLCLLRESLARGCTEAETALALQGLGTIPIVRSGTAAHRERWLPEVRAGRAVAAFALSEPGAGSDAAALSLAAEHTADGWRLTGEKCWISNAPEADVAVVFARTTPGAGSRGITAFLVPSDRPGLTGSALDMLSPHPIGTLEFDGVPVTADDVLGEPDRGFRVAMNTLNLFRPSVGAFAVGMARAALDATLDHTAHRTAFGGPLSDLQAVSHQVAEMATRTEAARLLVYAAAAAYDAGESGVPRRAAMAKLYATETAQYVVDAAVQLHGARALRRGHLLEHLYREVRAPRIYEGASEVQRTIIAKELYANDAPRAEPAAAPRPDARPPAAQPPVEPAGLTQEPPA

SEQ ID NO: 1467 - protein, 838 aa, Nitrosomonas sp.
MLAFLFYVILFVVVIASLILAVPLLRRYLVTNQILKIFRKMLPQISQTEQEALDAGTVWWEGDLFSGKPDWKKLLAYPKPQLTAEEQAFLEGPVEQLCAMLDEWRITHELKDLPPEVWQFIKENGFFGLIIPKQYGGYGFSALAHSEVVMKIGSRSGTAAVTVMVPNSLGPAELLLHYGTEMQKEHYLPRLAKGLEVPCFALTSPEAGSDAGAMPDFGIVCRGEYEGKTDVLGMRVTWEKRYITLGPVATILGLAFKLYDPDRLLGKEEDLGITLALIPTNTPGVNIGRRHYPLNGAFQNGPNSGKEVFIPMDWIIGGQEGVGQGWRMLMNCLSVGRAISLPATSVGAAKLAARTSGAYSRVRTQFKTPIGYFEGVEEALGRIGGNTYMMDAARVMTAAAVDLGEKPSVASAIVKYHLTERGRQAINDAMDIHGGKGICIGPRNYLGRTYQQIPVSITVEGANILTRNMIIFGQGALRCHPYLLKEVNAAHDKNPDSASLAFDEALIGHAKFTLRNTANSLVYALFGNHIKDNAPENATPETAAYYRQLARFSASFACIADIGLMRLGGSLKRKERLSARLGDILSMLYLCSATLKRFEDDGRPDSDLPLLHWCMQDAIYRMQQAFDEFLANIPGHFTFVGLLRILVFPLGKRCKPPADALTHEVARLMMAPGAVRDRLTAGIHIPIAEHEPMADLEQALRCVIECGAIEAKLREAVKLRKIADHGDGQIAQALQLNVITAEEASLLEKLKDLRSKVIKVDDFSPDLESEIKGRNAATGNSNTAMSARGAINANYTINNNVTDEADGVNSVSAGNSTKTESRKKSTPVTEESKTIETI

SEQ ID NO: 1468 - protein, 608 aa, Caenorhabditis elegans
MASSSSANATITARHTQYSHAKTGGFSQTGPTLHNPYKDDPILDRTLRRLLPESEYMRVAADLSKFGDRITSEVEHLGRQAELEQPRLEHQDAWGKRVDKLIVCNEWHKLKQICAEEGVISIGYEDSVDPFVRRIHQVAKLFLFSPSAGLVSCPMAMTDGAVKTLTSLNLYGKHKLATEAVDRLRSRDPSKAWTSGQWMTEKKGGSDVAGGCDTYAVQIDKDTYRLHGYKWFSSAVDADVALTLARIVDSDGNALEGSRGLSLFLLKIRDESGNLNGIQMVRLKNKLGTKQLPTAELLLDGAIAERIGDQGRGVAGISNMLNITRIHNAVASLGYMRRIISLARDYSTKRVVFGQTQSKWPLHTTTLAKMEVDTRGSMLLLFEAARLLGLSEAGKSSDVEAMMLRLITPVLKLYAGKQAVPMVSEGIECFGGQGYMEDTGLPTLLRDAQVTPIWEGTTNVLSLDVLRVFSGKENILLAFGKRVEQLLGNTKTEDEKLKKSKEAVESALKQLQKLLVKASDSAIQGETRIDSVARHIAFTIARIYSGALLIDHASDSSVANQSDIEVAYRYCCEQPLIDLRWEWFASERVKADREIVFDNFTALEKSKI

SEQ ID NO: 1469 - protein, 635 aa, Clostridium sp.; identical to SEQ ID NO: 1453

SEQ ID NO: 1470 - protein, 758 aa, Streptomyces griseus; identical to SEQ ID NO: 1465

SEQ ID NO: 1471 - protein, 405 aa, Streptomyces griseus; identical to SEQ ID NO: 1466

SEQ ID NO: 1472 - protein, 696 aa, Frankia sp.
AVELGRVLAPVPFAEHVAAARLLATAAPGHPDLPAVVAGELIATLAPRVRAGVGVAVPAGAVAGLVLAVADGQLVAARSAPPGAAVANQGDLPVADRELRGATVLGGGPAVALFERARAEWLVLMAGWLAGLADGALELTTRWVKERIQFGVPIGSFQGVQHGLADLPGLVDAATLLAREAAWSLDTGRRSETGADGGQLAGMAALVATDAARHAADRAVQYHGGLGVAVEHDAQLFFRRARAYPALAGAPLALARELGRALVDSPSPSAVDGHATLAGTSAQPGDDGAIGTDFAHSPSVAAFAAEVRGFVRSWLTDEVRREARRTGTVHVPALHQALAERGWLAASAPGGRAARDPYELGALFRELELADAPYHGIGTTMIVAGVLDQIGSPALRAEVLPRLLTGEATAVLGYSEPGSGSDVAAARTRAVPVDDARTAWRINGQKMWTTLAHTAAHCLLLTRTNPDVPKHRGLTMFLVPMDSPGITIQPIHTIADERTNVVFYDDVIVPDSCRVGEVDEGWRVMAIGLSLERGVMGSTAMLEPLLADVTAWARVAGPAGDWPGEGRPADDPAVLTAIARARADAEAAFLLTQRTAWLNVSGQSPAVAGTIAKLFASTAYQRASRELQDAVGLGGILRAPSGEGTLPAAAGGEIERAARHSCVVTIQGGTTEIARNLVAEQRLGLPKTRQGTRSSA

SEQ ID NO: 1473 - protein, 798 aa, Frankia sp.
MDLALDETALAARDLVRAVLARHPGLAPARAAQPLGHDPGLWDDLRAAGLPGLAVGAEHGGGGAGLHAAAAAALELGRVLAPVPFAEHTAAARLLAATAPDHPHLAAVVSGELVATLAPRVRCGVGTAVPAGAVAGVVLAIVDETLTATRTDPPGVATPNQGDLPLADRPLGLGSPAAVVLGQGPAAVAAFGRARREWLTLAAAWLAGLGDGALDLATRWVRERVQFGVPIGSFQGVQHGLADLPGLVDGAALLAREAAWCQDAGRRSLTGASGPELALMALHFATDAARATAGRLVQYHGGLGVAVEHDAQLFYRRASAYPLLAGAPRHLLRELGQRLLGAAATDGSVGTVDGSIDAGEGAGEGEGFGHRPEVGAFAAEVRAFLATWLTDEIRQRMRRTGTMHVPALHRAMAARGWLAAPTPGGRATRSVWELSALFRELEIADAPYHGIATTMIVAGVLDQLAGPALRTGALPRLLAGEAIAVLGYSEPGSGSDVAAARTRAEPVGDPPTAWRINGQKMWTTLAHEAAYCFLLARTNQDVPKHRGLTMFLVPLDTPGITIQPIHTIGDERTNIVFYDDVVIPDENRIGEVDGGWRVMAVGLSMERGVMGGTGMLEPLVHDAVAWAARTGPDGSRPGDDPAVLETVARARVDAEVAFLLTRHTAFLSASGQSPAVAGTVAKLFASTAYQRAAGELRDVAGTTGILRGLDHDALATPGPADAGGTGGALEPAAGGQIERAARHSAMVTIQGGTTEIARNLVAEQRLGLPKARGGTRAAGAVANSAPAATVTPAGVTTA

SEQ ID NO: 1474 - protein, 602 aa, Cyanothece sp.
MHQLKQYWVAERLDKDLGDPWTPENVMSFKQVVEIDEKEEFPHSEIEWLYNWKLQHYYVPAECGGEFTSFEEFLAFVRVLCRRDQTIGIAFTTLFWSFITWMAGTEEQKQQLAQYIKNENGAMCLGYSEREHGSDLVGGDLTAQKVPGGYILNGEKWPINRATISGISYILAKTDPEGGPKCLTLFMVDKRQLNPDNYYNLPKILTHGIRASDMSGIGFKDCFVPDSMRIKEEGDGLEFALKGFQVTRTFCAAFSLGAADTALRTTLNFAIKRVVYGKKVIDIPQPRKVLVDAFLDILICDCETIGAARGFHIIPEQFSVWASVTKYFVTTQIETMINSVYTVLGSRFYMREEHDWGIFQKVLRDNSIISMFDGSTVVNLHALMLQFRQLTKQRSRRKPEAIADLQKRLEAIFSLEQPLPSFNGEKLELFGRGADDPLQGLEIALQQLEAFKETTDTDEEVLEKLIVLGNLVLEELNAHDELIANSKFEYGHDQSPELFEVAKTYCTLHAAACCLQMWLYNRTILGDFFAQGEWLVLSLHRLLRTMRPLPYSISDVYVENTAQELLKLYKEDKLFSIVPFQLAHSPINEDRSYATSKLQLQA

SEQ ID NO: 1475 - protein, 798 aa, Frankia sp.; identical to SEQ ID NO: 1473

SEQ ID NO: 1476 - protein, 696 aa, Frankia sp.; identical to SEQ ID NO: 1472

SEQ ID NO: 1477 - protein, 814 aa, Fischerella sp.
MNLIHPTVVISTLIFLLLLLGYMGFPLWVWSVYLAVLLVYFQSPIWIWVIFGAIACIFNIPILRQKLITSSLIKAIKALNLLPKISDTERAAIEAGNVWVDGEFFSGKPDFQRINLEPYPQVTPELQAFLDGPVEQVCRMVSDWEIYLRKDLPPEVWDYLKKERFLGMMIPEEYGGLGFSNFAYSSVMTKLASRSFTHIATVGVTNSLGPAKLLLRYGTQEQKNYYLPRLARGEEIPCFALTEPTAGSDAASIKSEGIVFRGEDGKLYLRLNWKKRYITLAAIATLLGLAFKLRDPEDYLGKGKDVGITCVLIPTDTPGVIMGRRHDPMGVPFYNSPTEGHNVVVSVDQIIGGVEQAGNGWKMLMQTLAAGRGISFPASCTGVAKLVARVTGAYAVVRQQFGLSIGRFEGVEEPLARIGSLTYLMESVRNYTCGAVDKGEQPAVISAIAKYSLTELSRKIINDGMDIMGGAGICRGPRNLLANIYTATPISITVEGANILTRTLMIFGQGAIRCHPYVYQEITALEQSDVTAFDQAFWHHLGLTVRNTFRALLLSISRGYLAASPVPGATAKYYRKLEWASATFALLTDITIFSFRGALKRQEKLTGRFADILTWMYLATATLRRFEAEGRKPEDLPFVHWVMQYAFAQIQSAFEGIFQNFSVPVLGTLFAGPVSWWWRLNPIGSLPNDKLGSEVARKLQTPGQIRDRLTAGIYIPASSEEALGRLEKAFILLSQAEPLLKKLKNASQTEKLPQQKPDELISAALQAGVISNKEVELICEAEFARNDAIQVDSFTLEEYLQGTQESKGRWQMVK

SEQ ID NO: 1478 - protein, 403 aa, Desulfosporosinus meridiei
MWIAEGQVLKVSRKLVKNERIDFIMIFDLTEDHLMMRKMVRDFAEKECGPGAEERDEKEEFSVDLWKKAGELGLAGVTFPEEYGGVGADYISYAITVEELSRVDASVGVTISAHASLCANPINMFGNEAQKKKYLTPLATGEKLGAFGLTEPMAGSDASGTRTTAVRDGDFYILNGSKIFITNAYYADTYVVTAQMDKSKGNRGIAAFIIEKGMPGFSFGKKEKKMGIRSSATYELVFEDVRVPAENLLGQEGQGFKVAMQTLDYGRIGIASQALGIAQGAYEQAMKYTKERVQFGKAISEFQNTQFKLADMATQIEAARLLVYQAAYLASQHKPVSKAAAMAKLFASETAMAVTTMGVQLHGGYGYTREYPAERMMRDAKITEIYEGTSEVQRMVIAANILK

SEQ ID NO: 1479 - protein, 602 aa, Cyanothece sp.; identical to SEQ ID NO: 1474

SEQ ID NO: 1480 - protein, 814 aa, Fischerella sp.; identical to SEQ ID NO: 1477

SEQ ID NO: 1481 - protein, 403 aa, Desulfosporosinus meridiei; identical to SEQ ID NO: 1478

SEQ ID NO: 1482 - protein, 838 aa, Nitrosomonas sp.; identical to SEQ ID NO: 1467

SEQ ID NO: 1483 - protein, 573 aa, Thiocystis violascens
MANYFTDNTDLLFHFDRLKLQEVVDIAEHGYTESTDYNFAPVDYQDALDNYRKVLEIVGDITANNVAPQAAAVDEEGSHFADGKVAYAKGIQEALSLLTQAELMGFTLPRRYGGLNIPTTLYTMAIEMVSRAEASLMNLFGLQDIAETINKYGTEEQRQEFLPQFASGAATGAMALTEPDAGSDLQAVNMLAYQDDDGQWRLKGVKRFITNGNAEILLVLARSEPGTKDGRGLSLFACYGKDNVVVRRIENKLGIHGSPTCELQFNDTPAQLIGKRKFGLIKYVMDMMNGARLGVAAQGLGISQAAYDEALRYAKAREQFGKSIYAIPVITNLLMDMRVTLESDRSLLYAACHWVDLRNKLEEKVEELKAEGKDSSAQSAKLKEATRVAALLTPMAKYVLSENANRVTYDALQIHGGTGYMKEFNVERLTRDARITNIYEGTSQLQIVAATGGVINDIFAEDFTAREQKETSGSLARLADELKEMRVLFLDALKYVTDKTDKHFQSIAAKELVEIYSYLYTGWLLMDEAEEDSRKVFIARRYIIGASAKARRNWDVIKKDQFADLLHADEILI

SEQ ID NO: 1484 - protein, 573 aa, Thiocystis violascens; identical to SEQ ID NO: 1483

SEQ ID NO: 1485 - protein, 438 aa, Homo sapiens; identical to SEQ ID NO: 1362

SEQ ID NO: 1486 - protein, 661 aa, Rattus norvegicus; identical to SEQ ID NO: 493

SEQ ID NO: 1487 - protein, 661 aa, Rattus norvegicus; identical to SEQ ID NO: 493

SEQ ID NO: 1488 - protein, 756 aa, Thiothrix nivea
MNWLTEYRQKYISHPVMRLMKQQLPPISSTEQDALDSGNVWWDSELFSGKPDWRRLRDLSISKLNAEEQAFLDGPVEALCRRLDDWQITHELRDLPPDIWDFLKQHRFFGMIIPKQYGGLGFSALAHSQVVMKVSSRSATAAVTVMVPNSLGPGELLMKYGTQAQKDYYLPRLADGREIPCFGLTGPEAGSDASSIPDHGVVCRQDFNGDKNVLGIRLNWEKRYITLGPVATLLGLAFQLYDPEHLLGDKEEMGITVALIPTDHKGVEIGTRHYPLDIPFQNGPNRGRDVFIPMDWLIGGREQAGNGWRMLVECLGEGRGISLPALSTGAAKVASRYTGAYARVRQQFGMPIGYFEGVEEPLARILGNTYLMDAGRILTATAIDQGQRPAVITAMLKYQLTERMRRLVNDAMDISGGAGICMGPSNYLARAYQSIPIGITVEGANILTRSLIVFGQGAMRCHPWLLKEIQAVQADDVAAFDHAFLGHVKHIFANLGRSIWYGLSNAVFVVSGSPLTRCHYRNLSRLSSQFALLADYAALSLGGSLKRRERLSGRMADILANLYLCSAVLKHFEDQGEPEADLPLMEYACALTIHRAQQAMLAAFHNLPYPWLAKTLRTLMFPYGKPFGPPNDQLIHQVARLALEPSATRDRLTAGVYITNDPADRMGRIEDALHKTLAAADIEKQLRKLLKEGKLEAHTTDEAIAEARDKGLLDKFSAERLLAARKAVLNAIRVDDFPAEYFHKVGSYTAAQQVKG

SEQ ID NO: 1489 - protein, 756 aa, Thiothrix nivea; identical to SEQ ID NO: 1488

SEQ ID NO: 1490 - protein, 736 aa, Homo sapiens
MGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 1491 - protein, 604 aa, Desulfosporosinus acidiphilus
MASNFRYNTRDHKFIIKEWLDGKKILGLKRFRDIYSMEDVDGILEQALKVCKDVVAPTNDDGDTMKAVFKNGNVMVPPSFHHAFKYVADNGWGASNKDVDGEASLPSLLYGAVHEYMIAANPAFVAYLGLPGGVASVIKQFGSKEQIDFFTPKLFATTWGGTMCLTEPGGGSDVGDMLSKAYPTDDPRIYKIKGTKCFITCGDHDLTENIIHLVLARIDGGVPGTKGLSLFLVPKIWVNEDGSLGEPNDVVTVGIEHKMGLQGSATAVLNFGEEGLCRGFLLGAPLDEKGQGQGMAQMFKMINGSRVDTGHCALSVATVAYNNAVAYAKERIQGRPINNPKGNRVPLIQHEDIRRMLLTQKATLEAMRAMIFKGYYTLDLISFGDDPEDVRKAKRYIEVITPLIKAYCSDQAWLMITEAIQVHGGYGYTEEYPIARQARDCKIYSIWEGTNFIQSLDLVFRKWGLDKGSVFKDWLQEIVEFVRENSANREFPREFAILSQALKAYQELMAAVFVYMKEDIRFVPLYTTRILRVTAELYGAFLLMQQALVAREKLTQGIVDEDFYKGKISSAQFYLRNILPDVMATVQIIKDYDPSAIEIPEGAF

SEQ ID NO: 1492 - protein, 612 aa, Desulfotomaculum kuznetsovii
MAEFVYDIRDLKFIIKEWLNMEEIFNLEKFKDNYGMDDIDLILDEAYKIAREVIFPINKEGDRIGVKFENGRAKLPPGYVEAYKFLQENGWGSANESLASETAMPLTLYRAYNEMFIAASPALMSYVKLTTGAANLIYRFGTDKDRKLFLENMLSGKWSGTMCLTEPNAGSDVGDATTRAYPTDDPRIYKIKGTKMFITGGEVDLGENIIHMVLARPEGGAPGSKGLGLYIVPKIWVNDDGSLGEPNDVTCIAIESKMGLKASATAMLSFGENDNCRGILVGDPPDSEGRSKGLAMMFHMMNESRIGTGHNALAQMAAAYYFASRYAAERIQGRPFTNPKAERVPIIKHADVRRMLMEMKAQVEAIRAMVFRGFYYLDIAEYSKDREKAARYRGFADILTPLIKTYASETAWQMVALAIQVHGGVGYTEEYPVSQYARDVKILSIWEGTSFIQAMDLVGRKMRMKDGLPFASWLDERKEFIEQNKDADGFVAEMRKLEKAYQCVAEIKDIYASYYANIAEKGELIPLYALRVLTCCAQLFAAESLMDQALVARRKIEELGVNHHDYTYYAGKITTAKYFINNILPNVYMLADQIKEADKSALECPEEALVIG

SEQ ID NO: 1493 - protein, 443 aa, Pseudonocardia dioxanivorans
MAIDFTLSDAQKKVQHDARDFAEGVLAPAVRDADREPDPLKAFQRTKPVYVEAYKAGIAFCMLPKQYGGGGLTNVELILAAEEICAVDPGFACTVLVNGLGLLPVWYWGTEKQKSEVLGAATSDPTGEWIAGYGASEPAGSPGGTANFDTPLPQPAGIGVTARFDGDCYVVNGRKYWPCNVGGWDNRGANTSLYVVRTDPEKGGTEGLAALLVDRDTPGVTFNTIDSFGHRLTPNSEVIFDNARVPVENIVEGTKGNGDLLINRNFAWSGPVAGIAAVGVARAAYEAALSWAKTFTAGGPHPIIHHQYVGYVLGDVAGKIEAARYFCWKAAHYIDQHDYHGELIGAMNKVFCTETLFDAVYKCLQVVGVNSADRKHDFEKYLREAAIFPIYDGGNFGMQRRRVHGIIADPTFDPRALMDDEYVEFTKQMETIDTVAAPTAVAV

SEQ ID NO: 1494 - protein, 417 aa, Pseudonocardia dioxanivorans
MAESTTTPATTPTTTPTTTAPVATDVPVEFDVTDEQRELRAAVRRFCAEQSDEAAVRRHMESEVGYDPAVWARLGGELGVLGLAVPEELGGAGAGLVEQAIVVEELGAALLCGPVLGTIGLALPALVAATPGPLRDELVPSLVDGTRTAALAAPEHAGLFDGHAITVGAVHAGDGWELTGVVNQVVDAPGADLLLVAASGPEGVALFAVPAAIEQVEVEPLTTLDLTRRQGTVRLREAPARLLAGADEIDGVLGHAFYVGSALLAAEQVGGAQHMLDATVAHARERLQFGRPIGSFQAVKHRLADMLVQVEHARSTAQHAAWALQSGADDPFLATSIAQATCSDAYYRVAADAIQLHGGIGFTWEHRAHLYYKRAVTDAALLGGAEIHRDRIAAAVLDHVVATPGVPPVADGRPAPS

SEQ ID NO: 1495 - protein, 604 aa, Desulfosporosinus acidiphilus; identical to SEQ ID NO: 1491

SEQ ID NO: 1496 - protein, 825 aa, Stenotrophomonas maltophilia
MSIVLPFLALLLAGAFVAYHRMRLVTWTLISVALLAACWFIPYVNQTATIVAAAVLAVIAVPLLLPFIRKPLLTGPMMKVFRKVLPPLSQTERIALETGSVGFEGELFTGDPDWNILLNYPKPQLTAEEQAFLDGPVEELCTMVNDWEITHVHADLPPELWAFIKKNKFFGMIIPKEYGGLGFSALAHHKVIQKLASVSSVVSSTVGVPNSLGPGELLVHYGTQEQKDQYLPRLADGREVPCFGLTGPFAGSDATSIPDYGIVCKGEWNGEQVLGVKLTFDKRYITLAPVASLIGLAFRMYDPDGLIGETRDIGITLGLLPRDTAGVEIGRRHFPLNSTFQNGPIRGKDVFIPLTQLIGGAAMAGKGWNMLNECLAVGRSITLPSTASGGAKAGAAVTGAYARIRKQFGLSVGRFEGVEEALARIGGKAYKISALSQATAAAVDRGDVPSVPSAIAKYHCTNMSREVISDMMDVIGGKGIILGPRNFAGRSWQAAPIAITVEGANIMTRSLLIFGQGAILCHPWVLKEMKAAQDPDTRAGLQDFDRSLFGHIRFGISNAVRSFWFGLTGARFGAAPGDAYTRRYFRKLDRYSANLALMADISMMTLGGKLKFKESLSGRLGDVLSHVYMTSAMLKRYHDEGAPQADQPLLAWAFHDSVHKIEESLSAALRNFPIRPIGWLMWALIFPLGRRAEAPGDRLSRRVAALLMAPNEARDRLASGVFLTPCENNPGGRINSYLSKAIMAEPVERKFLKALKSKGIEALDFKAQLDEAVAEGVITQDERSLLEELRTLTLDTITVDDFDTHELRAASYYDRQHKDPHSQAA

SEQ ID NO: 1497 - protein, 513 aa, Runella slithyformis
MGKSLFVCMLISLQNAFVRRYDTVILSELNFQVLPGEQWAIVGENGSGKTTLLEVLAGKWPVWRGKLTHSYGDVLLSKVAELVPSDYSFNRIIASAAQYYQQRFHSFEAEIAPTVREVLTNQLKPVGTVDEHSVQLPVSDISEEELLKTARLLSIDHLLDRPFVTLSNGETRRMMLTRSLLKKPKLLLLDNPFAGLDVHSRDVLRTALKQLKDDRISVIFVTTSTEIPESVTNILTLKEGRITGVSAGGASFKDASENKAGPDFPVTAALPAESGPLKGDKAAAAAFQGFEWAVDLRNINVTYGSKKVLMNVNWKIRKGEKWALVGPNGSGKSTLLSLLTADNPQRFANDYDLFDLKRGGASMWDVKSKIGHVSPELHLYFPQETTVFKAIASGFFDATGVYFRKLTEEQIQRTQVVAEWLNVSAFIEKPFKNISKGQQRLVLLARALVKNPPLLILDEPCQGLDFAAVEHFKEVVDAICDTPERTLIYVSHYAHEIPSCVTQTLRLEDGKVV

SEQ ID NO: 1498 - protein, 815 aa, Shewanella baltica
MTTLLWIIAMILVLGALAYLRVSLLTATIAAAVVMTAGWTLDVVGPISWIIFLVVALPLNISAFRQNVISRPLMKVYRGIMPEMSSTEKEAIEAGTTWWEADLFAGNPNWKKLHNYPVARLSADEQAFLDGPVEEVCRMVNQHQVSHQLADLPADVWQYLKDNGFFAMIIKKKYGGLEYSAYAQSRVLQKLAGLSSELASTVGVPNSLGPGELLQHYGTPEQQNHYLPRLAKGLEVPCFALTSPEAGSDAGSIPDFGIVCKGQWEGEEVLGMKLTWNKRYITLAPVATVLGLAFKLRDPEHLLGDKEELGITCALIPTDMEGVETGRRHFPLNCMFQNGPTHGNEVFVPLSFIIGGPKMAGQGWRMLVECLSVGRGITLPSNSAGGVKTAALATGAYARIRRQFKLPIGKLEGIEEPMARIGGNAYLMDAVTTLTTTGIDLGEKPSVISAIVKYHLTDRMQKCVIDAMDIHGGKGVCLGPNNYLGRGYQAAPIAITVEGANILTRSMIIYGQGAIRCHPYVLAEMESAFDTESGQGLANFDAAIFGHIGFATSNFIRSFWLGLTSSRFSNAPYSDKTKRYYQQMNRFSANLALLSDLAMATLGGNLKRKERISARLGDLLSQLYLASATLKRYEDEGRQTDDLPLVQWAVEDALYKLQASLDDLLDNFPMGLGGALRVVMFPFGRPLKRPSDVLDHKVAKIMQTPCESRDRLGKGQFWTNSEHNAVGIQEQTLLDIIASEPLHDKVCKASGKRLPFMWLDKVAAEGKALGVLSDDEVNLLERAEIGRMKSINVDDFDPAELRPEVVSTSSQERAA

SEQ ID NO: 1499 - protein, 815 aa, Shewanella baltica
MTTLLWIIAMILVLGALAYLRVSLLTATIAAAVVMTAGWTLDVVGPISWIIFLVVALPLNISAFRQNVISRPLMKVYRGIMPEMSSTEKEAIEAGTTWWEADLFAGNPNWKKLHNYPVARLSADEQAFLDGPVEEVCRMVNQHQVSHQLADLPADVWQYLKDNGFFAMIIKKKYGGLEYSAYAQSRVLQKLAGLSSELASTVGVPNSLGPGELLQHYGTPEQQNHYLPRLAKGLEVPCFALTSPEAGSDAGSIPDFGIVCKGQWEGEEVLGMKLTWNKRYITLAPVATVLGLAFKLRDPEHLLGDKEELGITCALIPTDMEGVETGRRHFPLNCMFQNGPTHGNEVFVPLSFIIGGPKMAGQGWRMLVECLSVGRGITLPSNSAGGVKTAALATGAYARIRRQFKLPIGKLEGIEEPMARIGGNAYLMDAVTTLTTTGIDLGEKPSVISAIVKYHLTDRMQKCVIDAMDIHGGKGVCLGPNNYLGRGYQAAPIAITVEGANILTRSMIIYGQGAIRCHPYVLAEMESAFDTESGQGLANFDAAIFGHIGFATSNFIRSFWLGLTSSRFSNAPYSDKTKRYYQQMNRFSANLALLSDLAMATLGGNLKRKERISARLGDLLSQLYLASATLKRYEDEGRQADDLPLVQWAVEDALYKLQASLDDLLDNFPMGLGGALRVVMFPFGRPLKRPSDVLDHKVAKIMQTPCESRDRLGKGQFWTNSEHNAVGIQEQTLLDIIASEPLHDKVCKASGKRLPFMWLDKVAAEGKALGVLSDDEVNLLERAEIGRMKSINVDDFDPAELRPEVVSTTSQERAA

SEQ ID NO: 1500 - protein, 815 aa, Shewanella baltica; identical to SEQ ID NO: 1498

SEQ ID NO: 1501 - protein, 815 aa, Shewanella baltica; identical to SEQ ID NO: 1498

SEQ ID NO: 1502 - protein, 416 aa, Streptomyces griseus
MGALNVTARPDLAAPVTEAGSTLLALVGEQTPALRADADERDRTGTFPDKVFEHFGTSGVLGGTVPAELGGLGVGSLHDIALVLEEVARADASAALALHVQFSRGLTLTYEWRHGKPEAAALAERMLRAMATGTARVCGAVKDHPSAVTRLEPDGTGGWLLTGQKTLVSMAPVATHFFAYALVESEGRTCLAAPLIARGTPGLTVLDTWDGLGMRSSGTWDIRFDRCRVPDADVLVRGPVGERGDAALAGQTVSSITMLGIYLGIARAARDAAVEWQRGRSGAPAAVRVLVADVEARLYAARATTAAALAEADALTAEAPDPAVRGPRMMTPFQCAKLTLNRLALDIVNDCLTIVGGASYAGASTLSRLYRDVRAGWFMQPYTYPDAVDYLSARALRIDHDDDYMSTRAARFAGRG

SEQ ID NO: 1503 - protein, 825 aa, Stenotrophomonas maltophilia; identical to SEQ ID NO: 1496

SEQ ID NO: 1504 - protein, 612 aa, Desulfotomaculum kuznetsovii; identical to SEQ ID NO: 1492

SEQ ID NO: 1505 - protein, 443 aa, Pseudonocardia dioxanivorans; identical to SEQ ID NO: 1493

SEQ ID NO: 1506 - protein, 417 aa, Pseudonocardia dioxanivorans; identical to SEQ ID NO: 1494

SEQ ID NO: 1507 - protein, 416 aa, Streptomyces griseus; identical to SEQ ID NO: 1502

SEQ ID NO: 1508 - protein, 562 aa, Frankia sp.
MRSPTAGEAPPRSFIDALASGRLPWELFAAFPEPGPRETAAGDEFLAQFGPFVDGWVDGDELDRTRIWPDGLLEELRDRGYFQLTAPAELGGRGLSPYNLIRVVVRAARRSMGVGQMLCVQNGIAASALLPAVPAGPLHDFLRAEIAAGSVSGFGDTDPAGQNNTLPAATATLTEDGSSYLLRGEKLFIANAGIADVLGVSATVTEPDGPRAGVFFLTTGTPGFEVVAPNDFIGVNGLSASFRLNDVRVPREHAILGDGAARLPRTIALQGLYGRTALGAAGSLAVIRNCLEYCAEFLSRRRIDGRGLAEYDKVQRIVAGVLAAEFAVESAVRWTTLDPGPEDRSFELYVTKNLATALAWRASDRTVALLGGEGIETAQSKRRRGAAAHPVERYHRDARVLRTVGNVDYVNDLRAGQLVLAHYGDPGEEGAAGAFSVPDLSGADLSAANRRHLSAAADLFQNLHRTCRRLADRHGDPAEPGERQEPVILVGELATELFGICAVLGRAARSGGAAEQDLADVYATAAGFRVADLTRRLATEQEPNPPDYAKISRAWLAAQESL

SEQ ID NO: 1509 - protein, 409 aa, Frankia sp.
MDFAQTEEQRDLAALARQILTERVTPERLATLEADVLAGTGEPRFDRELWAQLAKANLLGIGVPAEYGGLGYGVLEECVVLEEAGRVLAPVPLWACATVGAGAIAAHGTEAQRRGWLPGLVSGEKIVTVALAEPRGSDAAAPATTATRLAGSGSSSSSAGGVGPDGGVGVGVGAGWRLDGVRTAVPFATVADAVLVPARTGTGVGVFLVDPAAAGVTVERQLTTAREVTGLLRLEGVVVGDDALVGGPAAAEGDAVAVALRDRATLGLCALQLGVTERAMRAAAEYTSNRQQFGRPIGSFQAVGHRLADCYIDVEAIRLTMWQAAWQLAEGWDASSAVATAKFWAADGGHRVASAVVHVHGGMGIAEEYFVHRYFLHAKQLEFTLGGAGEQARRLGDLMAAAPAPDHVV

SEQ ID NO: 1510 - protein, 409 aa, Frankia sp.; identical to SEQ ID NO: 1509

SEQ ID NO: 1511 - protein, 562 aa, Frankia sp.; identical to SEQ ID NO: 1508

SEQ ID NO: 1512 - protein, 604 aa, Desulfosporosinus meridiei
MASNFLFSNRDHKFIIKEWLNGGKILGLKRFQDYLSIEDVDGILDQSLKVCKEVVAPTNDDGDTIGAIFKDGKVTVPPSFHKAYKYIQENGWGASNSDVEGEGALPEILNQAVREFIIGANPSMSPYIGLSGGIGSVIKAFGSPEQIALYTPKMFQGIWEGTMCLTEPGGGSDVGDMTSKAYATENPLIYKMKGTKCFITGGDHDLTENIIHLVLARVDGAAPGTKGLSLFIVPKIWVNEDGSLGESNDVSTVGIEHKMGLKGSSTAVLSFGEEGQCRGVLLGSAPDERGFGQGMAQMFKMINGSRLDTGHSALAVATVAYNNSVHYAKERVQGRPIHNPKGDRVPIIQHEDIRRMLLTQKATLEAMRAMIFQGYFFQDLIEFGDDPADVAKAKRFIEVITPLVKAYCSDQGWLMITEAIQVLGGYGFTEEYPVARQARDVKIYSIWEGTNFIQSMDLVGRKWNLDKGTIFKEWIMEIAEFVQVNQNHETFAREFQVLGKALLAYQDLLGTVLGYFKENIRLVPLYSTRILRITAELYSGYLLIQQAIVAQTKLNQGNEDKDFYQGKVQSARFYILNILPDVMATVKIIKEADTSAIDIPEGAF

SEQ ID NO: 1513 - protein, 604 aa, Desulfosporosinus meridiei; identical to SEQ ID NO: 1512

SEQ ID NO: 1514 - protein, 609 aa, Mycobacterium rhodesiae
MSHYKSNVRDLEFNLFELLDLEKALGDYPDLDGDSVREMLAEAARLAEGPVAESFAETDRHPPTFDPDTHVVSLPEPFTKSMRAWQQGEWFRIGLSEEVGGVPAPAMVTWAIDELVLGANPAVFMYMAGPIMANILFHIGTEQQKHWATLAAERNWCATMVLTEPDAGSDVGAGRTKAIDAGDGTWHIEGVKRFITNGDTGDYFENILHLVLARPEGAGPGTKGLSLFVVPKFLLDPETGAPGDRNGVYVTNLEHKMGLKASATTELSLGLHGKPAIGWLVGDVHNGIAQMFKVIEYARMFVGTKAIATLSTGYLNALEYAKTRVQGADMTQMTDKTAPRVTIIHHPDVRRALMTQKAYAEGLRALYLYTAAHQDPAVAQVVSGADASMAERVNDLLLPIVKGVGSERAYQTLTESLQTFGGSGFLQDYPIEQYIRDAKIDSLYEGTTAIQAQDFFFRKIARDQGGALAHVVTQIEKFIDSPDARPELAAARASLADALDNVRAVATVMTGYLLGAQDNARDLYRVGLESVGFLLAVGDLLIGWFLLRQAEIALRALDGDPDPREEAFYRGKVAVANFFAANMLPRLAAERKIAESIDLTIMDLSEEAF

SEQ ID NO: 1515 - protein, 776 aa, Thiocapsa marina
MTILIIAFGTIAATIAALTLFAPLRRHLITRHLLAQFRRVMPAMSRTEREALEAGGTWWDAELFSGRPEWSRLRDLPPARLSPAEQAFLDGPVEQLCRMLDDWRITHEDLDLAPEVWSFIRRERLFGLVIPTRYGGLGFSPLAHSEIVMKLASRSITAAVTVMVPNSLGPAELLLRYGTQAQRERWLPRMASGEEIPCFALTGPTAGSDAASTPDIGVVCQGLFKGHPTLGIRIDFDKRYITLGPVATLIGLAFRLTDPDQLLGDDPQPGLTLALIPADTPGIERGRRHLPLGIPFQNGPLVGRGVFIPVDWVIGGRDGIGKGWRMLMESLSEGRGISLPALATGGGKLAARYTGAYARIRKQFGRPIGDFEGVEAALARIAGRTYQMDAARRVFLAALQAGEHPAVLSAVLKYQLTEAYRRVINDAMDVQGGSGICLGPANPLGRVYQAIPIAITVEGANILTRNLIVFGQGALRCHPHVLEEFRAAGDPNPTRAPERFDAAIAGHVGFLIRNLLRTLRDGLTGGHLAARPIAGWLGSHYQRLDWLSSVFALNADLAMMTLGGSLKRRERLSARLGDILSLLFMASCTLKHFEDQGRPEADRDLVEWAMADHLMRIQEALVALWRNFPRRGLARLLRMISFPTGLPFEGPSDALEHRVARLILEPGASRDRLTAGIFGSRDPSLAVGRMELALTAATRAEEIRHVLRAAIRQGRLGEGDGRTQIREAVAARLITADDAAALREAEQLRDAVIGVDSFAALRPLQPRVQDEARAAA

SEQ ID NO: 1516 - protein, 776 aa, Thiocapsa marina; identical to SEQ ID NO: 1515

SEQ ID NO: 1517 - protein, 704 aa, Arthrobacter sp.; identical to SEQ ID NO: 486

SEQ ID NO: 1518 - protein, 577 aa, Thermus thermophilus
MTEEKKLWQKGGGWLLEVPERVYTPEDFDESVKEIARTTRTFVEREVLPLLERMEHGELELNVPLMRKAGELGLLAIEVPEEYGGLDLPKVISTVVAEELSGSGGFSVTYGAHTSIGTLPLVYFGTEEQKRKYLPKLASGEWIAAYCLTEPGSGSDALAAKARATLSEDGKYYILNGVKQFISNAGFAHLFTVFAKVDGEHFTAFLVERDTPGLSFGPEEKKMGIKASSTRQVILEDVKVPVENVLGEIGKGHKIAFNVLNVGRYKLGAGAVGGAKRALELSAQYATQRVQFGRPIGRFGLIQQKLGEMASRIYAAESAVYRTVGLIDEALEGKKGAEAVMAGIEEYAVEASIIKVLGSEVLDYVVDEGVQIHGGYGYIQDYPIERAYRDARINRIFEGTNEINRLLIPGMLLRRALKGQLPLIQAAQKLQKELLEPSFEEPEDVELHQIAGLKKLALMVAGLAVQKYGQQVEEEQEVLGAVADILIDAYAAESALLRARRLGGVAQAMTRIYLVQALDRAQSLALSVLPRLVEGDEARVVYSAARRLTKHEPADLVALRREVAEAVLEAQGYPIPR

SEQ ID NO: 1519 - protein, 415 aa, Sphingobium chlorophenolicum
MTTAEITTRTNRLRRADSLFNEALLPDESRRIRREVRDFAEAVLKPEAFRLNTTPESREGFPRAMFEAMAAAGLYEIPFPADVGGRGLEFPTLATMIVLEELGYFSAGIASALFDAQALLVGQTLANAPKALRQRYLPRIVRGEIVGSFATSEPQASTDLSADALRTVATRTQGGWRINGKKRWISNAIAADFILTLCRTGEGEQTFILVETHQNGIEVGAPDLKMGNHPQLTSDVTYTGAFAAEDNVVGRVGGGLKAALSALMLGRIGIGAVGVGLAQAAFDEASAHMEERHAFGQPLGRFQHWQFTFADHAILLETARSLYLKAAQLHDIGIAADAEAAMAKVAGSRLAVDVARDAIQVCGAYGFARYIQGAGSERILEAIYRDAKIGEIYEGANEIQKWILARRIFGRHITG

SEQ ID NO: 1520 - protein, 403 aa, Sphingobium chlorophenolicum
MGDMNEGSVTGYMTEERIQIRDMARDFVRKDLLPLANKLDPIRGDMPRELIEQMGDLGFFGIVIPEELGGLGLGAFEFCLVAEELARGWMSASSIIARGNAGYLTVPGSGEARKEKIRLMAQGRYLGASALSEPGTGSDLSGITCQARRDGDHWVITGNKYWCTYADGANFIRVLCRLEGEDEPSGKAKTAIIPVEKPAGQLPEGVTGNPIPKIGYYGWKTWELRFEDVRVPIQSTDEAPLGYGGGGVNAAAQSLSLARAHTAARSIGLARGALEDAIAYAKDRVQFGQPISDFQAIRFKIATMATEVEAARQLLHYVCAEIDAGRAERVHTSMVKYFAAEMAERVTSEALQIHGGSGYTTLHAVERHWRDARLTKIFEGTSEIQQRIIADSLLGKPTIRGSN

SEQ ID NO: 1521 - protein, 411 aa, Sphingobium chlorophenolicum
MAIDFEIPADAKLVRERVQAWVQDECHPAEQRLLAGEDQTTVVSELRAKARAKGLWCPFIPTDYGGMGLGPLANALVQMELGESYLAALSMNSQGPDDATMLTLLEHGSDYQKERYLKPLLNGEMRVCYSMTEKAAGADATGMQTRAERQEDGSYLLNGDKWFSSAASHADIAVVMAMTDPTAPRHKRYSTFIVDIPSDGFCIKRDIPTMALQSPLDAMLRHAHSEIEISNVKVPSENILGGEGNGFSMGQHRLAYGRLRHGMHNVAIAQRALDMTTERVIGRSTFGKLLADRQAVQFMLAECASKLYVARLMILHIAYKAEKGLDLRHENSIAKVYLASMVHSVVDIAIQLHGALGYSQDTPLARWYTQVRAQRLVDGPDEVHTWMTGRNVIKAFKDNGTTRAACGGDLL

SEQ ID NO: 1522 - protein, 560 aa, Sphingobium chlorophenolicum
MSVAVEVEKTVLVLPGLPALLSGAADAAQAFVAAARPQVKARIVNDKGQVDRVLADVEQHAVHGFGWFASYAEMMREVANWAANLDADGAFGEIEALLAQLLFAEYGAQMLGGIPMNQGEVIRATDLTDDLSALDAPAFRTLVRQGGGQGVKSAIARHLVVQRGHATLENCGLDDMFDMVREQFFALSNEKVAPFAHDWHLKDELIPLPLVEELGAMGVFGMTIPEEFGGLGMGKTAMCVVSEELSRGWIGVGSLATRSEIAAELILTGGTDEQKAHWLPQIANASILPTAVFTEPDTGSDLGSLRTRATLADGEYRVSGNKTWITHAARADVMTLLVRTDPDTKNYSGLSMLIAPKQRGTVEAPFPTPGMSGGEIEVIGYRGMKEYEIGFDDFRVPAANLLGGVEGQGFKQLMATFESARIQTAARAIGVAQASLDIGLAYALDRKQFGRPIFDFPRVANKLAMMAAEIMGARQLTYFAARRKDEGKRCDLEAGMAKLIGARVAWAAADNALQIHGGNGFATEYQVSRLLADARILNIFEGAGEIQAQVIARRLLDGGN

SEQ ID NO: 1523 - protein, 408 aa, Sphingobium chlorophenolicum
MDFEYSDKVKALQAQLIDFMDAHVYPIEKERDHFHHDPANLWKRWPGTEEIKAKAKEAGLWNLFLPHEYGKWSPGLSNLEYAPLAEIMGRVVSASEYFNCSAPDTGNMEVLARYGTPEQQEQWLKPLLDGTIRSSYVMTEPEVASSDATNVATTIIADGDDYVINGRKWWISGAFDPNTKLFILLGRTPNDGQRHQQHSQILIPVGTPGIEIVRPLDVLNAVHSPGGHAEMIFKDVRVPKANLILGEGRGFEIAQGRLGPGRIHHCMRLIGQAQRALEYMARRVENRVAFGRKLADQGSIRQDIALSFCEIEQARLLTLKAADAMDRHGNKVAKDLIAAIKIIAPRMTQTVADRAMQVFGGIGMASDFPPASAFMSARYLRFADGPDEVHMAQLGKIKIAELNQLPVR

SEQ ID NO: 1524 - protein, 437 aa, Sphingobium chlorophenolicum
MMMEPSSRGSALAEQLKSFMAEHIYPNERRYYQEAERLGPWSVYPVVEELKPIARAAGLWNLFLPASEAAEGLSNVDYAPLCEIMGRSMLAPEVFNCNAPDTGNMETILRYGTAEQKEKWLKPLLAGEIRSCFAMTEPEVASSDATNIASSIVRDGGDYVINGRKWYTTGATDPRCGIMIFMGQTDPEGDDPHRRQSMILVPMDTPGVNVVRALPIFGFYGVPDRSAEVLFDNVRVPAENILLGEGRGFEIAQGRLGPGRIHHCMRLIGMSERVLERMCRRAELRHPFGRPLADQTVTLERIAESRIMIEQARLLTMKAAYMMDTVGNKAARQEIAMIKVAAPNMAQTIVDWAIQMFGGGGTSSDHYLAAAFTMARLLRLADGPDEVHRNQIARLEMRRHRGVDPALTGGGADVLSRDEAGRMAAEGMWPRPAGWRA

SEQ ID NO: 1525 - protein, 584 aa, Desulfosporosinus acidiphilus
MSNLPKGGSFLFEETNPQDIFTPEDFTLEHKMIYRTAAGFVTDNVLARMEELEAKKEGLNRELLKAAGDLGLNGADIAEDYGGTEMDKISTTIIAECMGRAGSFAMTQGGQTGIGSMPIVMFGTHEQKKKYLPGIATGDLIGAYALTEPGAGSDAMSAKTRADLSPDGKYYILNGTKQFITNSAMADIFIVYAKIDGDKFSAFIVDGDSKGLSTGAEEKKMGIKGSSTRPLILEDVHVPAENLLFEGGRGHVVAFNILNLGRYKLAANSVGNAKYALELAASYANERKQFGTPIANFGLIKEKLAEMAIKVYVTESMVYRTGGLLENMMNSLDTSGEDGGRVAAKGIEEYALECSMNKVFATEALAYVVDEGVQIHGGYGFSSEYTIERLYRDARIYRIFEGTNEINRVLIPTTLLRRADKGDIPLQETVDQLLKKIESGSIVREGEAGMVQAAKDIFLLIFGSALQKYGKALSKQQELLGRLADMGIQVFALESAWLRAQKSLLNEGEEQAKLKLTMARAFLNSSLGHLEYLAKETLAALVNGKDLENLLNNLQKVTNHKLQNIIALRQEIAAAISENGKYIV

SEQ ID NO: 1526 - protein, 589 aa, Desulfosporosinus acidiphilus
MDLELRGGGFLLTEVKPDQIFIREQLNEDHMQLKRMTHNFMVKEVVPKMEEIEAQAEGVIKGFMRQAGELGLLGLEIPEEFSGLSMDKAATVVVGEEVPRGGSFAVSYAAHTGIGTLPIVYFGTPEQKAKYLPGLATGQTFAAYCLTEPGSGSDALGAKTTAVLNAEGTHYILNGTKQFITNAGFADIYLVYAKVDGKLTNFIVERGYPGVSLGPEEKKMGIKGSSTRQVILEDVMVPVENVVGELGRGHVVAFNILNVGRFKLAAGNLGSASVVLETALKYASERKQFGVPLNSFGAIQHKIAEIAAKTYMAESVVYRTSGLMEYGFHGLDLTGDCRKEAGKALEEYAIECSLNKVYASEVLDFAVDEGVQIHGGYGYIQEYPIERMYRDSRINRLFEGTNEINRLLVPATLLKRAMTGELPLLQAAQSVSKDLMTSGLSGEAEGLDGLYQLVQKAKKLCLMVAGLAAQNLGVAIKDNQFVLMGMAEMVLQVYAMESAVLRALKVRDLDVSAAHKTFTEKAATLGTFEAFNILEQQAKEVVCAVEKGDSLSTVLAGVRKLVRRPTLDIIGLRQEIARYVIEKESYPTS

SEQ ID NO: 1527 - protein, 414 aa, Isoptericola variabilis
MTRNAPVMPGVTAPDYDVAQPSDADYVGAFADVTPEEREHQLAVRAFVQDEVLPVIDGYWERAEVPFDLVKRLAELDFLRDGVDVPGRPRISFMGEGLASMEMSRGDGSVATICGVQGGLALRSIVMHGSPEQVERYAEPMARGEILGAFALTEPTHGSDSVSLETTARRTVRDGVEGYVITGEKKWIGFGSCGDIAIVWARLVGDDGDGQVHGFVVPQDAPGYRATTIEGKVALRAIWQAHIVLDDVFVPTDAALPGATSFAATAAVLFATRLTVAWSAVGHATACYEAALAYAKQRIQFGRPLAAKQMVQERLTRMLSLLTQMQLLVARTTRLADAGTLTGEQASLAKYTCTRQAREIAAIARDMMGGNGILLENRVARHFADIEALHTYEGTESMQALIVGRDVTGFSAFA

SEQ ID NO: 1528 - protein, 401 aa, Isoptericola variabilis
MTGDEATRTDPTDLLALDAQLSDDERATRDRVRALVDAHVRPHVARWFADAVFPRELVPVLGEAGLLGMHLEGYGCAGRSAVEYGLAMAEVEAADSGIRTFVSVQGSLAMSAIAKHGSEEQKQHWLPRMATGEAIGCFALTEPTAGSDPAGMRTRAVRDGDTWVIDGAKRWIGLASVADVAVVWAKVTEDDAGDGRERVRGFLVPTSTPGFRATPIEPKLSLRASVQCDVALDGVRVPADAILPHNPGLRGPFACLDEARYGIAWGAAGAARDCLEVALAYAQQREQFGRPLAAFQLTQAKLVEMALEVSRAQLLALHLGRLKDAGRLEPHQVSAGKLSNVRAALDVARTARTILGGNGVTLEHSPMRHAANLESVRTYEGTDEVHTLVLGRHLTGHAAFR

SEQ ID NO: 1529 - protein, 582 aa, Desulfotomaculum kuznetsovii
MLQKGGAFLLEDIDPQDVFTPEDFTDEHRMIQSTVADFAVNELAPKAEELENQPEGLMRELMQKAGELGLLSADIPEEYGGADLGKVASCLIAENVVAGGSFAVTHSAHTGIGTMPILLFGNEEQKKKYLPRLASGEAIAAYALTEPNAGSDALSIRTRAVLSPDGKHYLLNGEKMFITNGGIADVYITYAKVDGDKFTGFIVERNTPGFSLGQEEKKMGIKGSSTRSLIFEDAKVPVENVLGEIGKGHLIAFNALNIGRFKLGAACVGSCKLAVEHAAKYALQRVQFAQPIARFGLIQHKLAMMAARTYAVESVIYRIAGMLEEALADKKEGPAAVEAISEYAIECSIAKVLASEVLDYVVDEMVQIYGGYGYIQEYPAERFYRDSRINRIFEGTNEVNRLLIPATIARRAMKGQLNFLGAARTLAREILNLRATLPEDDGKPLAAERQMLAMAKKLFLFIGGQAVEKYMDKLAQQQEIMGILADLAIVIYAMESAIVRVLKAHGNGQADKKLLLAQAYVHDTYPLLEKWAREAMCFLFEGDMRQTQLSIVKRMCKHQPVDLIGLRRQIADRVLTAEKYVV

SEQ ID NO: 1530 - protein, 401 aa, Pseudonocardia dioxanivorans
MDFEPSAAAADHTRRMRAFLDEKVLPAEPTYDAWRLERRGTPQEWDLPPVVEELKAEARERGLWNLFLPSVSGLSNLEYAAVAEVSGWSPVIAPEAINCQAPDTGNMETLHLFGTPEQKQQWLEPLLAGEIRSAFAMTEPDVASSDATNVQTRIRRDGDDYVISGRKWWISGTADERCKVFIVMGKTDPDAPRHRQQSMILVPRDAPGMQVLRHLPTFGYQDQHGHSEIVFDDVRVPASNLLGEEGGGFAIAQARLGPGRIHHCMRLIGMAERAIDLMVRRARDRVAFGRPLADQGVVREQIALSRIEVEQARLLVLKTAWLIDEHGSKGAATEIAAIKVAVPRMACTVIDRAMQLHGAAAMSDDFPLAYFYTWARALRFADGPDEVHLRSVARQELAAHE

SEQ ID NO: 1531 - protein, 429 aa, Pseudonocardia dioxanivorans
MAWDFATDPGFEEKLTWAREFVRDEIYPLEVLDLDHEGFRRVAAPLQEQVKANGLWAAHLDPELGGQGYGQLKLGLLHEVLGTSELAPFVFGCQAPDSGNAELIAVAGTPAQRERWMRPLLDGELLSAFAMTEQGTGSDPRQLTTSARLEGGEEGGEWVIEGRKWCVGNAGRSDFHIVMAVTDPDADPYHRMSMIIVPTTAPGIEVRELGLMNDPNHDMPVWSHAEVGYHDVRVPAENLLGGRGEAFTLAQKRLGPGRIHHCMRWIGVCRRAFDMLCERAVSVDVHGGPLADKQTVQNWVADSAAAIEAARLLTLKAAWTIDQVGASAARTEIAMIKYYGAAVLHDVIDRAIQVHGSLGFSTDMPLEQMYRWARAARIYDGPDEVHRVTVARRLLRNYRPTLPPTEHIPTRRAAALETFRERFDAQAVQ

SEQ ID NO: 1532 - protein, 413 aa, Pseudonocardia dioxanivorans
MWHNDPMDVPAQPPVDDDPLPPPLPEVPPQYSTDERVALQRTARRFAMERVLPVANELDPRKGEIPRSLLAEMGELGFFGITVDTEHGGLGLGAYEYCMVAEELARAWMSVGSIIARAQGAGTGVADPARRGELLRRSASGEWIGAIALSEPDAGSDLAAVSTRAERDGDEYVLTGRKRWIGNAKAADFIQVLVRTADPGPGEKRSAGLATLLVEKERDAFPKGLTGSPIDKIGYHGFVTWELEFDGLRVPVADEITEGGFAETQRWLTIARVHTAARAVGLARAAVEDCIGYLQQRRQFGHPIGDFQAVRFTLARMAARVDQARAFYQHVAHQIDLGVPCERESAMVKLLATEMAAEVTGDGIQLHGGNGYTTEHQVERHWRDARLTTIFEGTSEIQSKIIADRLLPRSELG

SEQ ID NO: 1533 - protein, 411 aa, Pseudonocardia dioxanivorans
MAVSFSLSPEQRRLVAIARRFAEEELRPLADEVRAEPDPLRRALLARPTFEKAVGAGFLKGLIPVPFGGTAGSGVDAAILVEEWAAQSPDFVISMAGPLIALMPVYQVGTPEQIRRFVAPFLADSGAPVAAMAFSEPDGSVNFDAPPPAEGIRTTAVLDGDQWVVNGRKQWASHLPGWDGDGPDVMTIVCRTPGGVSLVVAEREHLAGHIEVEEYLDLPGLTGCLTARIALHDVRVPRENLLGAEGQGGELTRNAFFASGASIGTFATAAMRQAFAVAHRFATTQTRGGGVPIIAHQSVADVFADAKGRIEAVRLLSWRALDAVLSGDPAGPELALHSKVFGSETAVDVINDLVKVVGVTAYDRAFPLVRHLNEALAYPVIEGSNIGLRRRQLQAMLAAPGYDPLAASGLA

SEQ ID NO: 1534 - protein, 408 aa, Pseudonocardia dioxanivorans
MSMFEISDRAKAVEADLREFMDSHVYPAEAVYEQQMLEAGDPHHHPQIIEDLKAEAKKRGLWNLFHPHPDWGPGLTNLEYAPLCEIMGRSAFIAPEVFNCSAPDTGNMEVFTLFGSEEHKERWLRPLLDGTIRSAFAMTEPAVASSDATNVELRMERDGDEYVLNGRKWFASNALHANCKVLIVMGKTDPDALPHRQQSMMVVPIDAPGVEIVRNLTVFGYADREGHAEITFTDVRVPEKDVLKGEGEGFAIAQARLGPGRIHHCMRTIGVAERALELMCRRADSRVTWGQPLSERANIQDWIAEARIDIEMIRLLTLKAAHLMDTVGNKAARTEIAAIKVAAPNIALTIIDRAIQVHGAGGVTGDFPLAAAYAHVRTLRLADGPDEVHKRAIARQELRRHRDTADAG

SEQ ID NO: 1535 - protein, 436 aa, Pseudonocardia dioxanivorans
MTIDFTMSDEQKKLQYDVRAFAENVLKPIVAAADAEPDPLKGFQMTKPAYVEAYKAGIAMCMLPAEYGGGGISCVDLVIAAEEICVVDPGFACTVLCNGLGLMPVAWYGSEEQKQKFLGAATSDPTGEYLGGWTASEPPGNPSGTANFDIPLPRPAGVGLTAELDGDHYVVNGRKYWPSSAGWDERGVNAGTLIVRTDPNVGGTSGLSALVLERDTPGVTYRHLDKTGHRLASNAEIVFENARIPATNLLPGAVGNGDLVINRNFAWSGPVAAIAAVGMARAAYEMALDFAKGNTAGALKPIMGFQNVGYVLGDVAAKIEMGRYFSWRAADYLDKHDQHAELVGAMNKIQVTELMFECVYKCMQIVGVNSLETKNGFGKILREASVLPIYDGGNMGMQRRRVHGILADPLFNPRAIMEDDYVVFGKHHEEIDTIAG

SEQ ID NO: 1536 - protein, 432 aa, Pseudonocardia dioxanivorans
MGWDFETDPDVAQELDWVDEFVRTEVEPVDEVVTHAWDVHDPVRNALIKPLQQVVRDKNLWACHLGPELGGKGYGQLRLALLNERLGRSHSAPVVFGCQAPDSGNAEILAHYGTNHLKKTFLEPLVANEIVSCFSMTEPHGGSDPTGFRTTAVLDGDEWVINGEKWFSSHALFADFLIVMAVTEPDAPPHRSMSMFVVPADIPGLERVRDVSVWGHEEPVGTHQYLRYTDVRVPAENLLGERGAGFAVAQTRLGGGRIHHAMRTVGLVGSAFEMMKRRAVSRTTKGERLADKQLVQEMIADTWIQLEQFRLLVLRTAWRIDRYNDYRKVRADISAVKAAMPKVLLDASSRAIQIHGSLGISTELPFGKWVMESFHMGLADGATEIHKVNLAQALLRGTEPDDGLFPPYIRPTLRARAHDRFAEVLAAAADDD

SEQ ID NO: 1537 - protein, 416 aa, Pseudonocardia dioxanivorans
MTSTIDGAVGAPDLDTFAETARSWLLAHAAPRRADEAERTDVSVFHDLPPERERELLGRICDWQRTKFDAGYGALTWAVEDGGAGLSERHAEVFAELEAGVETPGQHELASVSVSLIAPTVRMFGTPAQKSRLVRGLLRGDELACQLFSEPSAGSDLAGLATRAVRDGDGWVVTGQKVWSSGAQFAGWGELIARTDPDVAKHKGLTAFLLPMDTPGVEVRPLRQMSGGSSFCEVFLDEVRIPDSLRLGDVGAGWTVALATLGFERGHSGSEARVGGGFAQLLAAARKLDRTGDPDVRRLLADVWVHEKLAAVAAQRDREARLAGAAPGPIGSLRKLVWAQGLSLVSEAATTILGNRLVADTGDELFGWTEHVLGAPGYRIAGGSDEVQRTIIGERLLGLPPEPRGDRGVPWRDIPR

SEQ ID NO: 1538 - protein, 424 aa, Acidovorax avenae
MDFDYSPKTRDLQARLLKFMDEHIYPSEAAYTAELAANTAADRRWTALDTIEQLKPKARAAGLWNLFLPVDSAAASGYEGAGLTNQEYAPLAEIMGRVPWASEVFNCSAPDTGNMETIARYGSEENKARWLRPLLEGEIRSAFAMTEPDVASSDATNISTRIERQGDEYVINGRKWWISGAADPRCKVFITMGKSDPEAPKHSQQSMVLVPADTPGIRILRPLNVLGYDDAPHGHVEMVFENVRVPASNILLGEGRGFEIAQGRLGPGRIHHCMRLIGLAERALELMCRRASARVAFGKTVAQQTVTQERIAEARCKIDMARLLTLKAAWLMDVAGNKVAKTEIAMIKVVAPSMACQVIDWAMQVHGGGGMCDDFPLAYAYAGARTLRFADGPDEVHRNAIAKWELGKYSAYGRGAEVPVTRGC

SEQ ID NO: 1539 - protein, 589 aa, Desulfosporosinus acidiphilus; identical to SEQ ID NO: 1526

SEQ ID NO: 1540 - protein, 584 aa, Desulfosporosinus acidiphilus; identical to SEQ ID NO: 1525

SEQ ID NO: 1541 - protein, 404 aa, Streptomyces violaceusniger
MDFAFDARTEELRAKLLAFMDEHVRPAEAVAEEQRAALDSPWLTPAVVGELKAEARRQGLWNLFLPDEEYGAGLTNLQYAPLAEITGHSPQLAPTALNCAAPDTGNMEVLAQFGDERQRKQWLEPLLAGEIRSAFAMTEPEVASSDATNIETRIERDGDDYVITGRKWYISGAMNPDCKIFIVMGKTDPEGADVRRQQSMVLVPRDTPGVEVRRAMRVYGYEDHYHGGHAEVVFDRARVPVSNLIGEEGGGFAIAQARLGPGRIHHCMRLIGMAERGIELMCRRAVDRTAFGKALAQQGQVHEWIADARVAVEQLRLLVLKTAWLMDTVGNREAHTEIQAIKIATPRTVVQILDRAVQLHGAGGVSQDFPLAELWAAARTLQLADGPDEVHQRSLARRELKRYV

SEQ ID NO: 1542 - protein, 408 aa, Streptomyces violaceusniger
MAEFSFELDDDQKAVRDWIHGFAADVMRPAAAEWDEREETPWPIIQEAAKIGLYSLDFYAQQYFDPTGLGIPMTMEELFWGDAGIALSIVGTGLAAVGVLANGTEEQIGTWIPQMYGDPDDVKVAAFCSSEPDAGSDVGSMRTRAVYDEAKDEWVLSGTKTWATNGGIANVHVVVAVVDPEVGSKGHASFIIPPGTPGLSQGQKFKKHGIRASHTAEVVLDQVRVPGSCLLGGKEKLDERLARARERAKTGGERLKNAAMATFEASRPAVGAMAVGTARAAYEVALDYAKTRQQFGRPIIDNQGVAFQLADMRTRIDAARLMVWRASWMAVTGKPFESAEGSMSKLFASETAKQVTAQAVQILGGNGFTREYPVERMHRDAAIYTIFEGTSEIQRLVIARTLSGVQIR

SEQ ID NO: 1543 - protein, 410 aa, Streptomyces violaceusniger
MDFGYSPRASELQDRMRSFMDEHVFPAEATYDRQLAEGDDPHALPPVMAELKEKARAEGLWNLFMAHGDWGAGLSNLEYAPLAELAGRSIIGPEVFNCSAPDTGNMELLALYATPEQQERWLRPLLDAQIRSCFAMTEPEVASSDARNIRTRITRDGDSYVVNGRKWYTSGILDPDCKLIILMGKTDPDAPTYRQQSMLLVPRDTPGVTVLRDLPMFGYTDRLGHGDVLFENVRVPAENILGGEGEGFALAQGRLGPGRMHYAMRAVGFAERALRLMCERVTERTAFGGPLADQGVVREWIARSRIEIEQLRLLVLKSAWLMDTVGNAAARMEVAAIKVAALEVAHKVVDRAVQAHGAAGVSDDTVLARLYAITRALQIADGPDEVHLRTVARQELAHYKKKTDTETGAA

SEQ ID NO: 1544 - protein, 644 aa, Streptomyces violaceusniger
MTASSVRPVSEHEARQVAEAAREQVWHKPSFAKELFLGRFRLDLIHPHPAPAPDDVRRGETFLAKLGEFCETQVDAARIEREAQIPDETIQGLKELGALGMKIDTKYGGLGLTQLYYNKALALAGSASPAIGALLSAHQSIGVPQPLKLFGTQEQKDRFLPRCARTDISAFLLTEPDVGSDPARLATTAVPDGDGYLLDGVKLWTTNGVVADLLVVMARVPRSEGRKGGITAFVVETASEGVTVERRNAFMGLRGLENGVTRFHQVRVPAANRIGPEGAGLKIALTTLNTGRLSLPAMCAGAGKWCLKIAREWSAAREQWGKPIAKHEAVGAKISFIAATTFALEAVIDLASQMADEDRNDIRIEAALAKLYGSEMAWLMADELVQIRGGRGYETAASLAARGERAVPAEQMLRDLRINRIFEGSTEIMHLLIAREAVDAHLSVAGDLIDPDKSLQDKGKAAAKAGGFYARWLPGLLAGPGQLPRAYPEFHPAGHPDLSPHLRYVERSARKLARSTFYAMSRWQGRMETKQGFLARIVDIGAELFAMSAACVRAEMLRSRGDHGVAAYQLADAFCRQARIRADELFGRLWTNTDELDRKVVSGVLSGAYEWLEQGVLDPSGDGPWIADATPGPTAMQNVHRPIH

SEQ ID NO: 1545 - protein, 452 aa, Sphingobacterium sp.
MSNTFTKIKEAFRLLKHIDFDQLSKISQKVDLVKVMDGFSKLDDNQLKGLLKMMDGDGKKKELPPINGDFYELSDRLSAEDRALQLRIRQFMEQEVKPLVNKYWLHDEFPFELIPKFGELGLAGITYNGYGCPNKSFLMEGVLAMEMARVDASIATFFGVQSGLAMGSIYLCGSEEQKREWLPQMNKMQKIGAFGLTEPEVGSGAAGGLTTTCKRTAEGWVLNGQKKWIGNATFADLIVIWARDLDDGQVKGFILKKDTPGFSVEKIKGKMALRIVQNGLITLKDCVVEEKDRLPHANSFKDTANVLRMTRAGVAWMAVGCARGAYESALDYTRKRKQFGKPIASFQLIQNHLVEMLSNLTAMQTLVFRLSELQDAGQLKDEHASLAKVFCSLRTRDIVGQAREVMGGNGILLEHDVARFVADAEAIYSYEGTKEINSLIVGRAITGMSAFV

SEQ ID NO: 1546 - protein, 597 aa, Sphingobacterium sp.
METVDKKRAIKGGEFVIKETRYEDVFIPEEFDEEQLMIKKTCQDFLQTEVTPNLERIDNQEEGLMQTLLDKAGELGLLGVSIPEEYGGFGKNFNTSMLVTDAVGAGHSFAVALSAHTGIGTLPILYYGNTEQKQKYIPKLATGAYKAAYCLTEPNAGSDANSGRTTAKLNDEGTHYLINGQKMWITNGGFADIFIVFAKIDDDKNLSAFIVERAFGGITMNPEEHKLGIKGSSTRQVFFNDCPVPKENLLSERENGFKIAVNILNIGRIKLGAAAIGSSRKVISQAINYANERVQFKLPIAKFGAIRYKLAEMATRNFAVESAAYRAGQNIDDAYEALVSDGMEPAKAKLKSTEQFAIECAILKVWGSEMLDYIVDEGVQIYGGMGYSADAPMERSYRDSRINRIFEGTNEVNRLLIVDMLLKRALKGELDLMGPAQEVVGELMAIPDFSEPEDVLLAYEKRVIANLKKAGLLVAGAAVQKLMMTLQKEQEILMNIADIIGTVYLAESTLLRAEKLVHFKNEQEVTGQIDMARIFLYNAVDKAYLAGKEALNSFAEGDELKMMLAGLRRFTKLEPFNVKEARQRVAKLLIDANGYCF

SEQ ID NO: 1547 - protein, 408 aa, Frankia symbiont
MNAAPTALTAPAAGSASAAPGADSSPRRIAERTKAFVQEHVFPVEREIIVDGRPMDDALRVRLQEEARQAGVFGPLSPVAYGGLGLDTRALAHVLEAAGASLIGPIAVNASAPDDGNIHLLAHLATAEQARRYLEPLARGEVRSSLAVSEPSPGAGSDLTMLRTTAEKAPGGWKINGVKHFVTGADGAAFSICMAATAGGGATIFLVDQDNPGLTVGRRMPTLDHSAPGGHCEVTFDDCFVPDDAVLGEVGKGFEQIQARLAPSRIMFSMSWLGVAIRAHEMAAARIVGREAFGAAVAGHGMAQAHVADNEIDIAAARALVHSTAAVIDERGALSGAARHASAITKTFVSEAVWRVLDRVVQLYGGLGVCEDELVARFLVEARGFRIYEGPSEVLRWSIARRVLRAYR

SEQ ID NO: 1548 - protein, 402 aa, Frankia symbiont
MSTLDPRLLALPFYERPHRELAEVLGRFCDTHAELAAAARTGAPEKYTARVLRALGDAGLLTPTDLRGLCLTREALAYTEDLLDFAFSIQALAAWPIQRHGTDEQKRRWLPGMARGELAGAFALSEEQAGSDVAALALRAVPDGDGTGYVLDGHKTWIAGAAGADVFCVVARTGDGPAALGLTALLVPAGTPGLRIEPIDMLAERDIARLEFDGCRVAADAVLGSRGGGFVVAMELLERFRLTVGAAALGFARRAADAALARARGRAAYGGRLFDLPTVKASLADVEVRLNAAALLVARAAWEADRGTPPARHASIAKLYATEAAQQVVDAAVQVFGAAGLVRDSLPERLYRQIRSLRIYEGASEVQRLAIADALPPAASHVSRTDAGRPPKTLKASSSHEE

SEQ ID NO: 1549 - protein, 598 aa, Agrobacterium sp.
MPVYKAPVKDTLFILNDVLGLERYNNLPGFEDATPDMIEAITGEAAKLAEERLFPLNLSGDQQGCKRADDGSVSVPDGFKEAYDAYCEGGWIGLAVPPEFGGQGLPYTLHAAIGEYMSSANLSLMMYPGLTQGAIAAVLVHGTQEQKETYLPKMVEGTWSGTMNLTEPHCGTDLGLLRTKAVPQGDGSYKISGQKIFISAGEHSMTDNIVHLVIARIEGAPEGTKGISLFIVPKFLVKEDGSLGERNGVTCGAIEHKMGIHGNATCVMNYDDATGYLLGAENKGLSAMFVMMNEARLGVGLQGLSVGEIAYQNAVEYARERIQGRSLSGAKFPDKKADPIIVHPDIRRTLMTIKAYNEAGRAFLLWTALQSDIAHRSTDEKERQTADDLLGLVTPILKGVLTDKGFDHAVMAQQVFGGHGYIEEHGMSQYVRDARITMIYEGANGIQALDLVGRKLGMNGGRAVMALFKEIGDFCEENRPDEKLSLYTKGLKKGLNDLQAATMWFMQNAMAKPDNAGAGSTDYMHLFGIVVLGYMQARMAKAASEALAAGSTSDEDFLKTKLVTAKFYMERIMPETALRKARIETGADTMMELAAEAF

SEQ ID NO: 1550 - protein, 408 aa, Methylobacterium extorquens
MAKPEFKAPRPPELLSPWRTDRRAALQEEARAFARDVILPLADELDPQKGEMPRSLIDAMAEKGWFGITIPAEYGGMGLGVFEYCLISEELARAWLSTGSILARGQGLGTQTLDDESRRALLAKSAKGQWIGSIALSEPTAGSDLAGVQTRAVREGDEWVLTGTKRWAGFAQGADFIEVLARVRDPEPGEPRSAGLEPFLVVKEPGTFPKGMTGTVIDKIGYHGFLTFELNLDGVRVPERDRLTGLYGDEGADADSGGFASVQRGLNIARVHTAARAVGVARAAVEDCTAYLQEREQFGQPIGQFQALRFALADMAAEVAQARAYWQQVAHLLDEGLPAESESAQVKLLATEMAVRVTNQAMQLHGGNGYTTERRVERYWRDARLTTIFEGTSEIQRRIISDRMLPRG

SEQ ID NO: 1551 - protein, 410 aa, Alicycliphilus denitrificans
MTANACAGRLFGDHFLSRLNVDEQAMVANVRRLARDALGPRAAEVAQRDVFAWDNFRLLAREGVIGTAFPREYGGTDARQVLRIRIIEELGRVCSASASLVTGADLSCRAIVAGASDDNKARLLPALCRGDIQAAFALTEPGAGSDVRGLSTTIRREGDDYVINGRKKFITRGTTADWFMVVGRAAHDPSCFIAVLVPRDAAGFAISPEVGKLGWAGVPISSLQFKDVRAQVSDRLGAEGDGFDLAQDALIRARMGHASMALGRAIGAVEIAAAYMVDRKLFGKSLGEHQGAQWMVADMVTQLEAARALVHLAAEKYDSGDPDAGIFASMAKLQATDLGMKVVTDALQLTGGRGYLQDFPLERFFRDAKLNQIGEGSSEVHKTVIGRDAIRRVRTLERHPCLKFESLENY

SEQ ID NO: 1552 - protein, 413 aa, Alicycliphilus denitrificans
MDFDYSPKTKELQARLRQFMDDHIHPAEKACAEELAAHTAAGNRWQPLQTIENLKPKARAAGLWNLFLPVDTAEASGYHGAGLTNAEYAPLAEIMGRVLWASEVFNCSAPDTGNMETIARYGSEAIKAEWLTPLLEGRIRSAFAMTEPDVASSDATNICTRIERQGRHYVINGRKWWTSGANDPRCKVFITMGKTDPDAPRHSQQSMIVVPADTPGITIVRPLNVFGYDDAPHGHAEVVFDDVKVPVDNILLGEGRGFEIAQGRLGPGRIHHCMRLIGQAERALELMCQRTLSRTAFGKTIAQQGVTQERIAEARCRIDMARLLTLKAAWMMDTAGNKVAKTEIAMIKVVAPGMACQVIDWAMQAHGGGGVSDDFPLAYAYANARTLRFADGPDEVHRSAIAKWELGKHATRP

SEQ ID NO: 1553 - protein, 408 aa, Alicycliphilus denitrificans
MDFSYSPKVVDLQKRLTAFMDEHVYPAESAYHHEVDANRKAGNPWQPTKVMEELKAKARAAGLWNLFLPESKYGAGLTNLEYAPLCEIMGRSHVAPEAFNCSAPDTGNMETLVRYGSEEQQRQWLLPLLEGRIRSAFAMTEPAVASSDATNIEARIERVGDEYVINGRKWWTSGAPDPRCEILIFMGKTDPDHPSRHRQQSMILVPMKTPGVTMERALPVFGYDHAPHGHGEVSFDNVRVPVSNVLLGEGRGFEIAQGRLGPGRIHHCMRLIGVAERALELMCRRALGRVAFHRPVADQGVTRERIANARILIDQARFLVLNAAYMMDTVGNKVAQKEIAMIKVAAPGMACQVIDWAMQVHGGGGVCDDFPLAAAYAQARTLRFADGPDEVHRNQIGKMELSRYMTAR

SEQ ID NO: 1554 - protein, 549 aa, Alicycliphilus denitrificans
MMPAIVSPLLARTRALFGGAVTALARECAEGDKLDARKLDAQQFASYEIAWAAADLLAAETLAGARLNALDAKLAGVFVAEALGAVLRRLEPLLLDLRLDLQLGELHALAASGELAQFRREAASAAVQAQAGAAVAAGDGELGDVPLDAGIVMARDGFRRFAAEAVAPLAERIHREDQIVPESLLQPLREMGVFGLSIPEAYGGTAPGSHDDTQMMVAVTEALSEGSLGAAGSLITRPEILARALLAGGTEAQKRRWLPALAVGEPLCAIAMTEPDFGSDVAGLQLKATRAEGGWLLNGAKTWCTFAGKAGVLMVVARTDPDKAAGHRGLSLLLVEKPAFEGHEFAVAQEGGGTLHGRAIPTIGYRGMHSFDLVFENFFVPDENLVGGDAGLGKGFYFTMTGMMGGRMQTAGRALGVMRAAVRAAIRYAGDRQVFGAPLVSYQLTQVKIAAMAARFVACRWLAYDVARLLDAGGGRMEASLVKLLACRSAELVTREALQIHGGMGYAEETAVSRYFVDARVLSIFEGAEETLALKVIARSLLEQALEKR

SEQ ID NO: 1555 - protein, 416 aa, Alicycliphilus denitrificans
MNTTPTIDGKGYMTEERIMIRDAARDFTMNEVLPVANQLDGPDGEIPMELRRKMADMGYFGITIPEEYGGMGLGTFEYCLICEQLARGWMSVASLVARAQGGFIKNEMPEEMRRKYLPRVVRGEFLNASALSEPDTGSDLASISCRAELVGDEWVLNGNKYWCTFADGADYINVFARTAKPTHPKKRWEGISCFLIEKKRGEFPPGMVGQPIPKIGYFGWKTFELALNDLRVPRENLIGAPGQAFLIMAKGLETARAHTAARAIGLAQGALEDAIAYARERKQFGMPIAEYQAIRFKIATMATEVEAARQLLHYVCSAIDSGRRCDTEASMVKLFATEMAERVTSEALQIFGGAGYTKLFAVERHWRDARLTKIFEGTSEIQQRIIANNLLGKSVLEDMIASRAFESAAGARTEAA

SEQ ID NO: 1556 - protein, 408 aa, Streptomyces griseus
MAEFTLELNDDQKQVKEWLHGFAADVIRPAAAEWDEREETPWPVIQEAAKVGIYSLDFYAQQFFDPTGLGIPVAMEELFWGDAGIALSIVGTGLAAVGVLANGTEEQIGTWIPQMYGDADDVKVAAFCSSEPDAGSDVASMRTRAVYDEAKDEWVLNGTKTWATNGGIAGVHVVVAVVDPDIGSKGHASFIVPPNTPGLSQGQKFKKHGIRASHTAEVVLEDVRVPGHCLLGGKEKLDERLARARERAKSGGERVKNAAMATFEASRPAVGAMAVGTARAAYEVALDYAKTRSQFGRPIIDNQGIAFQLADMRTRIDAARLLVWRASWMATTGKPFTSAEGSMSKLYASETARDVTAQAIQILGGNGFTREYPVERMHRDAAIYTIFEGTSEIQRLVIARTLSDMPIR

SEQ ID NO: 1557 - protein, 404 aa, Streptomyces griseus
MDFAFDARTEELRARLLAFMDEHVYPAEQVAEEQRARLASPWDTPAVVGELKAEARRQGLWNLFLPDAEYGAGLTNLQYAPLAEITGRSPHLAPTATNCAAPDTGNMEVLFQFATEAQKKQWLEPLLAGEIRSAFAMTEPDVASSDATNIETRMIRDGDDYVINGRKWYISGAMNPDCAVFIVMGKTDPDSEDVRRQQSMILVPRDTPGVEVRRAMRVYGYEDHSHGGHAEVVFHDVRVPAANLIGEEGGGFAIAQARLGPGRIHHCMRLIGMAERAIELMCRRAVARTAFGKPLAAQGVVQNWIADARVTVEQLRLLVLKTAWLMDTVGNKGAHTEIQAIKIATPRAVVDILDSAVQLYGAGGVSQDFPLAELWASARTLRLADGPDEVHQRSLARREIKRYV

SEQ ID NO: 1558 - protein, 406 aa, Streptomyces griseus
MSSTESAKPSKLPPFDASDPLGIDDLLGPDDLAIRDTVRTWAADRVLPHIAEWYEKGELPGIRELARELGALGALGMSLDGYGCAGASAVQYGLACLELEAADSGIRSLVSVQGSLAMYAIHRFGSEEQKLRWLPAMASGEIIGCFGLTEPDHGSDPAGMRTYAKRDGEDWILTGRKMWITNGSVAGVAVVWAQTDEGADGRGIRGFVVPTDTPGFSAPEIHHKWSLRASVTSELVMDEVRLPADAVLPDASGLRGPLSCLSHARYGIVWGSMGAARASFESALDYARGREQFGRPIGGFQLTQAKLADMAVELHKGILLAHHLGRRMDAGGLRPEQVSFGKLNNVREAIEICRTSRTILGANGISLEYPVMRHATNLESVLTYEGTVEMHQLVLGKALTGLDAFR

SEQ ID NO: 1559 - protein, 651 aa, Streptomyces griseus
MSAPHNVPQLPRAPKVTEREARRVAEAAREQDWRKPSFAKELFLGRFRLDLIHPHPLPPPDDIRRGEEFLARLRTFCETRVDSARIEREARIPDEVIAGLKELGALGMKIETRYGGLGLTQVYYNKALALAGSASPAIGALLSAHQSIGVPQPLKIFGTQEQKDVYLPRLATTDISAFLLTEPDVGSDPARLATSAVPDGPDYVLDGVKLWTTNGVVADLLVVMARVPASEGHPGGITAFVVEADAPGVTVEHRNAFMGLRGIENGVTRFHGVRVPGACRIGPEGAGLKIALTTLNTGRLSLPAMCVGVGKWSLKIAREWSAVREQWGRPVARHEAVGSKISFIAATTFALEAIVDLSSQMADEDRNDIRIEAALAKLYGSEAGWQIADELVQIRGGRGFETAASLAARGERAVPAEQMLRDMRINRIFEGSTEIMHLLIAREAVDAHLKVAGDLIDPDKPLSAKARAGANAAGFYARWLPRLVAGPGQLPRTYAEFHPPGHRDLSGHLRYVERASRKLARSTFYAMSRWQGRMETKQGFLGRIVDIGAELFAMSAACVRAEHLRGTGEHGREAYQLADAFCRQARIRVEALFTRLWSNTDDLDRRVVDGVLAGLYTWLEEGVVDPSGEGPWIADATPGPSAHGNQHRPVR

SEQ ID NO: 1560 - protein, 401 aa, Streptomyces griseus
MTRLAQTAGLNDIQREILSTVRDFVDKEIIPVATQLEHRDEYPTEIVEGLKELGLFGLMIPEEYGGLGESLLTYALCVEEIARGWMSVSGIINTHFIVAYMLKQHGTQEQKDTFLPRMALGEVRGAFSMSEPALGSDVSAISSKGVKDGEEYVLNGQKMWLTNGGTSTLVAVLCRSDEGHPEGTAPHKSMTTFLVEKEPGFGEVRPGLTIPGKIDKMGYKGVDTTELIMDDLRIPANRVLGGTTGRGFYQMMDGVEVGRVNVAARGCGVAQRAFELGVSYAQQRHTFGKPIAQHQAIQFKLAEMATKVEAAHAMMVNAARKKDSGERNDLEAGMAKYLASEYCKEVVEDAFRIHGGYGFSKEYEIERLYREAPMLLIGEGTAEIQKMIIGRRLLEEYRFQG

SEQ ID NO: 1561 - protein, 404 aa, Streptomyces griseus
MSFFSLALTEEQQDLRTWVHGFAARVVRPAAAEWDAREETPWPVIQEAARIGLYGFESLADLYGDPTGLSLQIANEELFWGDAGIGMALFGTSLAVAGIFASGTPDQLAEWVPQCYGDEDDPKVAAFCVSEPGAGSDVSAMTTKARYIEASDSWVISGQKAWITNGGIAEVHVVVASVDPALGARGQAAFIVPPGTKGLTAGRTVKKLGLRASHTADLFLDEVTVPGHCLLGGKEKLDARLARAREGSTAKGQAAMATFEVSRPTVAAQALGIARAAYEYALEYAGEREAFGRPIIENQSIAFALADIRTEIEAVRLLIWQAAWMARNDRTFDAGQGSMSKLRAGELAVAATEKAVQILGGAGYSREHPVERMYRDAKIYTIFEGTSEIQRLVIARAISGRHIR

SEQ ID NO: 1562 - protein, 403 aa, Pseudomonas fulva
MDFAYSPKVQQLRKRVTAFMQDHVYPAEVEFERQVAEGDRWQPTAIMEQLKDRARGEGLWNLFLPDSELGAGLTNTEYAPLAEIMGSSLIGAEPFNCAAPDTGNMEVLVRYGSEAHKRQWLEPLLSGEIRSAFAMTEPGVASSDATNMQATAVRDGDQWVINGRKWWTSGACDPRCKIMIFMGLSNPDGPRHQQHSMILVPMDTPGVKVLRPLPVFGYDDAPHGHAEVLFEDVRVPYSNVLLGEGRGFEIAQGRLGPGRIHHCMRSIGMAERALKLMCERALERTAFGKPLARLGGNIDLIAESRMEINMARLLTLNAAYMMDTVGNKVAASEIAQIKVVAPNVALKVIDRAIQIHGGAGVSDDFPLAYWYAMQRTLRLADGPDEVHRAAIGKYELGKYLHKA

SEQ ID NO: 1563 - protein, 673 aa, Rhodothermus marinus
MSLLSRLKGISAQDRRMIEDIEAMLGPEPEEMGFMKNLFWGRFREDLLFPYPEESKEEREKCDALLAELEAYLKNEHPSILIDQEQYIPDWVLERLFEMGVMGLTIPEEYGGLGLGVTSYNRVLELIGRYCASTAVVVSAHQSIGCKAIMLFGTEEQKRKYLPIVAREKLAAFCLSEPNVGSDAAGQQTRCELSEDGQYYILNGEKKWSTSGALAGVLTVMAKQRLKNPKTGREEDRVTALIVTPDMEGVDVFEKNRSKAGIRGTWQARIRFTNVKVPRENLLYKEGKGLNVALSCLNYGRCTLSAGVLGGATWAMEQSTKWAQTRYQFGRPLADFEAVQQKIAKMAALTYGMRAMLYMVTGMLDRRDKDIMIETAAAKVFCSQMGWEVIDEAMQIMGGEGYMTENELERVWRDHRIHRIVEGANEVMQSYIFAYGGKQLAEQMLAIKQALGWDRDQSPVENLQRIVSNAFNPRLLKRALPLAAELFLGIRPEAPRIRRVHPSLRPWADRLARLVQQHAHYFKLVSKWEGDAIVTRQAQQARLADNAMYLFALSAALSDMDRQLRKGASGVAFEKDRAAFEHLFDLLEIRIQQNLGLLRRNGDESMRRAAQATLRYVDTLPNRDYYIHEASPVAKGTGKPVQKEHIKQFPGDRYVTAGGDGAPAESSTARSEA

SEQ ID NO: 1564 - protein, 402 aa, Geobacillus thermoglucosidasius
MMMNFDFTPEQEMLRSTVRKFVDKEIMPYIKEWDERGYFEPSILKRLAELNLMGVCIPEKYGGMGMDYNSLAIVCEELERGDTAFRTAVSVHTGLNSLTLLQWGTEEQKQKYLVPQAKGEKIGAFALTEPNAGSDVASISTTAVRDGDDYILNGQKTWISLCDIADHFIVFAYTDKSKKHRGISAFIVERTMPGFSSKAIKGKLGIRAGNTGELFFDNVRVPKENLLGEEGEGFKIAMSALDNGRFTVAAGAVGLIMACLEASIKYCHERKTFGKEIGRHQLVQQMIAKMEAGLQISRLLVYKVGFLKNQGRRTTREASLAKWIACDFANQAADDAVQIHGAYGYSNEYPVERYLRNSKAPVIYEGTREIHTIMQAEYALGYRVDKPLRKTLPAWSPESVTL

SEQ ID NO: 1565 - protein, 402 aa, Geobacillus thermoglucosidasius
MDFSYSPKVKELSKKLSAFMEEYIYPNEKVYEAQLNAQESRWSAIPPIIEELKAKAKKAGLWNLFLPDSEYGAGLTNLEYAPLCEMMGRSLIAPEVFNCNAPDTGNMEVLVRYGTEEQKKKWLIPLLNGEIRSCFSMTEPDVASSDATNIRASIVRDGDEYVITGRKWWSSGAGDPRCKIAIVMGKTNPDAPRHEQQSMILVPLDTPGVKIERMLSVFGYDHGPHGHAEITYDHVRVPKENIIWEEGKGFAIAQGRLGPGRIHHCMRLIGAAERALELMCQRVQKRVAFGRTLAEQGVIRDWIAQSRVEIEQARLLTLKAAYMMDKFGNKAAKKEIAMIKVVAPNVALKVIDRAIQAFGAAGISDDFPLAAHWANARTLRLADGPDEVHKEQIAKLELRQYQ

SEQ ID NO: 1566 - protein, 401 aa, Geobacillus thermoglucosidasius
MGVTVDSSSVRPNYEALREEIRAIVEKVIKPNADIIDRDGIFPKQNLQVLAETGWNSVLIPERWDGRGLDHVAFAIAAEEIARGCPSTSLVYVMHVGAAQTIALYGNDDQKERWLKPIRQGLIGTYSTSEKATGGHWWFNLSEASRDGEYYILNAEKSFTTSSGQADFYVVQTRSPGAQEPTDVSFFIVDGKLPGIKPGVWEALGVRGNHSGPITYEGVRIHQRDKLGKEGQGREILESGVSPIYLIGLGSTWLGVAEAALEAATSYVKETIHRDFNKRLADYQVIRQQLAEVKVLIDSLKPWQYSLAKQLDELQAQGKPQVELLLPLVEFKIHASEVANKAAKAALDVTGGYGYKRGIFERLFRDARAGIAMGPSNNIAREWIGKALVGLPLELWYEGGD

SEQ ID NO: 1567 - protein, 594 aa, Geobacillus thermoglucosidasius
MAKALENAIKGGSFLIEDIPCERVFTPEDFTDEHKMIAKTTEDYVVNEVLPQLEHLENHEFDRSVQLLRKAGELGLLSADIPEEYGGLGLDKISSALIGEKMSRAGGFSISHGAHVGIGSLPIVLFGTEEQKRKYLPSLATGEKIAAYALTEPGSGSDALGAKTTARLNAEGTHYILNGEKQWITNAGFADVFIVYAKVDGEHFSAFIVERGFPGVSTGPEEKKMGIKSSSTRTLILQDVPVPKENLLGEIGKGHVIAFNILNIGRYKLGVGAVGGAKRALEITLQYANQRQQFKQPISKFSLTQEKFATMASRLYATESSVYRTVGLFDERMGLLDEEKAKDGKEIAKSIAEYAIECSLNKFFATETLDYIVDEGVQIHGGYGFMQEYEIERAYRDSRINRIFEGTNEINRLLVPGMYLKKAMKGELPLLQKAQQLQEELIMLAPEEVGDGVLEQEKYLVCNAKKIALMAAGLAAQRFGPKLENEQEILVNIADIVANIYAMESAVLRTEKAINRSGVEKNKQKLLYTQIFCQEAFNEIEAHAKETIVAVEQGDTLRMMLTALRKLTRYTPINIIAKKREAAAALIEAERYIV

SEQ ID NO: 1568 - protein, 408 aa, Frankia symbiont; identical to SEQ ID NO: 1547

SEQ ID NO: 1569 - protein, 402 aa, Frankia symbiont; identical to SEQ ID NO: 1548

SEQ ID NO: 1570 - protein, 414 aa, Isoptericola variabilis; identical to SEQ ID NO: 1527

SEQ ID NO: 1571 - protein, 401 aa, Isoptericola variabilis; identical to SEQ ID NO: 1528

SEQ ID NO: 1572 - protein, 415 aa, Sphingobium chlorophenolicum; identical to SEQ ID NO: 1519

SEQ ID NO: 1573 - protein, 403 aa, Sphingobium chlorophenolicum; identical to SEQ ID NO: 1520

SEQ ID NO: 1574 - protein, 411 aa, Sphingobium chlorophenolicum; identical to SEQ ID NO: 1521

SEQ ID NO: 1575 - protein, 560 aa, Sphingobium chlorophenolicum; identical to SEQ ID NO: 1522

SEQ ID NO: 1576 - protein, 408 aa, Sphingobium chlorophenolicum; identical to SEQ ID NO: 1523

SEQ ID NO: 1577 - protein, 577 aa, Thermus thermophilus; identical to SEQ ID NO: 1518

SEQ ID NO: 1578 - protein, 582 aa, Desulfotomaculum kuznetsovii; identical to SEQ ID NO: 1529

SEQ ID NO: 1579 - protein, 424 aa, Delftia sp.
MDFEYSPKTKDLQERLLKFMDEHIYPGEKDYAAEMEANTAAGKRWTPLQTIEKLKVKAREQGLWNLFLPVDSAEAAGYKGGGLTNQEYAPLAEIMGRVPWSSEVFNCSAPDTGNMETIARYGSTELKERWLKPLLEGKIRSAFAMTEPEVASSDATNICTRIERQGDEYVINGHKWWISGAGDPRCQVFITMGKTDPDAPKHSQQSMIIVPGDAPGIRIVRPLNVMGYDDAPHGHMEMYFENVRVPAGNILLGEGRGFEIAQGRLGPGRIHHCMRLIGLAERALELMCKRASSRIAFGKSVAQQTVTQERIAEARCRIDMARLLTLKAAWLMDIAGNKVARSEIAMIKVVAPSMACQVIDWAMQVHGGGGMSDDFPLASAYAHARTLRFADGPDEVHRNAIAKWELGKYGAYGKDAGVPITRGS

SEQ ID NO: 1580 - protein, 407 aa, Delftia sp.
MNAKDTLPAANAALLEMPFEGSERAAGLIDALNAFIHGELADLARAHGVDHENSASTELLRQVWKLSHARGFYGMTLPEAMGGAGLSVLDQVLVKEAIYATGSPFAPHVLGELSGPPRIGALIRKATPLQMEQFILPVARAEKSICFALTEAAAGSDAGALETRAVLEGDHYVLHGRKRFISGSPFADFAVLMASTAPEGSPQREISAFFVDLHAPGVQVVSGYKTMAGQSSTGDIVLDGCRVPAAQLIGEPGRGLALALGRITVNRLLHCPAMLGLAQVALRDARDYALGRQQFGRSIAQFQSIQHMLADMATEWMAARALMVQTARAIDAGIDARAQASMSKLFCSETAFRIADRAVQIHGGEGIVQGRRVEFLFRMLRMYRVLTGTSEIQRNTIAKELLERAGA

SEQ ID NO: 1581 - protein, 403 aa, Pseudomonas fulva; identical to SEQ ID NO: 1562

SEQ ID NO: 1582 - protein, 410 aa, Alicycliphilus denitrificans; identical to SEQ ID NO: 1551

SEQ ID NO: 1583 - protein, 413 aa, Alicycliphilus denitrificans; identical to SEQ ID NO: 1552

SEQ ID NO: 1584 - protein, 408 aa, Alicycliphilus denitrificans; identical to SEQ ID NO: 1553

SEQ ID NO: 1585 - protein, 549 aa, Alicycliphilus denitrificans; identical to SEQ ID NO: 1554

SEQ ID NO: 1586 - protein, 416 aa, Alicycliphilus denitrificans; identical to SEQ ID NO: 1555

SEQ ID NO: 1587 - protein, 401 aa, Pseudonocardia dioxanivorans; identical to SEQ ID NO: 1530

SEQ ID NO: 1588 - protein, 429 aa, Pseudonocardia dioxanivorans; identical to SEQ ID NO: 1531

SEQ ID NO: 1589 - protein, 413 aa, Pseudonocardia dioxanivorans; identical to SEQ ID NO: 1532

SEQ ID NO: 1590 - protein, 411 aa, Pseudonocardia dioxanivorans; identical to SEQ ID NO: 1533

SEQ ID NO: 1591 - protein, 408 aa, Pseudonocardia dioxanivorans; identical to SEQ ID NO: 1534

SEQ ID NO: 1592 - protein, 436 aa, Pseudonocardia dioxanivorans; identical to SEQ ID NO: 1535

SEQ ID NO: 1593 - protein, 432 aa, Pseudonocardia dioxanivorans; identical to SEQ ID NO: 1536

SEQ ID NO: 1594 - protein, 416 aa, Pseudonocardia dioxanivorans; identical to SEQ ID NO: 1537

SEQ ID NO: 1595 - protein, 452 aa, Sphingobacterium sp.; identical to SEQ ID NO: 1545

SEQ ID NO: 1596 - protein, 597 aa, Sphingobacterium sp.; identical to SEQ ID NO: 1546

SEQ ID NO: 1597 - protein, 598 aa, Agrobacterium sp.; identical to SEQ ID NO: 1549

SEQ ID NO: 1598 - protein, 404 aa, Streptomyces violaceusniger; identical to SEQ ID NO: 1541

SEQ ID NO: 1599 - protein, 408 aa, Streptomyces violaceusniger; identical to SEQ ID NO: 1542

SEQ ID NO: 1600 - protein, 410 aa, Streptomyces violaceusniger; identical to SEQ ID NO: 1543

SEQ ID NO: 1601 - protein, 644 aa, Streptomyces violaceusniger; identical to SEQ ID NO: 1544

SEQ ID NO: 1602 - protein, 437 aa, Sphingobium chlorophenolicum; identical to SEQ ID NO: 1524

SEQ ID NO: 1603 - protein, 408 aa, Streptomyces griseus; identical to SEQ ID NO: 1556

SEQ ID NO: 1604 - protein, 404 aa, Streptomyces griseus; identical to SEQ ID NO: 1557

SEQ ID NO: 1605 - protein, 406 aa, Streptomyces griseus; identical to SEQ ID NO: 1558

SEQ ID NO: 1606 - protein, 651 aa, Streptomyces griseus; identical to SEQ ID NO: 1559

SEQ ID NO: 1607 - protein, 401 aa, Streptomyces griseus; identical to SEQ ID NO: 1560

SEQ ID NO: 1608 - protein, 404 aa, Streptomyces griseus; identical to SEQ ID NO: 1561

SEQ ID NO: 1609 - protein, 433 aa, Frankia sp.
MGWDFETDPEYQKKLDWVDEFVREEVEPLDHIFPHQQFDPMTDEMRRVINPLKEEVRRQGLWATHLAPELGGQGFGQLKLALLNEILGRTLWASVVFGTQAPDTGNAEIIAHYGTQAQKDKYLQPLLDGECFSSYSMTEPHGGSDPTQFTCRAVKEGDEWVINGWKYFSSNAKTASFLIVMVVTNPDVSAYRGMSMFLVPTDTPGVNIVRNVGLFGEPMNEGYHALIHYEDVRVPADALLGEEGQAFAVAQTRLGGGRIHHAMRTIGLANKALDMMCERALSRTTQGGLLADKQLVQGFIADSYAQLAQFRLFVLYTAWEIDRYNDYNRVRKDIATAKFVMPAVLHDIAWRAMQVHGALGTTNEMPLFQYVHLAAVLGLADGPTEVHKVTVARQVLRDHTPAAGMWPSEWIPGKTEEAQRKFASVLDLEIGNL

SEQ ID NO: 1610 - protein, 860 aa, Frankia sp.
MSWHEGPGLGPDAEAFRGQVCGWLTDSLAPARTAAHADPRDRTGLDEQFERRLQRAAGARGWLGISVPTELGGGGRPASFAAVFDYEAAYHDAPLVDTALTLAGPPVLAFASPDQRDRLVGPMLRGEIEMCIAYSEPGAGNDLASLTSTALALPGGGYRLSGHKTLVTGGGKADVCLTVARTNPAVPARRGVSMFLVDTALPGVTLVPRRTMAGYDLWDVLFDDVELPADALLGTRDDGWRQLSYAVERERTGMFSLGWCQRLFDEVHRYLATPVDGETPACVGTPACVGAPADVGTPADGHRPLDDLRLADGLAAQWTQLRDARHAAARLIREELAGQRSGASASAAKVLLTEYAQRLAQFATEAAGPAGTIGGTLFGPAAPGAPAAGRFAFEYLFRFDGTVSVGANELHRDGIAASALGLRAPRPSAEARQPDRVPTRPGPAAQRPGAGSLGDAGAPGDAPTLRAPIRELLGSWRLGRLAGVQSTSRGYDERLWSALLREAWPAAAATSDAWLTTARVVAEELGYARCPLPVHSGLAQVDAALWALGDAGAKHREELRRGTTRYALCAHDGLGSPAWERAGVIARAAPDGSWRLSGRARFVPYADSADVFLLPARLTTGPGRRGLLLAAVPATAAGLRLTTHRTLSEDHLGDVDLAEVVLRPDQVLAQDDTGGRDSDRAGDRNGGDDGDGGGDGAASRALAAALAMGTMALSAELTGLAAGLLRAAIDHARARTAFGQPLAAFQAVRHRAADMYLDVLCARDATAAACDVLTTTAPEPLDDHARAVVAAAKVTATAAALRAATGAHQLCGGWGHLDDAGLHHYTRAVKAAEGQLGSPSFHRATIAHHLRGCHPAPAPR

SEQ ID NO: 1611 - protein, 404 aa, Frankia sp.
MSGFSLDLSDEQRELRDWAHGFAADVVRPAASEWDEREETPWPVIQEAAKIGLYGFESIATMFADETGLSLPVVCEELFWGDAGIGMALMGTGLAAAAISSAGTVEQLLEWVPQCYGDAADPKVGAFCVSEPGAGSDVSSLRTRARYDEAKDEWVINGQKAWITNGGIANIHVVVASVDPALKSRGQATFVIPPNTPGLEGNKKIKKLGLRASHTADVFLDEVRIPGSCLLGGKDKLDARLAKAREGTSSKGQAAMATFERTRPTVGAQAIGIARAAYEYALEYAKTREAFGRAIIENQAIAFALADMRMEIDAARLLIWRAAWMGKQNRTFEAGEGSMSKLKAGEVAVAVTEKAVQILGGAGYSRDHPVERMYRDSKIYTIFEGTSEIQRLVIARAISGVHIR

SEQ ID NO: 1612 - protein, 426 aa, Frankia sp.
MSETVIDVDAFAARARGWLAENLPPADPAKDTFFLYAATHPTDEEVLARAATCRELQRRLFDGGFAGICVPRQYGGQGLTPAHQAAFNREIKGYDYPAEIQASTFIPCMAILLEFGTEQQKLRHVPAMLRGEEIWVQLLSEPGGGSDAAGAVTTATRDGNGWVLNGSKIWTTSGWWGDWALCLARTNWDVEKHRGLTVFSLPMSAPGLAIRQIELVNGSKDFCQEFLTDVVVPDSDRIGEVDAGWNVMTRWLYHERTISGGSPYVTGGGNRRGDGPYEPATMIEAARRLGTIDDSGTRALIGEARTGALVQRALVESVTRGMATGRLPHHAAAMTRLFGGTANARLAAIATELYGDAGVVWSPDEETSAQVGLGYLIRQAACIGGGTTEMARNVIAERLLGLPREHRADAGAFRDVPRGPQASGTH

SEQ ID NO: 1613 - protein, 426 aa, Frankia sp.
MSIEETESVEDFRSRARGWLARNMPRAEPDATGRMTVRPDEEELAEVAEERRLQRLLWDGGLAGICFPRQYGGLGLTPAHAAAFNEEIAGYRFPARLQVPTMTPCAAVILEFGTEQQKREHIPAILRGEELWMQFLSEPGSGSDVAGAKTSAVREGDEWVINGSKIWTTGAWWSDWGLCLARTNWDVPKHRGLTVFLLPIHQPGIEISRIEMLDGNKEFCQEYLTDVRVPDSARVGGVDDGWTVVTRWLFFERSFTSSPYTIRPAGTGGGESFYGENGVSLVRLAERAGRLADPSARDLIGEGHTLNVAMRELDRRLQAVAAAGKGSDQLAAVGRLMHGVVSARLATIAFDLAGPTAVASDDDEDALGSRGMSYLLRQIGSIGGGTTEMARNVISERVLGMPRETALDRNVPYREVRTAPSSASRP

SEQ ID NO: 1614 - protein, 408 aa, Frankia sp.
MDFGLVELTAEQRAFAAEVCDYLSEIVTDETLTEERETGNGFNLDVHLALGSRGWLMPEWPVNEGGAGLDPVSYRILELEKWDHGVPYITASTTRMVWGSVERFGQPDVRAELKPKIAAGAVRFCLGYTEPDGGSDIAAARLRAVRDGDNWVLNGSKMFTTGAQNCQYTFAITRTDPDLPKHRGLTMFLVPLDLPGIEIQAVHTFGGERTNIVYFGDVRVPDRYRLGGVNDGWTVLRGPLDEEHGMDARASLDDFSVGRNFLRALEPALAAAVDWAATTGLDGRRPADDPTVLARLGRIAAELEAGICTPGAQGRIKGSEVLIAAASDLLDMIGPLGVLRHDSPEAPGAGAIDFAHRFAQGTSTYGGTVEIFRNILAQHELGLPRPIYPGSTQIISTDRRSKATRLGT

SEQ ID NO: 1615 - protein, 408 aa, Frankia sp.
MPTPSAPAPEGAAEAPAEAPAETLAEFQGRVRAWFTANAPRKGSREDFSAVHVVSARTAEEYREQEQHAIDVTRGWQLRLFDAGLAGRSWPAECGGHGAPAWQDEAVAEEQARWGVSTKMFAVGLEMVPAVLFAHGTHEQRVTYLPPILRGEHSWCQLLSEPGAGSDLASVQTRATPRDGGGWTVTGQKVWTSNAGCSEYALLVARTGSREEGRAGLSCFALDMTQPGVDIRPLRQMSGAYHFNEVFLDDAVVPEGGLIGGLGDGWAVLRTMLASERAAIGGGTSARSATQLVALARHLGHADDPGVRDLLAQAVIRERTLDLLRARIAAGHPVPAAGPTTKLLYSEHARLSADAATTILGMAATVVDDPVSAPWIERLLFAPGLRLGGGTDEIQRNAIAERGLGLPR

SEQ ID NO: 1616 - protein, 431 aa, Frankia sp.
MAWDFETDPEYARELDWAEEFVREEVEPLDFVIEHAWDVRDPVRAKLIPPLQDQVRERKLWACHLGPELGGPGYGQVKLALLNEVLGRTHSGPIVFGCHAPDSGNAEILAHYGTDDLKKTYLEPLIENRIVSCFSMTEPQGGSDPTGFTTRARLDGDEWVIDGEKWFSSHARFASFLIVMAVTDPDAPSHRRMSAFVVPADTPGINIVRNVGVSGHDEHEGTHAYIRYEGVRVPADHLLGERGAGFAVAQTRLGGGRIHHAMRTVGLVRRAFEMMCERAVSRTTKGEVLGRKQLVQEMIADSWIQMEQFRLLVLRTAWRIDRYNDYNKVRADIAAVKAAMPKVLMDVASRALQVHGSLGISTEMPFGRWVLESFHMGLADGPTEIHKVNLARQLLRGVTPAPGLFPTGHLPSLAADARARYAVELELADAE

SEQ ID NO: 1617 - protein, 433 aa, Frankia sp.
MAWDFETDPEYQKKLDWANEFVRSEVEPLDLAFPDLQFVPLTDKRRELIDPLKQQVRDQGLWATHLSPELGGQGFGQQKLGLLNEILGRSSWAPIVFGCQAPDTGNAEIIAHYGTPEQKEKYLRPLLDGEMFSSYSMTEPQAGADPTQFTCRAHKEGGEWIINGWKYFSSNAKTASFFIVMVVTNPDVSAYRGMSMFLVPADTPGINIVRNVGLFGEPLGEGFHALIHYEDVRVPESALLGGEGQAFAIAQTRLGGGRIHHAMRTIGQAQRLLDMTCERALSRTTAGSKLAEKQFVQGFIADSYAQLLQFRLLVMYVAWEIDKYQDYKRVRKDIATAKIVMPTILHDIAWRAMQIHGALGTTNEMPFFRYIHGAAVMGLADGPTEVHKMTVAKQVLRDYKPAEGMWPTEWIPGKLDASRAKYAKFLEHEVGNL

SEQ ID NO: 1618 - protein, 433 aa, Frankia sp.
MSTSAAAGAAKGTAAAAGESVEDFRARARVWIRANLRPLEVHEEVGILRVTRTDEEELAAAAREREVQRMLFDNGLAGICFPAEYGGLGLTVAHQRAFDEEIDGYEYPQRIQVPTLTPCAAVLLEFGTEEQKLAHIPAMLKGEEIWMQFLSEPSSGSDVAAALTSAVRDGDDWLLNGSKIWTTGAWWSDWALCLARTNWDVPKHRGLTVFILPLTAQGVDVQRIEMLNGLKEFCQEFMTDVRVPDSDRIGAVDDGWTIGTRWMFHERMASNSPYVTSPGTSAHHRIGPDWLLDIARDAGRLEDPVVRDLIGESRVLDLVGSALQPRLAVGMTTGKLSDQSAAIARLFAGVTATQHMTNAFDIVGDRGAAWVESDGAVFDVGQDFLMRQTATIGGGTTEMARNVISERVLGMPREAALDRGLAFRDVPRGARNS

SEQ ID NO: 1619 - protein, 432 aa, Frankia sp.
MGWDFETDADFQAELDWIDEFVRQEVQPVDLVVTNARDLRDPLRRELIPPLQEKVRERGLWACHLGPALGGPGYGQLKLALMHEILGRSHAAPVVFGCQAPDSGNAEVLARYGTDELRKRYLEPLVAGEIMSSFSMTEPGGGSDPTQFVTRAELDGDQWVINGEKWFSSHARYASFLIVLAVTDPDAAPHRRQSMFVVPAETAGVTILRNVGVAGHEEMEGAHAYIRYQDVRVPADHLLGERGQGFAVAQTRLGGGRVHHAMRTVGLVREAFAMMCERALSRFTKGEPLARKQLVQAMIADSWIEIEQFRLLVLRTAWRIDRYDDYDRVRADIHAVKAAMPKVLHDVAARAVQIHGSLGISNEMPFGAWVLESFQMGLADGPTEVHRTALARTLLAQFEPAAGPFPSGHLPARRAAARERFAEQIERAVHGD

SEQ ID NO: 1620 - protein, 446 aa, Frankia sp.
MWDFETEPEFQEKLDWAEQFVREEVEPLDALWRHKVFERPVDPTLARIVGPLKQQVRDHGLWACHLGPELGGPGYGQVKLALLNELIGRAAWGPVIFGTAAPDTGNAEILAHYGTDEQKRLYLQPLLDGDIVSCFAMTEPQGGSDPRVFTTTAVREGDEWVINGLKFMASHAKWAAFYIVMTVTNHDVDIHRGASMFIVPADTPGIEIERNMALFGHEPVGEGTHGLVRFTDVRVPAENILGGEGQAFAISQTRLGGGRIHHAMRTVSQARRALDMMVERALSRETRGSVLAKKQSVQNYIADSYAELMQFRLFVLYVAWRIDKLKDYQAVRHDIAAVKVLTPQVMHNITQRSLQVHGALGTTSDLPLNEWFSGSMILGLADGPSEVHRLTVARKVLSEGKATDGLWPTQWLPLRQEAARKKFAEFLEPAEFLEPAELLEPQDAGA

SEQ ID NO: 1621 - protein, 401 aa, Frankia sp.
MDFELSAQAHDACERMWDFMRAEVFPAEPVWHAWLREHGEHAYPPVMEDLKASARKRGLWNLFLPAWSGLSNVDYASVAEISGWSPVIAPEAINCQAPDTGNMETLELFGTPEQKDRWLEPLKEGRIRSAFAMTEPAVASSDATNIRTSILRNGDEYVINGRKWFITGVADERCEILIVMGQTDPDADPHRRQSMILVPLATPGVTVVRHLPVFGFQDQHGHSEIVFEDVRVPASNLLSGEGRGFAISQARLGPGRIHHAMRAIGMAERALALMVERAKSRTAFGGPLSDQGVVRDLIAQSRIEIDQVRLYVLKTAWLIDRHGARGAATEISGIKVAAPAVATAVIDRAIEVHGAAGVSDDTPLAHFYASARALRIVDGPDAVHRRTIARRELRADRPYLG

SEQ ID NO: 1622 - protein, 431 aa, Frankia sp.
MAWDFATDPDYAELLTWADAFVREECEPLDLVVRESHDLHDPVRQALIPPLQAIVKEKGLWATHLGAELGGPGFGQVKLALLNEILGRSVCAPIVFGSQAPDSGNSEILARFGTPELKKRYLEPLLDNRIVSSFSMTEPQGGADPKIFTTTATLDGDEWVINGEKWFTSFAALASFLIVMTVTDPDAPPYQRQSMFVVPAGTPGVNILRNVGMGYEPVGQGSEGYVRYENVRVPADHMLGPRGGAFMVAQTRLGGGRIHHAMRTVGLVRRIFDMICERAVSRFTQGEVLGDKQLVRQMVADSWMEIEAFRLLTLQTAWKIDKFQDYKAVRADISAVKAMMQKVLHDVSSRALQLHGSLGTTHEMPFVHYLVESFVLGLADGPTEVHKVTLARELLKGYSPAEGLFPSGHLVRLRAEAEAKFADRLAGIPRT

SEQ ID NO: 1623 - protein, 412 aa, Frankia sp.
MVDFAIPEEAQAVRARAADFLDTHVLPAEARVGREPYFDIVAELQAKARADGLWCPFVPVEWGGMGLGPLANALVQIEVGRSFTYLGAWALNCMGPQDATMLTLIEHGTQEQKERYLRPLVAGDLRICFSMTERAAGADATGLRTSAVRDGDHWVLGGEKWFSSNASISQLALVMARTSEQGPRREQFTTFLVELPNPGYRILRNIPTMDEPLRPRFEDEVTSGHAEVRIDNLVVPHANVLGGVGRGFAMGQHRLGYGRLRHGMWSIAKAQAALDLAAGRALSRETFGAPLADRQGVQWMLADCAERLYLSRLMVLHIAAKMERGQDLRQENAIAKNYIAHMLHHVVDTALQLHGSLGYTLDTPLAEWYAEARQQRLVDGPDEVHRWMIGRGVLRAFERDGTTAAAAGGDLL

SEQ ID NO: 1624 - protein, 718 aa, Frankia sp.
MAIAISEEHRELARTARAFLTSNDARAANRALLEADEEPLPTFWKEFADLGLLGLHLPEEHGGGAGLPELVVVVEELGRAAAPGPFVPTVAAGAVIAAAGDAEQRARLLPGLAAGETVGAVGLLGDLTLADGRLSGSGGVVLGGALATLFVLATGDDVVLVPAGADGLTVEVPAALDPARRSARLWLDGVEVAGVLPGARRAATALTRVIFAAEAVGGALETVEVATAYAKVREQFGRPIGAFQAIKHHLANMFVAAELATAAVWDAARAAVDGAGADELELAAASAAALALTAFAGDASLNIQVHGGIGYTWEHDAHLLLRRATTLAAVLGPESAAADVAALAAAGVSRASTLDLPAEVEAAREGVRAFAQEVAALPEKEQLERLIDTGYIQPHWPRPWGLAASGGLQLVIDQEFAAAGVQRPNYGITSWNILTLVQHGTQDQIDRYVRKALTREEIWCQLFSEPAAGSDAAGIRTRAEKVDGGWVINGQKVWTSLAQYCRRGLATVRTDPDARKHAGVTMMIIDMKHPGVEVRPLRQTTGDSHFNEVFLTDVFVPDADVVGEPNQGWKVARATLGNERVSIGGGIGAPASADVVELYRARPDAFPAAAERVGRHVAEGLALRQLNLRGAVRAVAGGEPGPEGNVTKLALAEHTGSAAALNLAFAGPGAAFLDGPGAAAGRGALGWRAMTIAGGTSEITRNQIAERILGLPRDPLLK

SEQ ID NO: 1625 - protein, 718 aa, Frankia sp.; identical to SEQ ID NO: 1624

SEQ ID NO: 1626 - protein, 412 aa, Frankia sp.; identical to SEQ ID NO: 1623

SEQ ID NO: 1627 - protein, 431 aa, Frankia sp.; identical to SEQ ID NO: 1622

SEQ ID NO: 1628 - protein, 401 aa, Frankia sp.; identical to SEQ ID NO: 1621

SEQ ID NO: 1629 - protein, 433 aa, Frankia sp.; identical to SEQ ID NO: 1617

SEQ ID NO: 1630 - protein, 433 aa, Frankia sp.; identical to SEQ ID NO: 1618

SEQ ID NO: 1631 - protein, 432 aa, Frankia sp.; identical to SEQ ID NO: 1619

SEQ ID NO: 1632 - protein, 446 aa, Frankia sp.; identical to SEQ ID NO: 1620

SEQ ID NO: 1633 - protein, 408 aa, Frankia sp.; identical to SEQ ID NO: 1615

SEQ ID NO: 1634 - protein, 431 aa, Frankia sp.; identical to SEQ ID NO: 1616

SEQ ID NO: 1635 - protein, 426 aa, Frankia sp.; identical to SEQ ID NO: 1613

SEQ ID NO: 1636 - protein, 408 aa, Frankia sp.; identical to SEQ ID NO: 1614

SEQ ID NO: 1637 - protein, 426 aa, Frankia sp.; identical to SEQ ID NO: 1612

SEQ ID NO: 1638 - protein, 404 aa, Frankia sp.; identical to SEQ ID NO: 1611

SEQ ID NO: 1639 - protein, 860 aa, Frankia sp.; identical to SEQ ID NO: 1610

SEQ ID NO: 1640 - protein, 433 aa, Frankia sp.; identical to SEQ ID NO: 1609

SEQ ID NO: 1641 - protein, 578 aa, Desulfotomaculum gibsoniae
MFFLEDIAPEQVFTPEDFTGEHKMIADTVAGFVKNEILPNVEELDNQQEGLMRSMLERAGELGLLSADIPEEYEGSEMGKIAAAIITENVSAGGSFAVSHGAHTGIGSLPIVLFGNEEQKKKYLPGLASGDLVAAYALTEPMAGSDALAARTKAVLSEDGKFYILNGEKIFITNAGFADVYITYAKINGEKFTAFIVDRDTPGFSVGAEEKKLGIRGSSTCSLIFEDAKVPVGNVLGEIGKGHVIAFNILNIGRYKLGAGAMGSSKAALAIAAKYAVERQQFGMPIAKFGMIKNKLAQMAVKTYASESLVYRMVGDIEKALAGKTNGREIGAAIEDYAIECSIAKIHASETLDYAVDETLQIHGGYGYTQEFPAERFYRDARINRIFEGTNEVNRLIIPTTLLRRGIKGQLPLFQAAQALTSEVISLRAKIPTGDEAPFELEMDIINRAKKLFLMVGGSAAQKYMQKIAEEQEIIEILANMAIEIYAMESTVLRARKALEKDPENAETKVELALAYVYDVFPKLDAWAKQALAHMFDGDMLRTNLSIGKRLAKFTPVNLIAIRRKIADKVLDAGKYVV

SEQ ID NO: 1642 - protein, 584 aa, Desulfotomaculum gibsoniae
MSNLPKGGSYIFGQTDPQNIFTPEDFTDEHIMIFRTAAGFVTDNILTRMEELESKKEGIIRELLEACGELGLLGADIPEEYDGMEMDKISSTIIAECMGRAGSFAMTQGGQTGIGSMPIVFFGNHEQKKQYLPGIVSAEKIGAYALTEPEAGSDAMAIKTKAVLSSDGKYYILNGTKQFITNAGMADVFIVYAKIDGDKFTAFIVDGDSEGLSTGPEEKKMGIKGSSTRTLILEDVKVPVENLLFEIGKGHVVAFNILNLGRYKLAANSLGHAKFALELSATYANDRKQFKTPIANFGLIKEKLAEMAIKIYAAESMLYRTGGLLENMLHSLDTSGEDGGRVAAKGIEEYALECSMNKVFATEVVAYCVDEGVQVHGGYGYSSEYTIERLYRDARVYRIFEGTNEINRSLIPITLLRRAAKGDLPLQEAIERLRGQLSSGIPAREGEVDLVQAAKEIFLLTIDAGLQKYGDGLNKQQEILGKLADLAIMTFAMESAWLRAQKSMVNEDEAGSKLKMNMAKAYINSTFGVMVYVAGETLAALADGNELTSLLENLQMLSRYTPRNTIALRQEIAAAISEAGKYVV

SEQ ID NO: 1643 - protein, 594 aa, Bacillus coagulans
MANKTDAFVKGGSFLIEDITPDQVFTLEELTEEQKMIAKTAEDYTNNEVVPQIEYLENHEFDRSVKLLKKAGELGLLSADVPEEYGGLALDKVSSALISEKLAKVGGFAISHGAHVGIGSLPIVLFGNEEQKKKYLPKLATGEWLAAYALTEPSSGSDARSAKTVARLNEAGTHYILNGEKQWITNAGFADVFTVYAQVDGDKFTAFIVERTFPGVSTGAEEKKMGIKSSSTRTLILEDVPVPVENVLGEIGKGHKIAFNILNIGRYKLGVGAVGSSKHVLEIALKYANGRQQFKTPISQFNLTKEKFGTMASKLYAAESSVYRTVGLFDERMSHFTPEEEKDGRAVANAIAEYAIECSLNKFFASEVLDYVVDEAVQIHGGYGFMDEYEVSRAYRDSRINRIFEGTNEINRLIVPGTYVKKAFSGELPLLQKAQSLQEELMMMMPEQVGDAPLEQEKYLVRNMKKIALLVAGTALQTYGKKFENEQELLANVADLVSNIYAAESCVLRTEKAINKDGAEKQNQKLLYTQIFTQEAFNQCEQIAKESLAACLEGDQLQMTLSALRKLTRHTPTNVIAKKREAADKLIDAERYVL

SEQ ID NO: 1644 - protein, 414 aa, Bacillus coagulans
MDFDYSPKVKALISKLERFMEENVYPGEKIFEEQLNAQETRWAAVPPIMEELKAKAKQEGLWNLFLPDNEYGAGLSNLEYAPLCEIMGRSIIAPEVFNCNAPDTGNMEVLARYGSDEQKEKWLKPLLNGEIRSCFSMTEPDTASSDATNISCSIVRDGDEYIVNGRKWWSSGAGDPRCKIAIVMGKTNPDAPRHEQQSMILVPLDTPGVKIERMLPVFGYDDAPHGHAEITYENVRVPAENIIWGEGKGFAIAQGRLGPGRIHHCMRLIGAAERALELLCKRIQNRAPFGKPLAEQGVIRQWVAESRIEIEQARLLTLKAAYRMDTVGNKVARKEIAMIKAVAPRMALAVIDRAIQAFGGAGVSDDFPLARLWANARTLRLADGPDEVHLDQIARLEIKPYQERGSADERVRTV

SEQ ID NO: 1645 - protein, 403 aa, Bacillus coagulans
MHFELTEEQELLKKTVRNFVDKEIMPFIREWDENHHFETGLLKKLADLGLMGVCIPEKYGGSGMDYNALAIVCEELERGDTAFRTAVSVHTGLNSLTLLQWGTEAQKQKYLVPQAKGEKIGAFGLTEPGAGSDVAGIGTTAEKDGDFYILNGQKTWISLCDVADHFLVFAYTDKAKKHHGISAFIVERTMPGFSSKAIKGKLGIRAGNTGELFFDNVRVPKENLLGEEGEGFKIAMSALDNGRFTVAAGACGLIQACLEASVKYCHERKTFGHEIGKHQLVQQMIAKMEAGYQMSRLLVFRAGELKNQGKRNTRETSLAKWQACDFANEAANDAVQIHGAYGYSSEYPVERYLRNSKAPVIYEGTREIHTIMQAEYVLGYRTDKPLSKMLPAWPFTESGAEES

SEQ ID NO: 1646 - protein, 590 aa, Desulfosporosinus meridiei
MELALRGGGFLLTEVAPDQIFVREEINEDHKQLKRMAHNFMTKEVAPKIEEMEEQKDGVVREFMRQAGELGLLGLEIPEEFEGLSMDKYATVVVGEEVPRGGSFAVAYAAHTGIGTLPIVYFGTPEQKAKYLPGLANGSKVAAYCLTEPGSGSDALGAKATAVLNPEGTHYILNGTKQFITNAGFADVFLVYAKVDGKMTNFIVERDYPGFSLGPEEQKMGIKGSSTRQVILEDVMVPVENVVGELGRGHVVAFNILNVGRFKLAAGAIGSVQVVLETALKYASERKQFGVALNTFGAIQNKIAEIATRAYMAESVVYRTAGLMESGFHDLDLTGDCRKEAGKALEEYAIECSLNKVYASEVLDFAVDEGVQIHGGYGFIKEYPIERMYRDSRINRLFEGTNEINRLLVPGTLLKRAMTGELPLLQAAQAVSRDLVSVGMGGNAEGLEALNQMTQKAKKLCLMAAGLAAQNLGMALKDNQFVLTGMAEMVNQVYAMESAVLRAQKVQTLDVSAEHKVFVEKAATLGAYAAFNILEIQAKEVLCAVEKGDSLSTVLAGMRKLVKRPNVDMIGMRQEIAKYIIEKEGYPVNY

SEQ ID NO: 1647 - protein, 584 aa, Desulfitobacterium metallireducens
MTIIAKGGSFLLGRTDPQTLFTPEDFTLEHKMIFRTAAGFVKDNVLAQMDDLELKTEGLNRKLLQGAGELGLNGSEIPEEYGGTEMDKISTTIIAECMGWSGSFAMTQGGQTGIGSMPIVMFGTPKQKAKYLPGIGSGEIVGAYALTEPGAGSDALGAKTRADLSPDGKYYILNGTKQFITNSGFADIFIVYAKVDGDKFTAFIVDADSEGLSTGPEEHKMGIKGSSTRQVIFEDVKVPVENMLYKIGKGHVVAFNILNLGRYKLSANSLGGSKFALELAATYANERKQFGNPLASFGMIQEKLAEMAIKTYVTESMVYRTGGLLDEMMHSLDTSGPDGGQVAAKGVEEYAIECSMNKIFATEALDYCVDEGVQIHGGYGFSAEYTIERLYRDSRIYRIFEGTNEINRTIIPSTLLKRAAKEELPLQETIDALKTKITSGSIARDGEEGLVQAAKDIFLLTLDASQQKYGKDLAKQQEIVGRLADLSMQAYAMDSAWLRAQKAVVNEGEAKAKLKLSMAMAYINSTIGLSEYTAKETLTALAEGEELTNLLENLKKLTQYTLRNTVALRQEVAAVISENGKYTA

SEQ ID NO: 1648 - protein, 584 aa, Desulfotomaculum gibsoniae; identical to SEQ ID NO: 1642

SEQ ID NO: 1649 - protein, 578 aa, Desulfotomaculum gibsoniae; identical to SEQ ID NO: 1641

SEQ ID NO: 1650 - protein, 403 aa, Halobacterium sp.
MDFSESSELGLVKSQIDRFIEREVRPLESEHDQFLGERGVENRLDENGYLVDEYLDIRDEIRQLSAEAGFLTMHMPESVGGGGLSLLEYLLVLEHVNSYHPEGFHEMLLETLLTPALLPMHEDDHLRERYFEPMMNADITVTIGMSEPDHGSDITYLDTTAEKDGDEWVVDGTKCWITNSTFADAIIVFARTDGEDGDAYGISAFVVDEDNPGWERGKAQRPMGDEDAGRIAFNHFEGCRVPEERMVGERGRGLVDVAMGSVGYFRLSLPARAVGHAQWMFEECVDYAESRETFGKPIGTRQFVKGMLAEMRADIEQVRWLYRHAAWQYDRGEGERWEQSAAKLRGAQLWNDAADRAVQIHGGAGYVRSLPFEAEYRNARVTRIYDGTDEIQKVTIADQFLDL

SEQ ID NO: 1651 - protein, 409 aa, Halobacterium sp.
MEYGDSDQAKEVAERTRKFVDEVVVPVERELLGGEPATETQVAALREEAREWDVYAPQLSTEYGGMGLDFRDMLPVFEQAGRSLVAMDAMRVAAPDEGNMHLLELVGTDEQKDRWLEPLAAGDIRSGFCMTEPLDGAGSDPKMIRTTARKDGDEWVIDGHKWWTTQGTEADVLIVFARSDPDAHPYEGCSTFLVPKDTDGVDVVRDIPHVGGSVAGVSHAEITFDGVRVPEENLLGDLHEGFQNVQLRLGPARLTHCMRYTGMGQRSLDIAKAYASERQAFDGPLSEKQDLRYRVADAETRLHAVRTMVRHAAERIAEGEQARVPVSMCKVFAANTVQDAIDLSLQVCGGNGIGKDLPIADFYENVRQFRIIDGADEVHKRVIARDAFDDVDSWELEGVTRYGDPVTRR

SEQ ID NO: 1652 - protein, 424 aa, Acidovorax avenae; identical to SEQ ID NO: 1538

SEQ ID NO: 1653 - protein, 402 aa, Saccharomonospora paurometabolica
MDFAFDATTEEYRARLQAFMDEHVYPAEPVYEQQSRAAAHPGDQVPVLGELKAGARRQGLWNFFLPGELGAGLSNVQYAPLAEITGRSPHLAPAALNCAAPDTGNMEVLAQFGDEKQRQQWLHPLLDDEIRSAFAMTEPDVASSDARNIATRITRDGDDYVVDGRKWFISGAMDPRCAVLIVMGKSDPDAEPHRQQSMILVPRDTPGVEVRRGMSVFGYGDESYSDHAEVVFDNVRVPAENLISGEGEGFAIAQARLGPGRIHHCMRAIGMAERAIELMCRRAVSREAFGKALAEQGVVQDWIAEARVRVEQLRQLVFKTAWLMDTQGNRGAHTEIQAIKIATPRTVEWILDKAIQTHGAAGVSQDTPLAALWASVRTLRFADGPDEVHKRSLARRELKRYV

SEQ ID NO: 1654 - protein, 649 aa, Saccharomonospora paurometabolica
MAEHPHVTEARARQVAEQARESGWTKPSFARELYLGRLRLDLIRHTPPGAGPGGGDTPAAEAFLARLRSYCETLDPTVIEREGRIPDTYVKGLAELGCFGIKIPEDYGGLGLSQLAYNRALMLVGSVHSSLSVLLSAHQSIGVPEPLKLAGTPEQKAEYLPRCARGAVSAFLLTEPDVGSDPARLGTRATPTDDGAAYELDGVKLWTTNGVVAELLVVLARVPRTGERPGGITAFVVEADSPGITVRQRNTFMGLRGIENGLTRFDRVRVPRANVVGGEGDGLRIALATLNTGRLSVPASCAGAAKWALGIARQWSAERVQWGRPIGEHEAVARKVSFLAATTFALESVVELTARMADEGHGDIRIEAALAKLWASERAWEIADELVQIRGGRGYETAGSLAARGERAVPTEQLLRDMRINRVFEGSTEIMHLLIAREAVDVHLTAAGELVDPSVGPRRRAVAAVRAGGFYARWLPRLVTGAGRVPTAFAEYGDLAGHLRYVERAARRLARCTFYGMARWRAAMEKRQAFLGRVVDIGAELFAMTAVCVRAETPGADEEDRGRPAHELADAFCAQARLRVEALFGALWTNTDRGDRALARQVLAGRYAWLEEGVLDPSEGTGPWIADGDGHAGTVDGGGVARRFLPPTR

SEQ ID NO: 1655 - protein, 590 aa, Desulfosporosinus meridiei; identical to SEQ ID NO: 1646

SEQ ID NO: 1656 - protein, 584 aa, Desulfitobacterium metallireducens; identical to SEQ ID NO: 1647

SEQ ID NO: 1657 - protein, 407 aa, Natronobacterium gregoryi
MQYADSERARDVADRARELMEDIVLPRERDRAGGVPISSGTVAELRDAAREYDIYAPQIPEEYGGMGLGFRDSLPVFEEAGRSILGPVAMRVDAPDEGNMHLLEMAGDDLQKETYLESLVAGEITSGFSMTEPMQGAGSDPKMIQTTAEKDGDEWVIDGHKWWTTQGLDADVLIVLARTDEDVHPYEGCSLFLVPADADGVGVVRDVPHMGGSSHGISHAEIVYDNVRVPEEHLLGEQNQGFVHAQARLGPARLTHCMRYSGMAQRALEIAKAYTSERQGFDSTLSEKQSLRHRIADAETRLHVARTAIRDAADRIAAGNEARVPVSMCKVFTANATQDAIDLAVQCCGANGIGKDLPLSDFYEAVRQFRIVDGADEVHRRVIARAAFEDVNKDELEPLTRFGEPNR

SEQ ID NO: 1658 - protein, 649 aa, Saccharomonospora paurometabolica; identical to SEQ ID NO: 1654

SEQ ID NO: 1659 - protein, 402 aa, Saccharomonospora paurometabolica; identical to SEQ ID NO: 1653

SEQ ID NO: 1660 - protein, 559 aa, Hyphomicrobium denitrificans
MSVAPLKAGANILSAGPEKLIERCGEAVTGADRILQAAKAGVRIKIQEAGGIDNAQHTAHGLAWLATAVEGLRQMHDWANRLNGEGRFGELEQLLLIAAFAEYGAQIASGIPMSQLEIARPDALGVSKADLRRFDDSIADLVAEGGSEAVKARLGELIAAQPEAMTFGDTGLDETHAQIQDLMRRFCLDEVYPHAHEWHLKNEYIPLEVIAKLAELGVFGLALPEEFGGMALGKESMCVASEELSRGYIGVGSLGTRAEIAGELILHNGTPEQKEKYLPKIASGEMLPTAVFTEPNTGSDLASLKTRAVKDGDVYKITGQKTWITHPVRADIMTVLTRTNPNEPGYKGLSMFLAEKPRGNDEDPFPAKGMTGGEIEVLGYRGMKEYDISFDNFEVPAVNLLGGVEGQGFKQLMNTFEGARIQTAARAVGVAQCAMDLGLKYALERVQFGKPIYSFPRVRNKVVMMAVETMIARQLTYFSARQKDAGRRCDLEAGMAKLLGARVAWANADNALQIHGGNGFALEYPISRVLCDARILNIFEGAAEIQAQVIARRLLENTN

SEQ ID NO: 1661 - protein, 409 aa, Halobacterium sp.; identical to SEQ ID NO: 1651

SEQ ID NO: 1662 - protein, 427 aa, Mycobacterium rhodesiae
MDFSVDPDFEPQLEWMRNLMRDEVYPLEVLQAPREVFTEIISGLQTQVKQRGLWAAHLPPSLGGPGFGQLKLALMHEILGGSHWGPLVFGNQAPESGNTELIALAGTDEQKRQWVEPSLRGEMYSGFSMTEPNAGSDPTRLTTRAELDGDEWVINGHKWFTGHGYIADFVIVMAVTDPDAEPHRRASMFIVPKGTPGFIPARNIPNLHDIPDHPFEFGESEVFYRDCRIPKANLLGEVGGGFKLAQARLGPGRIHHCMRWLGQARRAFDMMCERALQREVFGGPLADKQTVQNWIADSAAEMQAARLMTLHAAWRMDEFGVAAARTDISLIKFFGAKVLHDVVDRALQVHGALGYSDDLPLAMMYRRARAARIYDGPDEVHRRTVSRQILKNYQRNADLWPAEHIPTRRQDAEKKYAELLARHHGEN

SEQ ID NO: 1663 - protein, 430 aa, Mycobacterium rhodesiae
MAWDFETDPEFQAQLDWIEDFVRSEIFPLETLDLDWPQLQSAVAPLQQEVKQRALWAAHLSPELGGQGYGQVKLGLIHERLGMSPYAPLVFGNQAPDSGNTEILAEAGSAEQKLRWLEPLLAGDLTSAFALTERDNAGADPSNLASTAVRDGKDWVINGHKWFITNASIADFMIVVAVTDPNAERHRRTSQFIVPMDSPGVRVARDITTMDSLEHRASQPYPSHAEVFLEDVRVGDEALLGQPGDGFLIAQKRLGPGRIHHCMRWVGQANRAFDMLCERATYRYAHGSVLGEKQTVRNWIADSAAEIQAARLMTMHAAWTIDQHGASAARKEIALIKFFGAKVLHDVIDRALQIHGSLGYCTDLPLESMYRAARAARFYDGPDEVHRDTVARLILRDYQPPTSGLPSEHVPTRREAAQARFAALLQSTTS

SEQ ID NO: 1664 - protein, 460 aa, Mycobacterium rhodesiae
MTNTLPPTTPSARARDSAVGQFKHKRSITDIGLAIITPLVGQDFLDRYHLRDPLNRGLKYGVRQAFSTGGAVTRQFKRVQGIGKEPTRLRPSGADYFDLTPDDDQKMIVATVDEFAEEILRPAAHDADEAAAYPADLIAKAAELGITAINVPEDFDGIAEHRTTVTNALVAEALAYGDMGLALPILAPGGVASALTHWGSADQQATYLNDFAGENVPQACVAIAEPHALFDPTALKTTAVRTPSGFRLDGVKSLVPAAADAELFIVAAQLNGKPALFIVEASTPGVSVKADPSMGIRAAALGRVELDKVSVPLSARLGEDGAGDADYSEAIALARLGWAALAVGTSHAVLDYVIPYVKEREAFGEPIARRQAVAFMCANIAIELDGLRLITWRGAARAERGLPFAREAALAKKLGTDKGMQIGLDGVQLLGGHGYTKEHPVERWYRDLRAIGVAEGVVVL

SEQ ID NO: 1665 - protein, 409 aa, Mycobacterium rhodesiae
MTAAIRRTQDDMSHDVFLPTETVELRARARESVARHLAPLAREIGSRQESVDSFPWQSFRGLASDGMFAVPFGPEHGAGLQYPMLGTCTVAEEIAYESSSMAGVYDGQCILVPATLRYADARLRDMLVPELVSGRQAFAFATTEPETSSDLTAERLGTFAEESDGEFIVTGRKRWITNSVVANWVSMLVRAGRTGGRAHMLLIDLTSPGVRIGSPDLKMGHRGQITADIVLDEVRVPRENLLGEWGRGMAVALSALVRGRIGIGAAGVGVAQAALDLAVHRLRTRHVFGKPLGAMQHWQFQMAQRATELECARSLYQKAAMLLDTGDATAEPEAAMAKAYGTRLANDLVREAIQIHGALGFARQVGETGESVRLEEMYRDAKILEIFEGANELQQWIVARRLIGREITG

SEQ ID NO: 1666 - protein, 403 aa, Halobacterium sp.; identical to SEQ ID NO: 1650

SEQ ID NO: 1667 - protein, 405 aa, Mycobacterium rhodesiae
MSAKGADYHKRLTDFMVEHVFPAEKSYDEYRAAAGPNDFTVPPIVEELKVLARGQGLWNLFLPSESGLTNLEYAPLAELTGWSTEIAPEAINCAAPDTGNMETLHLFATEPQRKQWLEPLLAGEIRSAFSMTEPAVASSDARNIATSIVRDGDDYIVNGHKWWTSGANDPRCKVLIVMGRTNPDAASHQQQSMILVPTDTPGVNIKRSTSVFGWQDQHGHAEVIYDNVRVPATNLLAEEGMGFAIAQARLGPGRIHHCMRAIGVAERALALMTERARTRIAFGKPLAEQGVVQQQIALSRNEIDQARLLCEKAAWTIDQHGNKEARDLVAQIKAVAPQMACNVIDRAIQVHGGGGVSDDFPLARMYGWQRAMRIFDGPDEVHMRSIARAEIGREQSALAAAVTRA

SEQ ID NO: 1668 - protein, 431 aa, Mycobacterium rhodesiae
MWDFETDPDYQKKLDWVEEFMRDQLEPLDFAPLDPYEKTNPEVLRVLRPLQQQVRDQGLWAAHLGPELGGQGYGQVKLALLNEIVGRSRWAPSVFGSQAPDSGNAEILAMFGTEEQKQRYLQPLLNGEISSCYSMTEPHGGSDPGLFTTHAERDGDEWVINGEKWFSSNARNASFFIVMVVTNPQARTHQKMSLFIVPAETPGIEIIRNVGVGGESDDRAGHGYIRYNDVRVPADHVLGGEGQAFAIAQTRLGGGRVHHAMRTIALARKAFDMMCERAVSRKTRMGPLGDYQMTQEKIADSWIQIEQFRLLVLRTAWKIDKYHDYQKVRRDIAAVKVAMPQVLHDVVQRAMHLHGALGVSDEMPFVKMMVGAESLAIADGPTEVHKLTVARRTLKEYEPVDTLFPSQHIPTRRAAAQAKLAEMLEHEVAEL

SEQ ID NO: 1669 - protein, 435 aa, Mycobacterium rhodesiae
MAWDFSTEPEFEEKLEWIRNFVRDEVEPLEVIFPSCEFLPLDEERRRIIDPLKQKVRDQGLWAPHLGPELGGQGFGAVKLTLINEILGRATWSSIIFGTQAPDTGNAEILARFGTSEQKDRYLTGLLSGEIFSTFSMTEPQGGSDPRVFTTRAVRDGDDWVINGRKYWSSNASVASFFIVVAITDPDVPVHKGASTFLIPADTPGVNIEATHHLVGSYSHDPGHSLVHYDNVRVPASAMLGEEGQGFHVAQSRLAGGRLHHAMRSIGVAQRAIDAMARRAKSRFTQGSLLADKQLVQEMVADSFVELTQFRLMVLYAAWLVDTGGERAAREAIAACKIQTANVLKSIGLRAIQVHGGLGLTDQMPLTSVLMGGITLGLADGPTEAHKVNLARQILKGYEPDDPVWPSEFLPNRIERAREKYGHLIDRIPALPVSP

SEQ ID NO: 1670 - protein, 461 aa, Mycobacterium rhodesiae
MGLDLTPTTAQHDLARRTHEFAEHCIRPVAGEYDRRQEFPWPVLEEAAVRGFYSPLFYRDLIGDPTGLSLPMFMEELFWGCAGIGLAVVMPALALAAIGQAATPEQMLTWAPECFGTPGDLKLAALAISEPEGGSDVRNLRTRARRDGDDWVIDGHKMWIGNGGIANVHVVNAVVDEELGHRGQALFVVPGGTPGLELVRKLDKLGCRASHTAELKFAGVRIPGENLLGGPDKLEHKLAKTREALATGGRRSGSATLGTFEQTRPMVAAQALGIARAALEYMTTYANRREAFGAPIIDNQGIAFPLADLATGIDAARLLTWRASWMAANSVPFERGEGSMAKLAASEIAVKTTERAIQTMGGWGYITDHPVEKWYRDAKLYTIFEGTSEIQRVVIASALGAADGGPPMHVELDPSGGPLNRWFGRGTPARGRVANAALAMRDRVPEPAMRMAMKILAPPRR

SEQ ID NO: 1671 - protein, 430 aa, Mycobacterium rhodesiae
MFTADCSLVVVIRCRPTRYDLIRSYTVMSFSLEVPEEVATVRDWVHKFAADVVRPAAAEWDEREETPWPLIQEAAKVGLYTPELFAEMSAEPSGIGMLTVFEELFWGDAGIGLSILGTGLAAAALAGGGTPEQIGHWLPEMFGTPGDPHLAAFCSSEPGAGSDVGSVRTRARYDEASDEWVLNGTKTWATNGGIANVHIVVASVDPELGTRGQATFIIPPNTPGFSQGQKFKKHGIRASHTAEVVLEDVRLPGHLILGGMERFEQRMAKAREGTRTSTQAAMATFERTRPAVGAMALGVARAAYEYALEYACEREQFGRKIGDFQAIGFKLADMKSRIDASRLLIWRAGWMQRNNKPFTSAEGSMAKLHASETAVYVTDEAIQILGGNGYTRDYPVERMHRDAKIFTIFEGTSEIQRLVIARRLTGLPLR

SEQ ID NO: 1672 - protein, 419 aa, Mycobacterium rhodesiae
MTETVISTSTESVAEFAARARTWLAANMPPIDPDHPPFAVRAEQPSWDHAQELQKRLYEGGFAGICFPREYGGLGLDHAYQQAFNAECRGYEMPLILNTPSLTICAATILDMGTEAQKRERISAAIRGDEVLCQLLSEPSGGSDLAGVITRADRVGDKWVVNGAKTWSTSAFAADYGLMLARTDWTVPKHEGLTMFLVPLNSPGITMRRIKEVNGNEEFCEEFFDGLELGDDAVVGEVNKGWEVASRQLHHERRAVGGGSEFASGTGAENAEEMPPDHVTLAERTGQGDDPAVQSLAGRALVRRIVKEQLIHHVGTAIGNGSLPPNAGTLIRLFHAETTELEVDTALAIAGTAGVVDEGGDLSGLLDIGVRYLSRQTGSLGGGSSEMARNVIGERILGFPRELAADKGVPFNQVKRGGG

SEQ ID NO: 1673 - protein, 411 aa, Mycobacterium rhodesiae
MIEWSDVDIAVRDAVREFVDKEVRPHIDALESGDMEPYPIVRKLFATFGIGEMARESLNKRLAKMRAGAETTSKGGGGMFGDGGSAGMGFVLISELCRVSMGLVTGMGVSLGLTVPTIQSRGTLAQQERWLPELVTYEKIGAWAITEPDSGSDAFGGMKSYVVRDGDDYILNGQKTFITNGPDADVVVVYAKLDEGDGADKRDRKVLTFVLDRGVEGFVQAKPFRKMGIHSSRTGELFFNNVRLGRDRLLGETEENKSGDGRDSARSSFAAERIGVVSMALGVIEECLRLCTDYAKTRTLWGKEIGQFQLIQLKLANMEVARMNVRNMLFRVIECGQTGTPISLAEASAMKYYCSQAATDVAMEAIQLFGGNGYMTEYRVEQLARDAKSLMIYAGSNEVQITHVAKGLLNE

SEQ ID NO: 1674 - protein, 424 aa, Delftia sp.; identical to SEQ ID NO: 1579

SEQ ID NO: 1675 - protein, 407 aa, Delftia sp.; identical to SEQ ID NO: 1580

SEQ ID NO: 1676 - protein, 407 aa, Natronobacterium gregoryi; identical to SEQ ID NO: 1657

SEQ ID NO: 1677 - protein, 594 aa, Bacillus coagulans; identical to SEQ ID NO: 1643

SEQ ID NO: 1678 - protein, 414 aa, Bacillus coagulans; identical to SEQ ID NO: 1644

SEQ ID NO: 1679 - protein, 403 aa, Bacillus coagulans; identical to SEQ ID NO: 1645

SEQ ID NO: 1680 - protein, 673 aa, Rhodothermus marinus; identical to SEQ ID NO: 1563

SEQ ID NO: 1681 - protein, 401 aa, halophilic archaeon
MLPRDTVRLSDQQQLVRDSIRDLCDDFDANYWRSKDEIGEYPAEFVDELADHGWFGVLIPEKYGGAGMTTEETVVMMEEIAASGGGFSAAQSIHGGIYNSVPLVKYGSESLKQDLLPEIARGEVSIQAFGLTEPNAGSDSTAIETHAEIDGDEYVISGQKLWISRVDESDYIVLMARTTPRDEVDKRTRGISMFLVDLENAYDQDALKIERIDKTASNFVHSYEMWFEDLRIPADAVIGDVDNGFYQMLDGLNEERLVIAAECVGLGEAAIEAGVEYANDREVFGRPIGKNQAVQHPLAEAYARVQAAKQMVYSAANAIEDGDHDAQAIGARANMSKFLAADAAFEAADAAVQTHGGFGVAREYDVERYFREARLTRLVPITQQLVLNFIGENVLDLPRSY

SEQ ID NO: 1682 - protein, 404 aa, halophilic archaeon
MEYDDSERAREVAERTRKFIDDVVIPVERDVLGDSPASAETVAELREAARDRDVYGPQLPEEYGGLGLSYRDMLPVFEAAGRSLLGPPAIRVDAPDEGNMHTIGLFGTDEQQEQWLRPLAAGEIGSGFAMTEPMQGAGSDPKMIRTTARKEGDEWVIDGHKWWTTKGVEADVLIVMARTDPDAHPYSGCSLLLVPADAPGVEVVRGIPHMADDVRGTSHAEIRFDEVRVRAENLLGQENEGFAHAQERLGPARLTHCMRYSGMAERALDVAKAYTSERKAFGDPLADKQSVRFEVAEAETELHAARTMVRHAARRIEQGEQARIPVSMAKVYTANTVQNVIDTAVQLCGGNGIGKDLPLADFYENVRQFRILDGADEVHKRVIARSAFEDVDPDEISELTRFGE

SEQ ID NO: 1683 - protein, 401 aa, halophilic archaeon; identical to SEQ ID NO: 1681

SEQ ID NO: 1684 - protein, 404 aa, halophilic archaeon; identical to SEQ ID NO: 1682

SEQ ID NO: 1685 - protein, 402 aa, Geobacillus thermoglucosidasius; identical to SEQ ID NO: 1564

SEQ ID NO: 1686 - protein, 402 aa, Geobacillus thermoglucosidasius; identical to SEQ ID NO: 1565

SEQ ID NO: 1687 - protein, 401 aa, Geobacillus thermoglucosidasius; identical to SEQ ID NO: 1566

SEQ ID NO: 1688 - protein, 594 aa, Geobacillus thermoglucosidasius; identical to SEQ ID NO: 1567

SEQ ID NO: 1689 - protein, 594 aa, Caldalkalibacillus thermarum
MSDVKSFVRGGGFLIEDVTPEQVLTPEEFTEEHRMIAKTTEEFVLNEVRPVLEEIENQNFEHTVRLLRKAGELGLLGADIPEKYGGLGLDKISSSLITEYLSPGRSFALSFGAHVGIGTLPIVFFGNEEQKKKYLPALATGEKIAAYALTEPSSGSDALGAKTVAKLSDCGKYYILTGEKQWITNSGFADVFIVYAKVDGEKFTAFIVERDYEGVSTGPEEKKMGIKGSSTRTLILDEAKVPVENVLGEIGKGHVIAFNILNIGRYKLAVGCVGSTKRLLEISVKYAKERKQFKQPIANFNLIKNKLANMAIRTFVNESMVYRTTGLFEEKLGRLSEEEMENGLEVAKSIAEYAIECSINKVYGSEALDYVVDEAVQIHGGYGYMSEYEVENAYRDSRINRIFEGTNEINRLLIPATLMRKVMKGELDLLSKASGLQEELMMLMPQEPDESELLGKEKQHLEMAKKLFLMVAGTGVQKYQQELEKEQELLAHIADMIIEIYAMESAILRTEKAVLKNGEAKEQQKLDYTRVYVQEALQRLEGIARESLAAMEEGDTLRTMLAIVKKLTRHNPINTIEIKRRIANRIIEAEKYVV

SEQ ID NO: 1690 - protein, 404 aa, Caldalkalibacillus thermarum
MMNFAFTEEQEMLRKMVRQFVDKEIMPYIKEWDEQGQFDPKILKRLGELNLMGVCIPEKYGGSGMDYNSLAIVCEELERGDTAFRTAVSVHTALNSMTLLQWGTEEQKQKYLVPQATGEKIGAFGLTEPNAGSDVKAMNSTAVRDGDYYILNGQKTWISLCDLADHFIVFAYTDKSKGHRGISAFIVERTMPGFSSKAIKGKLGIRAGNTGEIFFDNVKVPKENLLGEEGEGFKIAMSALDNGRFSVAAGACGLIMACLEASVQYCHERKTFGKEIGQHQLVKQMIANMEAKLQMARLLVYKAGWLKNQGIRNTRETSLAKWKACDFAFEAASDAVQIHGAYGYSNEYPVERYLRNAKAPVIYEGTREIHTLMQADYVLGYRKDKPLRKTLPAWPFEEETVKSH

SEQ ID NO: 1691 - protein, 584 aa, Caldalkalibacillus thermarum
METTGQRTGGEFLVSQVEADAVFTPEDLTEEQKMIVATAKDFVEGEVNPHSEEIENQDFELTVRLLRKAGELGLLAHSIPEAYGGLGLDKVTKGIVGEALGGSGSYGVAHSNHTCIATLPITYFGTEEQKRRYLPKLASGEYLGAYCLTEPSSGSDALGAKTTAVLNDAGTHYVLNGTKQWITNAGFADTFIVYAKVDGEKFTAFIVEKDFPGLSLGPEEKKMGIKGSSTRSVILENCPVPVENVLGEVGRGHLIAFTVLNLGRYNLGFACTGGAKKALEVAVKYTKERYQFKRPLSAFTATQEKLANMAIRIYASESLQYRTGGLLEEALGDLYEETDQNKVIEGLSEFAIECAICKVFGSETLDQVVDEALQLHGGYGFMQEYAVEQMYRDARIQRIFEGTNEINRLIVPGFLLRRSKKGKLDLQGAIEQAVQELHQPQLPVEGPLAQEQEMILSLRRLFLVGAGLALQTLGDKLQEEQEVLMKFSELAINLYAAESAVLRAKKAGGQGLKAELARACAEDVLLESELIARRLVCALTTAERQALYIKLFQREIGKYRFEQTLQRKREIASRVLDAEKYVTE

SEQ ID NO: 1692 - protein, 401 aa, Caldalkalibacillus thermarum
MYFEFSEKVKKLKKELQAFMEEVVYPNEQTYEEQLKQAGSRWQVPPVMEEMKAKAKAAGLWNLFLPDSEYGAGLTNLEYAPLCEIMGRSFIAPEVFNCSAPDTGNMEVLVRYGSEEQKRKWLEPLLKGEIRSCFSMTEPQVASSDATNMQARIERDRDEYVINGRKWWSSGAGDPRCKFAIVMGLSNPDAPKHERHSMIIVPLDTPGVKIKRMLPVFGYDHAPHGHAEIEFNNVRVPAENMIWGEGKGFAIAQGRLGPGRIHHCMRSIGAAERALELMCKRVLNRVAFGKPLAEQGVIREWIADSRIEIEQARLLTLKAAYMMDTVGNKVARKEISMIKVVAPNVALKVLDRAIQAFGAAGVSEDFPLAAHWANQRTLRLADGPDEVHRQAIAKLELKAYS

SEQ ID NO: 1693 - protein, 584 aa, Caldalkalibacillus thermarum; identical to SEQ ID NO: 1691

SEQ ID NO: 1694 - protein, 401 aa, Caldalkalibacillus thermarum; identical to SEQ ID NO: 1692

SEQ ID NO: 1695 - protein, 404 aa, Caldalkalibacillus thermarum; identical to SEQ ID NO: 1690

SEQ ID NO: 1696 - protein, 594 aa, Caldalkalibacillus thermarum; identical to SEQ ID NO: 1689

SEQ ID NO: 1697 - protein, 4150 aa, Streptomyces antibioticus
MHVPGEENGHSIAIVGIACRLPGSATPQEFWRLLADSADALDEPPAGRFPTGSLSSPPAPRGGFLDSIDTFDADFFNISPREAGVLDPQQRLALELGWEALEDAGIVPRHLRGTRTSVFMGAMWDDYAHLAHARGEAALTRHSLTGTHRGMIANRLSYALGLQGPSLTVDTGQSSSLAAVHMACESLARGESDLALVGGVNLVLDPAGTTGVERFGALSPDGRCYTFDSRANGYARGEGGVVVVLKPTHRALADGDTVYCEILGSALNNDGATEGLTVPSARAQADVLRQAWERARVAPTDVQYVELHGTGTPAGDPVEAEGLGTALGTARPAEAPLLVGSVKTNIGHLEGAAGIAGLLKTVLSIKNRHLPASLNFTSPNPRIDLDALRLRVHTAYGPWPSPDRPLVAGVSSFGMGGTNCHVVLSELRNAGGDGAGKGPYTGTEDRLGATEAEKRPDPATGNGPDPAQDTHRYPPLILSARSDAALRAQAERLRHHLEHSPGQRLRDTAYSLATRRQVFERHAVVTGHDREDLLNGLRDLENGLPAPQVLLGRTPTPEPGGLAFLFSGQGSQQPGMGKRLHQVFPGFRDALDEVCAELDTHLGRLLGPEAGPPLRDVMFAERGTAHSALLSETHYTQAALFALETALFRLLVQWGLKPDHLAGHSVGEIAAAHAAGILDLSDAAELVATRGALMRSLPGGGVMLSVQAPESEVAPLLLGREAHVGLAAVNGPDAVVVSGERGHVAAIEQILRDRGRKSRYLRVSHAFHSPLMEPVLEEFAEAVAGLTFRAPTTPLVSNLTGAPVDDRTMATPAYWVRHVREAVRFGDGIRALGKLGTGSFLEVGPDGVLTAMARACVTAAPEPGHRGEQGADADAHTALLLPALRRGRDEARSLTEAVARLHLHGVPMDWTSVLGGDVSRVPLPTYAFQRESHWLPSGEAHPRPADDTESGTGRTEASPPRPHDVLHLVRSHAAAVLGHSRAERIDPDRAFRDLGFDSLTALELRDRLDTALGLRLPSSVLFDHPSPGALARFLQGDDTRRPEPGKTNGTRATEPGPDPDDEPIAIVGMACRFPGGVTSPEDLWRLLAAGEDAVSGFPTDRGWNVTDSATRRGGFLYDAGEFDAAFFGISPREALVMDPQQRLLLETSWEALERAGVSPGSLRGSDTAVYIGATAQDYGPRLHESDDDSGGYVLTGNTASVASGRIAYSLGLEGPAVTVDTACSSSLVALHLAVQALRRGECSLALAGGATVMPSPGMFVEFSRQGGLSEDGRCKAFAATADGTGWAEGVGVLLVERLSDARRLGHRVLAVVRGSAVNQDGASNGLTAPNGPSQQRVIRAALADAGLVPADVDVVEAHGTGTRLGDPIEAQALLATYGQGRAGGRPVVLGSVKSNIGHTQAAAGVAGVMKMVLALGRGVVPKTLHVDEPSAHVDWSAGEVELAVEAVPWSRGGRVRRAGVSSFGISGTNAHVIVEEAPAEPEPEPERGPGSVVGVVPWVVSGRDAGALREQAARLAAHVSGVSAVDVGWSLVATRSVFEHRAVMVGSELDAMAESLAGFAAGGVVPGVVSGVAPAEGRRVVFVFPGQGSQWVGMAAGLLDACPVFAEAVAECAAVLDPLTGWSLVEVLRGGGEAVLGRVDVVQPALWAVMVSLARTWRYYGVEPAAVVGHSQGEIAAACVAGGLSLADGARVVVLRSRAIARIAGGGGMVSVSLPAGRVRTMLEEFDGRVSVAAVNGPSSTVVSGDVQALDELLAGCEREGVRARRVPVDYASHSAQMDQLRDDLLEALATIVPTSANVPFFSTVTADWLDTTALDAGYWFTNLRETVRFQEAVEGLVAQGMGAFVECSPHPVLVPGITETLDTFDADAVALSSLRRDEGGLDRFLTSLAEAFVQGVPVDWSRAFEGASPRTVDLPTYPFQRQRYWLLDKAAQRERERLEDWRYHVEWRPVTTRPSARLSGVWAVAIPARLARDSLLVGAIDALERGGARAVPVVVDERDHDRQALVEALRNGLGDDDLAGVLSLLALDEAPHGDHPDVPVGMAASLALVQAMADAAAEVPVWFATRGAVAALPGESPERPRQALLWGLGRVVALEQPQIWGGLVDLPQHLDEDAGRRLVDVVGGLADEDQLAVRASSVLARRLVRTPGHRMSSQAGGREWSPSGTVLVTGGTGALGAHVARWLAGKGAEHLVLISRRGADAAGAAALRDSLTDMGVRVTLAACDAADRHALETLLDSLRTDPAQLTAVIHAAGALDDGMTTVLTPEQMNNALRAKVTATVNLHELTRDLDLSAFVLFSSISATLGIPGQANYAPGNSFLDAFAEWRRAQGLVATSIAWGPWSGGTGMAHEGSVGERLQRHGVLAMEPAAAIAALDHTLASDETAVAVADIDWSRFFLAYTALRARPLIGEIPEARRMLESGSGPGDLEPDRAEPELAVRLAGLTAVEQERLLVQLVREQAAVVLGHSGAEAVAPDRAFKDLGFDSLTSVELRNRLNTATGLRLPVTAVFDYARPAALAGHLRSRLIDDDGDHGALPGVEKHAIDEPIAIVGMACRFPGGIASPEDLWDVLTAGEDVVSGLPQNRGWDLGRLYDPDPDRAGTSYMREGAFLHEAGEFDAAFFGISPREALAMDPQQRLLLETSWEALERAGITPSKLAGSPTGVFFGMSNQDYAAQAGDVPSELEGYLLTGSISSVASGRVAYTFGLEGPAVTVDTACSSSLVALHLAVQGLRRGECSLALVGGVTVMSSPVTLTTFSRQRGLSVDGRCKAFAASADGFGAAEGVGVLLVERLSDARRLGHRVLAVVRGSAVNQDGASNGLAAPNGPSQQRVIRAALADAGLAPADVDVVEAHGTGTRLGDPIEAQALLATYGQGRTSGRPVWLGSVKSNIGHTQAAAGVAGVMKMVLALGRGVVPKTLHVDEPSPHVDWSAGEVELAVEAVPWSRGGRVRRAGVSSFGISGTNAHVIVEEAPAEPSVEEGPGSVVGVVPWVVSGRDAGALRAQAARLAAHVSSTGAGVVDVGWSLVATRSVFEHRAVMVGTDLDSMAGSLAGFAAGGVVPGVVSGVAPAEGRRVVFVFPGQGSQWVGMAAGLLDACPVFAEAVAECAAVLDRLTGWSLVEVLRGGEAVLGRVDVVQPALWAVMVSLARTWRYYGVEPAAVVGHSQGEIAAACVAGGLSLADGARVVVLRSRAIARIAGGGGMVSVGLSAERVRTMLDTYGGRVSVAAVNGPSSTVVSGDAQALDELLAGCEREGVRARRVPVDYASHSAQMDQLRDELLEALADVTPQDSSVPFFSTVTADWLDTTALDAGYWFTNLRETVRFQEAVEGLVAQGMGAFVECSPHPVLVPGITETLDTFDADAVALSSLRRDEGGLDRFLTSLAEAFVQGVPVDWTHAFEGGRPRFVDLPTYAFQRQRYWLHEEPLQEPVDEAWDAEFWSVVERGDATAVSDLLSTDAEALHTVLPALSSWRRRRVEHRRLQDWRYRVEWKPFPAALDEVLGGGWLFVVPRGLADDGVVARVVAAVTARGGEVSVVELDPTRPDRRAYAEAVAGRGVSGVVSFLSWDDRRHSEHSVVPAGLAASLVLAQALVDLGRVGEGPRLWLVTRGAVVAGPSDAGVVIDPVQAQVWGFGRVLGLEHPELWGGLVDLPVGVDEEVCRRFVGVVASAGFEDQVAVRGSGVWVRRLVRAVVDGGGGGWRPRGTVLVTGGLGGLGAHTARWLVGGGADHVVLVSRRGGSAPGAGDLVRELEGLGGARVSVRACDVADRVALRALLSDLGEPVTAVFHAAGVPQSTPLAEISVQEAADVMAAKVAGAVNLGELVDPCGLEAFVLFSSNAGVWGSGGQAVYAAANAFLDALAVRRRGVGLPATSVAWGMWAGEGMASVGGAARELSRRGVRAMDPERAVAVMADAVGRGEAFVAVADVDWERFVTGFASARPRPLISDLPEVRAVVEGQVQGRGQGLGLVGEEESSGWLKRLSGLSRVRQEEELVELVRAQAAVVLGHGSAQDVPAERAFKELGFDSLTAVELRNGLAAATGIRLPATMAFDHPTATAIARFLQSELVGSDDPLTLMRSAIDQLETGLALLESDEEARSEITKRLNILLPRFGSGGSSRGREAGQDAGEHQDVEDATIDELFEVLDNELGNS

SEQ ID NO: 1698 - protein, 747 aa, Deinococcus proteolyticus
MNRPSSPFASFWMGGFECSTHRLRSGRRVDVIDATAHDRLAAQDYAALQSLGLSTVRDGLRWALIERRPGEYDFSSAEAQVQAAQESGVQVAWDLLHYGYPDFLDPYSPEFAPAFAAYARAAGEFLARHTTGPLWVCPVNEISFFAWAGGEVGDFAPFAHGRGHELKRQLAGAAIAAMRALREVLPQVRFLLAEPLITVHRDPQRPQEWADADGFHASQFEALDMLLGRLYPELGGSPDLVDALGMNYYPVNQWVHHPQHGRRRVLEPADPEYRPLHELLAEVHGRYGLPLLLTETGTEGPARAAWLRWVAYEALTARAQGVPVLGVCLYPVVNHPGWADDRHCPNGLLDYPGTADQAGGRAADPSLAAALREVQRWESGELPAQAPPPPSEPLTLGAVLDRLALAAPTILAEAPLRHADGGFPAESFAALRRHGLLRAGLPGGLGYSLRGPELLELLRAVGRLSLPVARLYEGHLNALGLLERYGTARQLAEAAASGAVLGVWNTEEGAGLRAQRTPDGWQLEGNKTFTSGAQFVRPLLPAETEEGRLMLLAPAPLPPERFDHAFWQPLGMRASVSARAELSGLSLPPGSEVGVGGDYYQQPDFSGGALRFLAAQLGGAEAVLAAARGVLARLGRHEDDVQRLRFAEAAAGVEAAWQTVLEGERWLARQGAGALDYVALCRVVAEDACLRACEAAERAVGARGLLAPHDPERLIRDLRHYLRQPAPDAARLQVGAATLAEGFGGWS

SEQ ID NO: 1699 - protein, 640 aa, Saccharomonospora glauca
MELLTEALTRLLDGRWASVRRDVREHLAAQAVRGALDTAGLDVAAHRELIARQLRALAETGRPRLGFPTEYGGGGDIGAAVVSFEMLGFGDLSLMVKSGVQWGLFGGAVHLLGTRYHHERYLPDIMSGALLGCFAMTEVGHGSDVQHLRTTATYDPGTAEFVVHTPDAAASKTYIGNAARDGRMAVVFAQLVTGGESRGVHALLVPIRDEHGAVLPGVTVEDCGVKAGLNGVDNGSITFDHVRVPRSALLNRYGDVAEDGTYTSPIDSDGKRFFTMLGTLVRGRVSVAGSAGSATKRALTIAVHYADRRKQFEGRDGAEATILDYLAHQRRLLPALATTYALHFAQEDLVAELHDLQTGTPEDVAEADEIRQRELESRAAGMKALATWHATHTIQAAREACGGAGYMAENVLPSLKADTDVFTTFEGDNTVLLQLVAKGLLTNYRLQFEDLSPLATARFVAEQFVGAVIERTAARRVVERIVDASPARDDDDVVFDRAWQCKLFTDRETHVLDGLARRLRAATRDNAFDVFNAAQDHVLRAARVHVERLVLDSFVAAVERCEDAEARALLDKVCDLYALSVVEADRAWFMEHGRLTSGRAKAVIAGVNRLCGELRPHARTLVDAFALPEPLWRVPMLDWT

SEQ ID NO: 1700 - protein, 640 aa, Saccharomonospora glauca; identical to SEQ ID NO: 1699

SEQ ID NO: 1701 - protein, 640 aa, Saccharomonospora azurea
MEPLTEELTRLLDGRWASVRRDIREHLAAEAEKGAFDTETLDAAAHRERIGEQLRALAKTGRPRLGFPTEYGGDGDIGAAVVSFEMLGFGDLSLMVKSGVQWGLFGGAIHLLGTRHHHERYLSDIMSGELLGCFAMTEIGHGSDVQNLRTTATYDPDTAEFVVHTPDRSATKTYIGNAARDGRLAVVFAQLVTGGESRGVHAVLVPIRDEHGTVLPGVTIEDNGVKAGLNGVDNGRITFDHVRVPRTALLNRYGDVTEDGTYTSPVDSDGKRFFTMLGTLVRGRISVAGSAGNATKRALAIAVHYADRRRQFAGRDGAEVTLLDYLAHQRRLLPALATTYALHFAQEDLVAELHDLQTGTPEDVAEADEIRQRELESSAAGLKALATWHATSTIQAAREACGGAGYMAENVLPSLKADTDVFTTFEGDNTVLLQLVAKGLLTHYRSQFQDLSPLATARFVAEQFVGAVIERTAARRVVERIVDASPARDDDDAVFDRAWQLKLFTDRESHVLDGLARRLRAAGRDNAFDVFNAAQDHVLRAARVHVERVVLDSFVAAVDRCENAEVKALLDKVCDLHVLATIEADRAWFLEHGRLTSGRAKAVVAGVNRLCGELRPHARTLVDAFAVPERLWRVPMLDWV

SEQ ID NO: 1702 - protein, 402 aa, Sphingobium chlorophenolicum
MDLRFTPEEEAFRAEVRQFLKEKLPSRISGKVRTGKRLTKQDAEEWHAILHERGWLATHWPKEYGGTGWSVAQAHIFDVETALAHAPRLVPFGLSMLGPVLIKYGSEAQKRHYLPRILDGTDWWCQGYSEPGAGSDLASLKTSAVRGTDADGDHYIVNGQKTWTTLGQYADMIFCLVRTSTEGKKQEGISFLLIDMKTPGVEVRPIILLDGEHEVNEVFFTDVRVPAENLVGEENKGWTYAKYLLTYERTNIAGVGASMAAFAHLKQIAQSQRKNGRPLAEDPLFAARLARVEIDLENMKTTNLRVLASAGEGMAAMELTAMLKIRGTEIRQEITSLARRALGPYAQPFVSEALDEGFNGEPIGPEYAAPASAHYFNNRKLSIYGGSNEVQREIITKALLEL

SEQ ID NO: 1703 - protein, 456 aa, Agrobacterium sp.
MAATSCRLSAKAFANGKMRRKRPLHNAAIQPGRLTGHFFEVQTEPIAPDGEMVFPTAREPRPRMSHDPTVLDATARILEQAAPDADQTGQFPWTGIRAVHESGLLESTVATRYGGQGATLADTAHILAALGRGDPSVALISAMTIFTHLAQAAKNHWPEDLYRRLLMDAKQQPLLLNAARVEPELGSPARGGLPATLARRTNNGWSITGRKRFVTGAYGLTHFLVWAHTDETPARVGTFVVPNGLPGIKVIENWQSLGMRATGSHDVEYANVEIPAENVIDLVDPSVAQQDNRAHAALTLALTALYLGVAEAAQAKFIRFAHERVPANLGHPIARTERFITLSGEIDLLVSGARQIIFGTLENNNGDAEGFIRARLLAGRQLRDAVEIAVHGIGNPGLGSELGLERHFRDIQTVLVHAPQEDTSIAILGRSAFGRWSREETAAAQPSAGLQILKSA

SEQ ID NO: 1704 - protein, 643 aa, Saccharomonospora xinjiangensis
MESLTVSSAALTRLLDGRWAAVRRDVREHLAAQAAHGALDTARLDVAAHRERIARQIEALAETGGPRLGFPTEYGGGGDIGAAVVSFEMLGFGDLSLMVKAGVQWGLFGGGIHLLGTRRHHEQYLPDIMSGALPGCFAMTEVGHGSDVQRLRTTATYDPRTAEFVVHTPDSAAAKTYIGNAARDGRLAVVFAQLVTGGRSRGVHALLVPIRDENGTVLPGVTVEDSGVKAGLNGVDNGRLTFDQVRVPRAALLNRYGDVTEDGTYTSPIDSDNKRFFTMLGTLVRGRISVAGSAGSATKRALAIAVNYADRRKQFEGPDGDEITVLDYLTHQRRLLPALATTYALHFAQEDLVAELHDLQGGTPEDVANADEIRQRELESRAAGLKAVATWHATHTIQAAREACGGAGYMAENVLPSLKADTDVFTTFEGDNTVLLQLVAKGLLTNYRLQFQDLSPLATARFVAEQFVGAVIERTAARKVVERIVDASPVRDDDDAVFDRAWQCKLFTDRESHVLDGLARRLRAAGRDNAFEVFNAAGDHVLRAARVHVDRLVLDSFVAAVERCDDDEARALLNKVCDLHVLSTIEADRGWFLEHGRLTSGRAKAVVAGVNRLCGELRPHARTLVDAFAVPEALVQVPMLDWT

SEQ ID NO: 1705 - protein, 643 aa, Saccharomonospora xinjiangensis; identical to SEQ ID NO: 1704

SEQ ID NO: 1706 - protein, 640 aa, Saccharomonospora azurea; identical to SEQ ID NO: 1701

SEQ ID NO: 1707 - protein, 637 aa, Saccharomonospora viridis
MDTLTAELTRILDGRWAQVRRDVRKYLEVEAERGSFDTTHLGVDAHRERVTRQLRTLAETEQPRLGFPTEYGGGGDICAAVVSSETLGFGDLSLMVKSGVQWGLFGGAVHLLGTSWHHDRYLPDIMSGSLLGCFAMTEVGHGSDVQSLRTTATYDPDTAEFVVHSPDVLAHKTYIGNAARDGRLAVVFAQLVTGGATHGVHALLVPIRDERGSVLPGVTIEDNGPKAGLNGVDNGRLAFDHVRVPRTALLNRYGDVAEDGTYSSPIDSDGKRFFTMLGTLVRGRISIAGSAGSATKRALTIAVRYAERRRQFAAPDGTEVALLDYLSHQRRLLPALATTYALHFAQEDLVARLEELQGDEAAGGDDRAQRELESRAAGLKAIATWHATSTIQTAREACGGAGYMAENVLPSLKADTDVFTTFEGDNTVLLQLVAKGLLTNYKHQFEDLSPLATVRFVAEQFVGAVMERTAARRVVERLVDASPAREDDAAVFDRAWQCKLFADREQHVLEGLARRLRAAARDDAFEVFNAAHDHVLRCARVHIERVVLDSFVAAVARCDDEQAKALLDKVCDLYVLSTIEADRAWFLEHGRLTSARAKSVIAGVNRLCRELRPHARTLVDAFAIPEPLVRVPMLDWT

SEQ ID NO: 1708 - protein, 604 aa, Desulfosporosinus acidiphilus
MASNFIYSNRDHKFIFKEWLDCKKILGLKRFRDYLSIEDVDGILDQSLKVCRDVVAPTNDDGDTIGARFHDGKVTVPPSFHKAFRFLHDNGWGASNNDVDGEGALPEILNQAVREYIIGANPSMSPYIGLSGGIASVIKAFGSQEQIALYTPKMFEGVWEGTMCLTEPGGGSDVGDMTSKAYPTDDPLIYKVKGTKCFITGGDHDLTENIIHLVLARIDGAAPGTKGLSLFIVPKIWVNEDGSLGESNDVATVGIEHKMGLKGSATAVLSFGEEGYCRGVLLGSAPDENGVGQGMAQMFKMINGSRMDTGHSALAVATVAYNNAVNYARERIQGRPITNPKGNRVPIIQHEDVRRMLITQKATLEAMRAMIFKGYYYIDLIEHGDDPEDIHSAKRSLEVITPLVKAYCSDQGWLMITEAIQVLGGYGYTEEYPIARQARDVKIYSIWEGTNFIQSMDLVGRKWNLDKGNVFREWMMELAAFVQANQNHDTFAREFAVLGKALLAYQDLVSTVLGYYKENIRLVPLYSTRILRITAELYGGCLLMQQALVAKEKLAQGNIDQDFYNGKIQSAKFFVLNIVPDVAATVRIIKEADTSAMDIPEAAF

SEQ ID NO: 1709 - protein, 602 aa, Lacinutrix sp.
MADTEKDILRGGQFLVKETKCEDVFTPEDFSEEQNMMKESVMEFNEREIIAHKPRFEAKDYALTEEVMRKAGEMGFLGVAVPEAYGGLGMGFVSTCLTCDYISSGTGSFSTAFGAHTGIGTMPITLYGTEAQKQKYVPKLASGEWFGAYCLTEPGAGSDANSGKTTAELTEDGKSYKINGQKMWISNAGFCSVMIVFARIEDDKNITGFIVEYDPENANGITLGEEEHKLGIRASSTRQVFFNDTKVPVENMLAGRGEGFKIAMNALNVGRIKLAAACLDSQRRILTTGVQYANERKQFKTPISDFGAIKVKLAEMATNAYAGESATYRAAKNIEDRIAMREAAGNTHQEAELKGVEEYAIECSILKVAVSEDVQSCADEGIQIFGGMGFSEETPMEAAWRDARIARIYEGTNEINRMLSVGMLVKKAMKGHVDLLNPAQAVQQELMGIPSFDTPDYSELFSEEKAMIAKLKKVFLMVAGAAVQKFGPDLEEHQQLLIAAADILIEIYMAESTILRTEKNAKRTSEKEQAVQIAMSKLYLYNAVSIVEGKGKESIISFAEGDEQRMMLMGLKRFTKYTNYPDIVDLRNEIAEKVKAENKYCF

SEQ ID NO: 1710 - protein, 401 aa, Acidovorax avenae
MDLAFTPEEQAFREEIRAWVREHLPAETAHKVHNALRLTRDDLQGWAKILGKKGWLGFGWPKQFGGPGWTAVQKHLFEEECALAGAPRIVPFGPVMVAPVIMAFGSPEQQQRFLPGIASGEVWWSQGYSEPGSGSDLASLKTRAERRGDKYIVNGQKTWTTLGQYGDWMFNLVRTSTEGKPQTGISFLLLDMKSPGVTVRPIKLLDGECEVNEVFFDNVEVPAENLIGEENKGWTYAKHLLSHERTNIADVNRSKRELERLKRIARTEGLWDDLRFRDQMALLEVDIVALEMLVLRVLSAEKSGKNSLDIAGLLKIKGSEIQQRYAELMMLAAGPYSLPFIEEAMEAGWQGDAAMGALGGFPGGTVANAPLASTYFNLRKTTIYGGSNEVQRNIVAQTVLG

SEQ ID NO: 1711 - protein, 653 aa, Mycobacterium gilvum
MTTTAEHLRNSLDGRFRDVKNRVRRELSDDVFRPHYTPNTVIARTKVAEQMKIMAARGAAEDGFKKEHGGNGDVGAAVTQIEMLAMSDLSLMVKAGVQWGLFGGAIENLGTERHHAAYVKKLINLEVLGCFAMTETGHGSDVQSLETTATYDPATQEFVIDSPTPSSRKDYIGGAAETARVAAVFAQLITPDGVKHGVHCFVVPIRDEQGEDLPGVTTSDCHYKGGLPGVDNGRIQFDEVRIPRENLLNKYADVAEDGTYSSPIENPNRRFFTMLGTLIRGRVTVGGSAGAAARVALDIATRYALQRRQFEDPDGGEVLLMDYLVHQRRLFPLIARSYALQYAQNELVARCHELQTADDPDPEDQRELESRAAGLKAANTWHATRAIQEAREACGGAGYLAENRLIALKADTDVFTTFEGDNHVLFQLVAKELLTAYADDIKGMSPVDWVRFAANFAGERVLKRTAAQTIMQTILDTREDNEEEGSLFNRGTQVQMFEDREQYMLSSVARRIQSKSKEMGAFDAFNSVQDHVLHTAQAHIDRIILEAFVAGIDSCQDRQAREILGMVCDLYALSVIEEDKAWFVEHRFLSTERAKAVTRGINDRCRRLRPYAELLVDGFGIPENLRYAEMLHPENIPDADEHTSQDATSAGVI

SEQ ID NO: 1712 - protein, 603 aa, Halomonas elongata
MPDYQAPLRDLRFVMDEMLDYPTHYAGLPGGEEATPDVVGAILEEGARFAREELLPLNQSGDLEGCLLEGGEVKTPKGFKEAYSRYVEGGWPGLAADPEQGGQGLPPSLAMVLSEMICATNLAWGMYPGLSHGAADALRHHGTEAQQATYLSKLVEGVWTGTMCLTEPHCGTDLGLIKTRAVPNDDDSYTLSGTKIFISAGDHDLAENIVHLVLAKLPDAPAGSKGISLFVVPKFLPDADGNPGERNGVSCGSLEHKMGIHGNATCVMNFDGARGFLVGKPHKGLACMFTMMNAARIGVGIQGLGLTEASFQNALAYARDRLQMRALSGAKAEDKPADPIIVHPDVRRMLLTQKAFAEGGRMLVLYAAQMVDVVERSDDTEQTERAETLLGLLTPIVKAFLTEVGFEATNEGVQVFGGHGFIQEWGMEQLVRDARITRLYEGTTGIQALDLLGRKVLMSQGETLKIFTKEIHKFCQAEEGNPDMAEFVRPLAKLNAEWGELTMGVGMKAMNDREEVGAASVDYLMYSGYVTLAYLFARAVKQAKSALAAGTDDAAFYRAKVNTARFYYERLLPRTRAHVQMIQAGGESLMALSPDDFGRGFEI

SEQ ID NO: 1713 - protein, 603 aa, Halomonas elongata; identical to SEQ ID NO: 1712

SEQ ID NO: 1714 - protein, 604 aa, Desulfosporosinus acidiphilus; identical to SEQ ID NO: 1708

SEQ ID NO: 1715 - protein, 464 aa, Streptomyces violaceusniger
MDAAFTEEQDEIRRTLRTLLRERCGPDEVKAAVQAAAGYDEALWQQLARTLGLPGLALPSAYGGVGCGVTELALACEETGRVLLPSPLLATAVFAAPLVAAVGTEVQRAELLPRIAEGALTAALAVPGRALPEALGLVGARDGAWAGGGRAGGVQARPDSGGGAGWRLYGQVEQVLGGHSAELLLVAARAGGYTRGRTLLFLVPAEADGLVRTRLTALDATRPQARIELRNVPAELLGVDDGGSGDGVAEALAAVGAAAAAVLAAEAVGAADAALARTVGYVRAREQFGRPIGSFQAVKHRLADVYVAVQAARSAAYYAAWAAAQSGAEGTGAAQGGAEGAEAAVAGGLALAQALEAQRMAAAEAVQLHGGIGFTWEHEAHLYFKRAASDELLFGPVHRLRAQAAEREGLFGAADRAPYGGHGGRGGNDGYGGHGRHDGPDRHDGPNGRDGRDGHDGPRKVVTV

SEQ ID NO: 1716 - protein, 512 aa, Frankia symbiont
MSVTPSIAPSRQSRRELLAELAVEFAATAAEHDRSGTFPVANLDRLHRAGLIGLTVPAAYGGAEADLSEVVEVLGTIARGDPSTALVLAMTYIIHASCGRFEPWPAQVYGLIARSAVEEGALANGLRVEPDLGTPARGGIPATTARWTGDGWELSGHKIYSTGAPVLRWMLVWGATDPASDPAAELAGDPVDGAAGDPVLDAASHGRPEPASARPRPREPRIGTFLVPADAPGIEIVRTWDHFGMCATESHDVIFNRVRLDAAAGIGLTPASKLRDPGAVDSTVASGLAAWGGLTIASIYLGVAEAARDWLIGFLHERVPSNLGRPLASLPRFQAAVGEIDVGPTAGRGDHARGRRRESPPHIPWQRREVGGHERRDRRGGQGGRPDRQSRPDPHESPGAPLPERPLRTGAHPPGRRRPRRRRPRPPVLLTPRCRLPGPSTPSRRAPSACKITASLSLCTLFRPKTVYSSKIVWIMTCVAAPGRGPCAADRVRGRRTGVSCRGDPARVASYG

SEQ ID NO: 1717 - protein, 640 aa, Caenorhabditis remanei
MHRINHVVRMASSSSTNATIAARHTQYSHAKTGGFSQEAPTLHNPYRDDPILDRVLRRLLPESQYVKVSADLTKFGDRITSEIEHLGRQAELEQPRLEHQDAWGKRIDKLVVCNEWQKLKQICAEEGVISIGYENDVDPFVRRIHQVAKLFLFSPSAGLVSCPMAMTDGAVKTLTVGILYSLNLYGKHKLATEAVDRLRSRDPTSAWTSGQWMTEKKGGSDVAGGCDTYAVQIENDTYRLNGYKWFSSAIDADVALTLARIVDSDGNAVEGSRGLSLFLLRIRDDNGNLNGIQMVRLKNKLGTKQLPTAELLLDGAIAERIGEPGRGVAGISNMLNITRIHNAVASLGYMRRFPALFSFLFKCSFSRIISLARDYSTKRVVFGQTQVKYSKWPLHTTTLAKMEVETRGSMLLLFESARLLGLSEAGKSSDVDAMMLRLITPVLKLYAGKQAVPLVSEGIECFGGQGYMEDTGLPTILRDAQVTPIWEGTTNVLSLDVLRVFSGKENILLAFGKRVSQLLSNTKSEEPRLQKSKESIESALKELQKLLVKASDSAVQGETRIDTVARHISFAIARIYSGALLIDHASDSTVANQSDIEVAYRYCCEQPLIDLRWEWFANERVKSDRAIVFDNYLGLQKSKI

SEQ ID NO: 1718 - protein, 424 aa, Spirosoma linguale
METIFTTERVRPLLAQVRQFVETELIPLEDGFSHQNIRAILPILDQKRQQVKDAGLWGLHLSVAEGGHGLTLCEFGQISEALAHAPFFGHYVFGCQAPDIGNTELLHKFASAELKERYLKPLMSGEIRSCFSMTEPEFAGSNPTRMATLAVREGDEYVINGRKWFTSSADGAAFAVVMAVTNPDAAPHQRASMIIVPTDTPGFNIERNIPVFGEAGEGWFSHAEVTYSNCRVPVANVIAGEGMGFRLAQERLGPGRVHHCMRWIGNAEKALDLLCKRAATREIEDGVMLGEKQFIQDFIAQSRAEIDASRLYVLNTAHMIDTVGVSNVRDAVSAIKFYVANAFLRVLDRAIQVHGALGVTDDTVLSAMYRHERGARIWDGADEVHKQNLAINILKTYGLDIKKKARELRQFRQLMEAERMMNAE

SEQ ID NO: 1719 - protein, 424 aa, Spirosoma linguale; identical to SEQ ID NO: 1718

SEQ ID NO: 1720 - protein, 562 aa, Methylobacterium extorquens
MAASPAVQPANDPTDFVALAKDAAAGAKALVAEATARVKARVTGPEGKLDAGALEREQHAAHGLSWLATYGEAVRELADYAERLQGEGSFGETEALLVKIGVGEYLDQMFGGIPMSQGEMVRPTALGFTAAELAGLRTPAIDAMVAEGNTPANRAALVAKIREATSAGAATIGASGLDEDMEAIRSEMRRFGKAEVVEQAHEWHLKNAYIPMSIIEKMAELGVFGLTIPEEYGGMGMPKAAMCVVSEELSRAYIGVGSLGTRSEIAAELILCGGTEEQKQRFLPGIASGDILPTAVFTEPNTGSDLASLRTKAVKDGDHWKISGNKTWITHPVRADIMTVLVRTKPEEKGHRGLSMLIAEKPRGTDEQPFPVEGLSGGEIEVLGYRGMKEYELSFEDFAVPANNLLGEIEGKGFAQLMQTFESARIQTAARAIGVAQSALDIGLRYAEERVQFGKALVEFPRVADKLAMMAVEINIARQLTYFSAREKDEGKRCDLEAGMAKLLGARVAWAAADNALQIHGGNGFALEYKISRVLCDARILSIFEGAAEIQAQVIARRLLEQ

SEQ ID NO: 1721 - protein, 641 aa, Saccharomonospora cyanea
MESLTEVLTRLLDGRWAAVRRDVREHLAAQAARGALDTAGLDVAAHRERVARQLQALAETGGPRLGFPREYGGHGDIGAAVVSFEMLGFGDLSLMVKAGVQWGLFGGAVHLLGTRYHHERYLPDIMSGALLGCFAMTEVGHGSDVQHLRTTATYEKDTAEFVVHTPDEAASKTYIGNAARDGRVAVVFAQLVTGGESRGVHALLVPIRDEHGAVLPGVTVEDSGVKAGLNGVDNGRLTFDHVRVPRTALLNRYGDVAEDGTYTSRIDSDGKRFFTMLGTLVRGRISIAGSAASATKRALTIAVHYGDRRRQFQNPAGAEIPVLDYLTHQRRLLPALATTYALHFAQEDLVGELHDLQGGGVPEDVAEVDDVRQRELESLAAGMKALATWHATRAIQAAREACGGAAYMAENVLPSLKADTDVFTTFEGDNTVLLQLVAKGLLTNYRLQFEDLSPLATARFVAEQFVGAVIERTAARRVVERLVDASPARDDDAAVFDRAWQCKLFTDRESHVLDGLARRLRAATRDNAFEVFNSAGDHVLRAARAHVERLVLDSFVAAIDRCEDDRARELLNKVCDLHVLSTIEADRAWFLEHGRLTSGRAKAVVAGVNRLCGELRPHARTLVDAFAVPEPLWRVPMLDWT

SEQ ID NO: 1722 - protein, 641 aa, Saccharomonospora cyanea; identical to SEQ ID NO: 1721

SEQ ID NO: 1723 - protein, 415 aa, Rhodothermus marinus
MGSFPFNPDDAFLFESMLKEEDRLIMETAREYAQSCLEPRALEGNQQGIFHMEIPREMGELGLLGVTIDPKYGGGGASYTAYGLIARELERVDSAYRSFMSVQSSLVMFPIEKYGTEEQKRKYLPKLATGELIGCFGLTEPDHGSDPGSMETTARRVDGGWILNGTKAWITNAPIADIAVVWARAKEHPDDEGEIMGFILERDMPGLSTPETKNKMSLRASSTGEIVMEDVFVPDANVLPGVRGLRGPFSCLSNARYGIAWGTVGAAEDCYQRTRRYVMERTQFGYPLAAMQLIQTKLANMLTEITQMQLLALRLGQLADEGRVTPAQISLAKRNNAGKALEIARMARDMHGANGIVGDYRVIHHMVNLESVNTYEGTYDIHGLILGREITGIQAFVPRGNDLSPKKKPAPATAS

SEQ ID NO: 1724 - protein, 512 aa, Frankia symbiont; identical to SEQ ID NO: 1716

SEQ ID NO: 1725 - protein, 602 aa, Lacinutrix sp.; identical to SEQ ID NO: 1709

SEQ ID NO: 1726 - protein, 402 aa, Sphingobium chlorophenolicum; identical to SEQ ID NO: 1702

SEQ ID NO: 1727 - protein, 653 aa, Mycobacterium gilvum; identical to SEQ ID NO: 1711

SEQ ID NO: 1728 - protein, 456 aa, Agrobacterium sp.; identical to SEQ ID NO: 1703

SEQ ID NO: 1729 - protein, 464 aa, Streptomyces violaceusniger; identical to SEQ ID NO: 1715

SEQ ID NO: 1730 - protein, 446 aa, Frankia sp.
MTDEAAGDVRTNDVTGGAGTGGAGTGAVGTGGVIGLDEFRAEVRAWLAANLRRRPVGVQDGGEARTDGQVAAARPLQRKLFDAGYAGISFPREYGGRGLGAEHERVFREESRDFVTPHFGGAGHVTFTAIARSMLAHASPEFLSRHIPPILAGERLWCQFYSEPEAGSDLAGIRTTARREGDRWVLNGSKIWSTGAHQADYAMCLARTDWDVPKHRGLTWFAVPTDATGVTVRPIRQINGASGFCEAFLDDVVVSDEDVIGEINQGWSVAQTMLVHERGAGSFGPARAEPRDLAPDLVELARRAGRIEDPVARQAIARAHINDFAQYHLGLRIGAQLRGSAAPQPAVAAYGKLAAGVLSPIRARITVEVGGAEALLWPQGADESATAPATTYLNGRMVSIAAGTNEVQRNGIGERVLGLPREPSFDARKPFRDVVRDARTWDGRIG

SEQ ID NO: 1731 - protein, 420 aa, Frankia sp.
MTDTPEIEEYRERARQWLAANLEPRHPGQGAHGRGGTQQNDEGFQAERALQKKLYEAGYAGINWPSEHGGQGLSDRHARAFAEEAARYRMPDLGHAGGTTYGPCGQTIVRHGSPEFLARHVPRMLAGDELFVQLFSEPSAGSDMAGITTRAVRDGDRWLITGSKIWTSGAHQADYGMCLARTDWDAPKHRGLTWFAVPLRAKGVTIRPIREITGDAEFCEEFLDEVEVGDDAVIGEVNQGWTVAQTLLLVERGAGRDDPVNLPTTQAADVDPFLLDVIRAAGRAQDPVARQALARIHTADWAKGQLGQRITGLLRSSEKPAAGVASYWKLAAGVYNPERARLVLEIGQGLGLAWKDGDEEGQHAALDYLNSRVWSIAGGSNEMQRNAISEQVLGMPREPSFDRGKPFREVVNSAREWFRS

SEQ ID NO: 1732 - protein, 470 aa, Frankia sp.
MSVTTPDAAGTPDAVLPKGAADAKGPVGPNGRLLLAADATPEEARAKVREWVEANVPVTWREAAAAGGRAAIRKVRSRADYERWYPVFGVSGLVAARWAPEYGGLGLSSGAARAADEELRPYNLGRLNPLGLANAATALFAHGTEEQKRRFLPPIVRNEEVWCQLFSEPGAGSDLASLATRAVREGDNWIVTGQKVWTTWGFLADYGVLLARTDPDVPKRGGITYFLIDMHQPGVEVRSLRHVTGEVDFCEVFLDDAVVPDSQRLGAVGDGWRVGNSTLSGERQMVSGSGSGGVDRIGGSGALHLVKLAKEVSAAGRPGGWDEPTVRQEIAHLYSEERIRAWNNERIRARLAAGLAPGPESSIGKVHQGDLNQRTQALAADLLGAYGAAWESDFIPGTEHAGADGAPLEPAEVYAESLPHEVKGMLRSRANTIEGGTSEVNKNILAERVLGLPREPDPHRGKAWKDVPRS

SEQ ID NO: 1733 - protein, 402 aa, Frankia sp.
MRLRDSESDARFRKEVRAWLAENLPVLGPPPAYGDWTAKKAYDQRWQRMLFDAGYAGIDWPAAYGGRGVTASEQLIFLAESAAAGAPDLGVHFVGQLHAGPTLIAEATDEQRAFHLPRILRGESIWCQGFSEPGAGSDLASLRTRAVRDGDHYVVTGSKIWTSYGFAADYCELLVRTDPDAGKHRGISWLIMPMDLPGIDVRPLRTIQGESEFAEMFLDEVRIPVENLVGRENDGWRVAMVTFSFERGTSLVRELLTAMTMVEELATLAKTLGHGPGRTAWDDDAIRREIGQVAAELDAMWALTRRNVTRAAGGGGVPPAGGSAFKLTYSEAIHHFGEVAMKVLERYAISLDALPLGDGTDLPVGRHIIEHLHAFAISIGAGTSQIQKNIIAERVLGLPRER

SEQ ID NO: 1734 - protein, 401 aa, Frankia sp.
MNATLADLAELRVAVRDWCRAHVPADWRGAQTGVGDDEFVAFQQAWFQELRRAGYAVPHWPAEWGGGMSAAEQMVLYQELAAADAPRLVLAFVSIHHAAATLLTAGTDEQRRRHLPGILDGEIWVQGFSEPEAGSDLASLRTTARRDRRSDGDVFVVNGQKLWASGAAHADWCLLLARSDPAAPKRRGISYLLMDMRSPGLDVRPIRNALGDSHFCEIFLNDVEIPAENLVGPENSGWQVAQATLSAERGMTMLELAERLGNVGLRSLVDTCRRPDTAGHRPIDDTLVADRLAAFDTEIAGLRALCRDLVERHDAGTVGPADASVVKVYYSELLQRMTGFGAQIAGLGALTELAKPASSGWESGRWLLDFIGSWEWTIPGGTNEIQRTIIGERGLGLPREP

SEQ ID NO: 1735 - protein, 409 aa, Frankia sp.
MDLRYPPDVEAFRAEVRAILAEELPAGFAGLGAIEDRTAAEEFVESWRATLYRRGLLGVTWPVEYGGRDLSRLHQVALVEELARAGVPYGAPYDTYAIKMLGSTLLRFGTPAQKERFLPLILSGEEHWCQGYSEPEAGSDLASLRTRARLEGGEWVIDGQKIWTSHAFDADWIFVLARSDPAAARNRGISFLLVPIDQPGIEIRRIRQMTGESDFCEVFFTEARTAAENVVGAPGEGWKVATALLGHERGEEAATNPILFRSELDRLIRLARQDGKAGDPVVRQRLADAVVRVEVMRHLGYRILTGLAGGGELAATASVAKLYWSEYHQRVTELAEDVLGPRGQVLQGRPPLRAYRADDPGVPASSTASWAGAWMAARSGTIYAGASEIQRNIISETVLGLPREPRPAA

SEQ ID NO: 1736 - protein, 409 aa, Frankia sp.; identical to SEQ ID NO: 1735

SEQ ID NO: 1737 - protein, 401 aa, Frankia sp.; identical to SEQ ID NO: 1734

SEQ ID NO: 1738 - protein, 420 aa, Frankia sp.; identical to SEQ ID NO: 1731

SEQ ID NO: 1739 - protein, 470 aa, Frankia sp.; identical to SEQ ID NO: 1732

SEQ ID NO: 1740 - protein, 402 aa, Frankia sp.; identical to SEQ ID NO: 1733

SEQ ID NO: 1741 - protein, 446 aa, Frankia sp.; identical to SEQ ID NO: 1730

SEQ ID NO: 1742 - protein, 584 aa, Desulfosporosinus meridiei
MSNLPKGGSFLFSQTNPQDIFTPEDFSLEHKMIYRTAAGFVTDKVLTQMDELEAKKEGLIRELLEAAGELGLNGADISDEYGGMEMDKISTTIIAECMGRSGSFAMTQGGQTGIGSMPIVMFGTHEQKKKYLPGIASGKKVGAYALTEPGAGSDALSAKTRAELSSDGKYYVLNGTKQFITNSAMGDIFIVYAKIDGDKFTAFIVDGNSEGLTTGAEEKKMGIKGSSTRSVILEDVKVPAQNLLYEIGKGHVVAFNILNLGRYKLAANSVGNAKYALELAATYANERKQFGTPIAEFGLIKEKLATMAIKIYVTESMVYRTGGLLENMMNSLDTSGEDGGQVAAKGIEEYALECSMNKVFATEALAYAVDEGVQIHGGYGFSAEYTIERLYRDARIYRIFEGTNEINRTIIPVTLMRREAKGDLPLIEQITKLHEKIAGGNILREGEEGLVQAAKDIFLLTMGAGIQKYGKNLPKHQEIIGSLADLAIQAFAMESAWLRAQKAVVNQGEANARLKLNMAMAYINSTIGILEYTARETLTALAEGEQLTYLLENLKKITHFSIRNTVALRQEIAFAISKVGKYIV

SEQ ID NO: 1743 - protein, 759 aa, Shewanella baltica
MLTIIILALIAIVVLFAVKNIRMQFITRPVFSFFKKVLPPLSDTEREAMEAGDVWWEGELFRGNPNWNTLHSYGKPTLSAEEKDFIDNQVMTALTMIDDFDIVHNRKDLPPELWEYFKKEGFFALIIPKKFGGKAFSAYANSTIVSKLASRSVSAAVTVMVPNSLGPGELLTHYGTSEQKERWLPALAKGDEIPCFALTGPEAGSDAGAIPDVGIVCRDTFNGEEMLGLKLTWDKRYITLAPVATVLGLAFQMRDPEGLLGDKKNLGITCALIPTDHPGVVIGRRHNPLGMAFMNGTTQGKEVFIPLDWIIGGPEFAGKGWRMLVECLSAGRGISLPALATASGHMATKTTTAYSYVRHQFGMAIGQFEGVQEALARIIANTYQLEAARRLTTTGIDLKVKPSVVTAIAKYHMTELGRSVMNDAMDIQSGKGIQLGPKNYLGHPYMSNPISITVEGANILTRSLMIFGQGATRCHPYVLAEMEAAAMENQHEALERFDALLMGHMGYATRNAFSALFSALSGSRFGSAPVSGETKQYYKDMSRISSALALMTDLSMLIMGGDLKRKEMLSARMGDVLSQLYLGSATLKLFEDNGRQQDDLPAVRYVMANRLHLAAKALEDTIRNFPSRPVAWLLRGLIFPLGNHFNAPSDKMATDLVGGMLKPGPARDRITFLCPEFEGDKGGIAEVEQAFIAQYACKDIYKKLKKAQRAGELPAKVPNLVLFAKALETGVITADEEQKLQHADKLRLAAINVNDFEAL

SEQ ID NO: 1744 - protein, 401 aa, Acidovorax avenae; identical to SEQ ID NO: 1710

SEQ ID NO: 1745 - protein, 584 aa, Desulfosporosinus meridiei; identical to SEQ ID NO: 1742

SEQ ID NO: 1746 - protein, 410 aa, Mycobacterium rhodesiae
MDLSWSAKDLEFQAEVRAFLDEKLTPDLRRAGRLMTSVYADHEASMAWQAILHERGWAAPAWPVEHGGCDWTLTQHYIFSRESTLAGAPSLSPMGIRMVAHAIIAYGTPEQKDYFLPRILTGEVFFCQGYSEPEAGSDLAALTMSAANDGDDLICTGSKIWTTHATEANWIFALVRTSRSAKKQQGITFVLIDMSTPGIEIRPLVMTSGEKVQNQIFFDAVRVPKANVIGEIDGGWTVAKYLLEFERGGGATAPALQALAGSIATEAVGQPGPAGGALIDDPTFAAKLADIRIRADVLEILEYRVLTTVAEGGNPGAASSMLKVLSTELSQAITELAMEAAGPRGRAYQPHATYPGGPVSDFEPPADGYVSGEPWQAVAALRYFNDRAGSIYAGSNEIQRNILAKATLGL

SEQ ID NO: 1747 - protein, 404 aa, Mycobacterium rhodesiae
MDIDYPPEAQSFRDEIRAFLAEHLPPDWTGPGGLPPEEREELRHRWRKILADRGLVAVSWPKAYGGGGLSVIEQAVLAEEFSRGGAPERDENDMFGIDLLGNTLIAVGTKQQKKHFLPRILSGEDRWCQGFSEPEAGSDLASVRTKAVLEGDEWIVNGQKIWTSAGPTANWIFVLARTDPEVPKHKGLSMLLVPVDQPGVMVRPIVNAAGHASFSEVFFTDARAKATDVLGGIGGGWATAMTVLGFERGSQITTAAIEFGRGLDRLRQLAKERGRNTDPLIRDELAWCYSRVQILRYQGYRGLTALLNGQRPGAEAAINKVVWSEYFQRYTDLAVDIIGVDALSADGPGNGAALIIPVPGTPNSAACWLDELLYARAATIYAGSSQIQRNVIGEQLLGLPKEPR

SEQ ID NO: 1748 - protein, 407 aa, Mycobacterium rhodesiae
MPASLDSIASLPLSPADRDFRDEVRTWLDEHLVGEFVGTADRGGPDDDDNWELRRAWERELAAGNWLGLSWPTRYGGRAATMTQEIIFAMECARAAAPPRAAFHGETLMAPTALAHGTEEQKQRLLPPMAASEVVWCQGYSEPGAGSDLANISTKAVRDGNEWVISGQKIWTTFAQYADWIFAIVRTEPGSSRHTGLSYLLIPLDQPGVDVVPIRTMLGDSGFNEVFFDEARTSVDNVLGAEGDGWNAAMTTLGHERATSVLNYQFSFGREMKQLRALAAQRGALEDPILRHQLVDSLIGLEIMAYNNMRTLSAALRDGKFGPEASIGKYYWSRWHKEFTEIAMDVLGPDALLGTDWTSGPDADSAAVRRGFIRARAETIYAGTSEIQKNIISERVLGLPREPKVTR

SEQ ID NO: 1749 - protein, 637 aa, Saccharomonospora viridis; identical to SEQ ID NO: 1707

SEQ ID NO: 1750 - protein, 415 aa, Rhodothermus marinus; identical to SEQ ID NO: 1723

SEQ ID NO: 1751 - protein, 640 aa, Caenorhabditis remanei; identical to SEQ ID NO: 1717

SEQ ID NO: 1752 - protein, 718 aa, Homo sapiens
MGSPLRFDGRVVLVTGAGAVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 1753 - protein, 550 aa, Sinorhizobium meliloti
MNQMNRTEQKLAELNQPKPWSGVNAFRSDPLVVDITSSMPKTLRDEFDGLGRYVTSPEAQELARMANEGVPKLKTHGPRGERLDVVEFHPAWHALMRRSMTTGLHSSAWENLPDERGRSHKVRAIRFYLTAQLECGHLCPLTMTSASVAAITASPAVQKEWAPKILSRKYDSSNRPWMQKSAVTIGMGMTEKQGGTDVRANTSTAERVGEGIYRLTGHKWFMSAPMSDAFVMLAQTREGLGCFLVPRLLEDGGANGLRFQRLKDKLGNRSNASSEVEFSDTFGFLLGTPDAGIRTILDMVTLTRLDCALASAGMMRASLAEAVHHTRGRKVFGKALVSQPMMTRVLADMALDVAAASALSFRLAEAFDNAHSSAEDAAYARIMTPVAKYWCCKIAPALIYEAMECMGGNGYVEERALARHYREAPVNAIWEGSGNVMALDVLRVLGRRKELFEQLFATIGRDLGPAGRKTIEVLRAAMSLCERDEGAARMLVEQLALAAAAAELYRLGAGRIADAFLESRLAAGWRSTYGMLDSRFDSAYVLDLLYPAAT

SEQ ID NO: 1754 - protein, 550 aa, Sinorhizobium meliloti
MNQMNRTEQKLAELNQPKPWSGVNAFRSDPLVVDITSSMPKTLRDEFDGLGRYVTSPEAQELARMANEGVPKLKTHGPRGERLDVVEFHPAWHALMRRSMTTGLHSSAWENLPDERGRSHKVRAIRFYLTAQLECGHLCPLTMTSASVAAITASPAVQKEWAPKILSRKYDSSNRPWMQKSAVTIGMGMTEKQGGTDVRANTSTAERVGEGIYRLTGHKWFMSAPMSDAFVMLAQTREGLGCFLVPRLLEDGGANGLRFQRLKDKLGNRSNASSEVEFSDTFGFLLGTPDAGIRTILDMVTLTRLDCALASAGMMRASLAEAVHHTRGRKVFGKALVSQPMMTRVLADMALDVAAASALSFRLAEAFDNAHSSAEDAAYARIMTPVAKYWCCKIAPALIYEAMECMGGNGYVEERALARHYREAPVNAVWEGSGNVMALDVLRVLGRRKELFEQLFATIGRDLGPAGRKTIEVLRAAMSLCERDEGAARMLVEQLALAAAAAELYRLGAGRIADAFLESRLAAGWRSTYGMLDSRFDSAYVLDLLYPAAT

SEQ ID NO: 1755 - protein, 580 aa, Serratia plymuthica
MMDLLLQTLQATRDAPLTAEAYAHWREQAERAFESTRLMQHDRDATFPQEAVDWLNQQGAALLYLPSQHRGRLTGLEQISTLWRALAALDLTVAIGHGKSFLGAVSVWLAGNARQVEQTRRALLADEALAWGLTERERGADLMATRTTAVKHAQGWRLQGEKWLINNATRGNIITLLARTDELAGARGMSVLLLDKRHLPATSWRHLPKVSTYGIRGADISGQQWQDAELPDDALVGEPGQGLEITLRALQLTRTACCGLSVGALDAGLRLTTGLVQHHRLYGRRLSELDTVQTLLAESQVVSWMLEITAWTAARHASYLPQEMSVVSALAKAAIPSLAAHQLSLLEEQMGARGFVSDLFADGAFQKLIRDHQIVPIFDGSTLVSRSSLAPQLPTLIRQYRRGASDSVVLDRLGNRHSPTPAELPLNALTIYSRSGCSLVQALPAMIARAQQQHAGQVAEQDLAALLDTLLQASHRVIDDLASAPVVYPQVPQQTLLGLQRYESLFIAASCLLFWLNNPAPSALRCRHWLPLCLTLVVRQWGLPETAEPHVAWQALKASFADRPFTSADAILQQETDHER

SEQ ID NO: 1756 - protein, 567 aa, Desulfosporosinus acidiphilus
MSLLLNPQNYKSPQKDLPSREIMEKTLRFFEDKGLASIKEDDQASRWYTDFLKFIKEHQIFAALLTPAGYGAENSRFDLSRICEFNEISAFYSLSYQYAYQVTILGLGPIWMGNNEKVKHLTAKKLREGGIFAFGLSEKEHGADLYSNEMSLAPAGDGQFTANGGKYYIGNANEAALVSTFGRYKDTNDYVFFVVDSRHRNYKLVKKISTSGVRAAYVGDFELIEYPISEDDILSSGTLAWDSSLSSVNIGKFQLGFASIGICTHAYYEAINHASNRVLYGKKVTDFPHIQKIFTESYARLIAMKLYALRSLDYFRSASDEDRRYLLFNPIQKMKVTTQGMKIIEMLLDAIAAKGFEQDTYFETAIRDIGMIPRLEGTTHVNIALVIKFIQNYFFQPKEYPVIPKRDDPADDSYLFRQKAGKLASVRFPDYRIPYAGIKIPNVLVFFEQVELFRSFLEQASPSPEQVKNIDYMLALGEMFTLIVYAQLILEDTKLNPISPALLDEIFNFLVRDFAQFALTQISNYANSIEQEEFLKAMMKKPSHNPATVQTLWDNEVKPLVGAYQNS

SEQ ID NO: 1757 - protein, 580 aa, Serratia plymuthica; identical to SEQ ID NO: 1755

SEQ ID NO: 1758 - protein, 580 aa, Serratia sp.; identical to SEQ ID NO: 1755

SEQ ID NO: 1759 - protein, 409 aa, Pseudonocardia dioxanivorans
MTDADGRCTGGPLSTGADAERVQEAARAVVAEHDPRRVAAPEFLGACFDAGLSWVHFPEGLGGLGVSRGLQAVADAVLQGAGGPVPFWLNPIGYGMAAPTISEHARSPELARGWLRPLATTEDIWCQLFSEPGAGSDLAGLATSAVRDGDSWVVNGQKVWTSLAHRARWGLLLARSDPDQPKHRGLTYFVLDMTAPGVRTRPLRQMTGQAEFNEVFLDDARIPDEHRLGAVGDGWRVAMTTLMNERSAIGAGSAERGSGTIGDALSLWADRPHRRTPVLRDRLAGLWARAEAQRLTAARARRTATAGSPGPEGSVSKLVAAELNQDVYEFCMDLLGPEGTLYGSYEVRREGGRDADWRGAVQQRFLRSRANTIEGGTSEVLRNILGERVLGLPGEPRTDSGPWKEVPRG

SEQ ID NO: 1760 - protein, 704 aa, Pseudonocardia dioxanivorans
MVSAESHGGGRATRDTAGPGRAAGRTPEGGTRDTHDRGAAVDAGSAVPAPRPAGPTEPAEGGAALPRIDITGIGSTGTDSTGTDSTGTDARATTDDSPGTGTGSESSRHGSTPHYGARPSGASQGGRAAPAGSGRDDDPIAGPAPSTTRPRVPRTVRAEPVPPGPGVDLGTHEVTNQPPPLSGYDPLACDPALVDAVEREGAGGALPTMRQLGERIASPEYREHARLANENHPILRTHDRYGHRVDEVEFHPSWHALMDLSVGWGLHAAPWLADPGTGAHVARAAGFYLVGQLEQGHCCPISMTYASVPALRHDDELAAAYVPGLTAREYQPGLARPDSKTGLLAGMSMTEKQGGSDVRAGTTVATPSSDGTYRLTGHKWFTSAPMNDLFLTLAQAPAGLTCFVLPRVLPDGTRNAIRLQRLKDKLGNRSNASAELEYDDAVGWRLGEEGRGVVTIIEMVSMTRLDCVIGSASVIRAALTEAVHHVTHRRAFGERLVDQPLMQAVVADLALESEAATALTMRLAGAVDRGETDFLRLALPASKYLVCKRAPAVVAEALECLGGNGYVEESGMPRLYREAPLNSVWEGSGNVTALDVLRAVTREPDSQEAVLREIDAAAGADSWFDRARTELRTELRSREQRTARRLAELLALCMQGSLLLRFAPEEVASAFVSSRFLPDGPWRTAGTLPAAAHSEALVERVSPG

SEQ ID NO: 1761 - protein, 555 aa, Acidovorax avenae
MAQATHEVFNQYAELADYDLLATDAALQEALQRAGAGHALPALGEYARRLGSAETQALAQLANRHTPTLHRFDSRGRRIDRVEFHPAWDALMALYRGQGLVSMPFDSDRAGRWAAWAAGFYLHGQVEQGTLCPATMTQAAIPLLRKEPALWAQLGDRLHSRTHDPRELPAHEKAGIWLGMGMTEKQGGSDVRANTTVAMPLGAGGRGGEYRLRGHKWFFSTPQSDAHLVVARTGEGGPFACFYVPRRLPDGTLNGVHVQRLKDKVGNRSNASGEVEFDDAWGVLMGEEGRGIPTIIEMATYTRLNCVAGSAAILRQATVQAIAYARRRHAFGKALAAQPLMRTVLADLALESEAALALLMRLAEAFERDDGGTASPADRAWKRVMTPAAKFWVCKRGVEMSGEAMEVFGGNGYVQEGVMARLFLEAPVNSIWEGSGNVMCLDVLRALARDPEAAHALLEELAPAAQGEPRIAVALRELQALLARPPEALEALGRLLVQRLVLLAQACLLRRHAPAAVADAFIATRLSDPGAGRTVGAIDLRAAETGQVLARAFPD

SEQ ID NO: 1762 - protein, 654 aa, Tsukamurella paurometabola; identical to SEQ ID NO: 515

SEQ ID NO: 1763 - protein, 691 aa, Cellulomonas flavigena
MTTTTDRPTVPPTDAAAAPRVDVAALEEMLLGTYAQLRREARAITADPDFQKIEGLPMAEHRERVLQQLRRLVSEHEVLRSFPAHLGGADDHGGSLAKFEELVAGDPSLQIKAGVQWGLFASAILHLGTQHHHDTLLADAMHLRVPGAFAMTEAGHGSDVASIGTTAEYDPASEEFVLHTPFRAAWKDYLGNAAVHGTAAVVFAQLITAAPGGPRVNHGVHAFYVPLRDPATMEFLPGIGGEDDGVKGGLNGIDNGRLHFTHVRVPRTNLLNRYGDVAPDGTYSSPIKSPGRRFFTMLGTLVQGRVSLDGAAANASKIALAIAVTYANQRRQFAGGTGDEVVLLDYGQHQRRLLPLLADAYATSFAHEELLAAFDEVFSGRGDTPEQREDLETLAAALKPTSTWNALRTIQECREACGGAGFMAENRLTGLHADLDVYATFEGDNTVLYQLVAKRLLGDYAKSLKALQSDRGDLARFVVDRVTDVAMHRTPLVRAVQTLGDRGDARRSVGQLRDTDTQRELLTDRVETMVAQVAQALAPARKMAPEKAAELFNAHQHELIEAARAHAERVQWEAFTRAVERVEDPGTRQVLTWVRDLFGLTLVERNLAWYLVNGRLSAGRARAVTSYIERLLVRLRPHAQDLVDAFGYGPEHLRAPIASGQERQRQDEARAYYRGQRASGDAPIPEKHVSA

SEQ ID NO: 1764 - protein, 691 aa, Cellulomonas flavigena; identical to SEQ ID NO: 1763

SEQ ID NO: 1765 - protein, 414 aa, Desulfobacterium autotrophicum
MDYLELNINLTKEDIMLKKAAHEFARDVMRPVSLQMDRMTAAEAVAPGSPFWEFKKKAYELDLHTILIPDSYGGMGLTPLQLHLVLEELSWGSVGLTVDLAVAAFPAYLASMVPDDEIVENIIKPFCDCRDGKIAGCWAITEPMHGSDTLLPNYPSFRNPDIPADCTATLDGDHYVINGQKAAWVSGAPYASHALLFCQIDPSMGHAGGGIFIVPLDLPGVKRGAPLEKMGQRDDPQGELYFDNVRVPANYLVAGPEAYEVMLEIILSATTALMGTCATGIGRAAFEEALEYAKNRVQCGKALIEHQDVQKKLFKMFSKVEMTRQLTRSVLEYNQNTSTPAEEYSVIGKVFGCQYAFEIANDAVQIFGGNGLTREYIVEKLFRDARSMMIEDGANDVLAIAAGHKVIHNYPRQD

SEQ ID NO: 1766 - protein, 567 aa, Desulfosporosinus acidiphilus; identical to SEQ ID NO: 1756

SEQ ID NO: 1767 - protein, 545 aa, Stenotrophomonas maltophilia
MSGPSFSSSAPYETHVVLNQPPPFAGRQLWTDDVALMEAVQREGAGSFAPRLAVYGALAGDELYRLGFDANRDRPRLRTHDAQGHRIDTVEFHPAYHQLMGTAKSHGVAGLSWHEPQPGAHVARAVLSYLHHQAEAGTSCPLTMTHAAVAVLHTQPHLAEWARKAAAPVYDPRDVPVADKAGITLGMGMTEKQGGSDVRANSTRAEPIDGERYRLVGHKWFFSAPMCDGFLVLAQAPGGLTCLLMPRRLADGDRNAFRLMRLKDKLGDWANASSEVEFCGAQAWRVGEEGRGVATIIGMVMMTRLDCMLGAAAEMRMALAQALHHARHRRTFGKLLVEHPLMTNVLADLALESEAATVLSMRIARAVDRAGVDANEAALARVGTALGKYWLCKRAPAFVNEAQECLGGAGYVEESMLPRLYRQAPLNSIWEGSGNIQCLDVLRALAREPEALAALRAELAAVADRDARYAAALQRWAAAPPPDESQARLFCERTALLLQAALLLRARSPMAEAFVRSRLQGEHGLVFGTLPAGVDLSAMLARALP

SEQ ID NO: 1768 - protein, 411 aa, Streptomyces violaceusniger
MTPTTNRTHRPTALPPLDLDRLPALTAALAVRAPAHDRDASFPTEGVALVHEAGLLTATVATRHGGPGAGLADTARILRALGAGDPAVALVAAMTLFVHAAEARTPAWPAAVYGDLLAASAAGPTLVNALRVEPELGSPVRGGLPATTARRDGGHWLLTGRKIYSTGAIGLSRMLVFARTEPGDGEPVRVGTFIVRTGSPGLTVEPTWDHVGLRASRSDDVVLDSVPVPADDVIGLTEPGDTPGARPDPVTGAWNALGLTALYLGVAGAARDWLTGFLHERVPTALGAPLATLPRFQSAVGEIETALIGADTLVDALAARVDAGDPEAVEQAGVAKVLGTRAAITAVDQALTLTGNHGLTHANPLQRHYRDVLCNRVHTPQDDSVLTATGRAALARRFTSDMSNPPAPKGD

SEQ ID NO: 1769 - protein, 401 aa, Streptomyces violaceusniger
MSAAGQHPAVDADELRRRVRDLLDAHPPATTEPLDFLRARFDAGLAWVHYPAGLGGLDAPRSLQAVVDAELAAAGAPDNDPRRIGIGLGMAAPTILGFGTDEQRQRLLRPLWTGEEVWCQLFSEPGAGSDLAALATRAVRDGEDWVVDGQKVWTSSAHIARWAILIARTDPDQPKHRGISYFICDMTDPGVEVRPLRQITGEAEFNEVFLTGVRIPDSRRLGEIGEGWRVAQTTLMNERVAIGGGRVPREGGMIGLVADTWRERPELRTHDLHQRLLRLWMESEAARLAGERLRQQLAVGQPGPEGSAMKLAFARLNQHISALEVELLGEEGLRYDDWTLRRPELVDFTGREAGYRYLRAKGNSIEGGTSEVLLNIIAERVLGLPPEPRTDKDVPWKDLPR

SEQ ID NO: 1770 - protein, 466 aa, Streptomyces violaceusniger
MDFAFGPEDERFRAEARDWLAAHFTGPFAALKQEPGGHPGEARGDMTARRAWERELSTGGWIGLGWDRTDGAYGNRAATLTQQVVWAEEYARAGAPGRLGHIGENLLAPTLLAHGDSAQRARFLPPIARAEELWCQGYSEPDAGSDLAGLRTRAVRDPGDGTYRITGQKIWTSLAHEADWCFVLARTEEGSQRHHGLSFLLVPMDQPGRIEVRPIRQLTGTAEFNEVFFDGAVARAEHLVGGAGHGWRVAMSLLAVERGVSTLVQQIGFAQELSRVVRLALETGAAEEPVLRDRLIRQWAELKAMRWNALRTLGAAQKPTPNPNPNPNANHARDPALHPASNDARDPAPRKGAAHDLPPGSADPQAPGPRDPGPQDPGAQDLGAPSVAKLLWGGWHQRLGELAVQVRGAAAALGPARWTAGRPYELDAFQRLFLFSRADTIYGGSDEIQRTIIAERVLHLPKESRR

SEQ ID NO: 1771 - protein, 505 aa, Sphingobacterium sp.
MINTTEITREVQNFNIFINSFRKRLASLFNTEHDYNALSLKRGLPPGFLSEIMDMQPLAVAIPENYGGRGMKVKECLSVLSAASYESLSLSLIFGINIALFLEPFAKYGHVAAQERVFRRFLENKAMGGLMITEPDYGSDALNMQTFYQEEANGYRIKGEKHWQGLTGAADFWLVAARKKNEQGELVRDIDFFFTDNALAEQQIDVKERYNSLGLYAIPYGLNFIDVEVPATQRLLPESTGLKLMLDTLHRSRLQFPGMGMGFIKRLLDESLLHCKTRVVAGQRLYELDAVQFQLSRIQAAYTICSAMCSYSSKVSSIEQDVSGNGVDANSVKALVTDLMQESAQIALQLAGANGYRLDHIAGRAVVDSRPFQIFEGSNEMLYTQVAESVAKLMRKNKESNLLRYLKGYELTAQAAPYFAGCLDFSFPEQPKKRDLVTLGRIIARVICFQMVVVLQDAGFNRELVDITQKHMGMDLNMLIGQLTANNDAVPVIDYEEDAAWADFV

SEQ ID NO: 1772 - protein, 412 aa, Caenorhabditis brenneri
MAIRNSDGYMARNLKRWSDAYQMSKTEEIPEMEKLESYLKENLPKSEKSTIVHGDFRIDNLILEENEIKVKGVLDWELSTIGDPLSDLATFLFVHYVPNRMKLLPGIGDYSESDLRRMGIPTIKECLELYAKYTDSQVVDPEIWTYYMAFVVFRFASIVQGVYMRSKLKNASSTEASMLGPLVRKLAAEGNQMISKLHASKSYGQLTIIPSGMSSKAQKYYEIVRDIVHNHVIPLELELMEYYEEGPHKWTIPHPKIEKLKEKAKSLGAWNLFISEHIDPDQKYGKGLTNVEYAHICELMGRSIFAPEVFNCQAPDTGNMEVLIKYGNEEQKKKWLIPLLNGEIKSCFAMTEPDVASSDATNIQGSIVRVGDEYIINARKWFISNGSHPRCRICVFMGQVAGPKKSRIFHNQ

SEQ ID NO: 1773 - protein, 608 aa, Caenorhabditis brenneri
MASSSATNATIAARHTQYSHAKTGGFSQEAPTLHNPYKDDPILDRAIRRLLPEAQYMRVAEDLTKFGDRITSEIEHLGRQAELEQPRLEQQDAWGKRVDKLIVCNEWQKLKRICAEEGVISIGYENDVDPFVRRIHQVAKLFLFSPSAGLVSCPMAMTDGAVKTLTSLNLYGKHKFATEAVDRLRSRDPSKAWTSGQWMTEKKGGSDVAGGCDTYAVQIDKDTYRLHGYKWFSSAIDADVALTLARVVDTDGNSVEGSRGLSLFLLRIRDDAGNLNGIQMVRLKNKLGTKQLPTAELLLDGAIAERIGEQGRGVAGISNMLNITRIHNAVASLGYMRRIISLARDYSTKRVVFGQTQSKWPLHTTTLAKMEVETRGSMLLLFESARLLGLSEAGKSSDIDAMMLRLITPVLKLYAGKQAVPLVSEGIECFGGQGYMEDTGLPTLLRDAQVTPIWEGTTNVLSLDVLRVFSGKENILLAFGKRVGQLLANTKSDEPKLQKAKESVETALKELQKLLVKASDSAVQGDTRIDSVARHISFAIARIYSGSLLIDHASDSTVANPSDIEVAYRYCCEQPLIDLRWEWFANERVKADRDIVFDNYSGLQKSKI

SEQ ID NO: 1774 - protein, 594 aa, Agrobacterium sp.
MYTAPVDDIAFTLKHVAGLQDALSRGALGDLGEDVVDAILQEAGRFATEQVAPLADIGDRQGARLSDGKVSTPDGWADLYRRWAEAGWNSLTAPEEFGGQNLPHMLNVAALEMWNSGSMAFALAPTLTMGAVEALVAHGSNDLKRIYLPKLVSGEWTGTMNLTEPHAGSDLGVLKTRAERNGDGTYRIFGQKIFITWGEHDAADNIIHLVLARLPDAPAGTRGISLFLVPKFLPEDDGTPGSRNDVFCHSLEHKLGIHGSPTCTMIFGDGKFGEEKGALGWLIGEENKGLACMFTMMNNARLAVGMQGVAICEAATQKAIEYARERTQGKAPGWQGSGMSPIIEHPDIARTLLTMKALTQGARAISFNCAHAIDMAHAAEDVAERAHWQERAALLTPIAKSFSTDAGVDVASMGIQVHGGMGFIEETGAARYLRDARIAPIYEGTNGIQAIDLVVRKLPLSDGAQVRGFIAELREIVARTAASNRSDLGETARYLETSLADLETATDWLLERLKAGETETALAGATPYQRLFGLALTGAYLAKGALAQVDDGRGAHRASLCRFAAENLLAETAALRDRVIAGAASLAAARAVLG

SEQ ID NO: 1775 - protein, 568 aa, Alicycliphilus denitrificans
MSANDQTQMTALAQASAAAHPVPDRGHVNYYTGDGELQSLLALYLPADLHAHLQPYFERMGELAGGAVDDWAQEADRNPPTLEMRSRAGKEQQRIVKHPAYVEMEKVAFQQFGLAAISHREDMLGWKGKMPPIVKYALTYLFVQSEFGLCCPLSMTDSLTRTLKKYGAPELVNKYLPRLLAMDFDSSVQGSMFMTEQAAGSDIANTLTMAYPQEDGSWRLYGEKWFCSNPDAGFSMVLARVDGGPPGMKGISLFLLPRIKDDGSTNHYHIVRLKDKMGTRSMASGEIRMEGAVAYLVGEQGRGFVQIADMVNNSRLSNGMRSAGMMRRAVAEAEFIARERWAFGRRLQDLPLMRVQLDKLRVPAEQARTMVFQTAATLARSDAGDKSAYALLRILTPMIKFRACRDARKVAGDAMEVRGGCGYIEEWADPRLVRDAHLGSIWEGTSNIVALDVVRAIKREGSLPVLNDYLHGLLADTAAITPAYRQALGDALARAAKLAERAAAEGGEKLARQAASGLYHCTTAIAMAWEAGKTGSSERLRLSQLVLAHRVLPRDPLAEAAVPADWRQ

SEQ ID NO: 1776 - protein, 640 aa, Streptomyces flavogriseus
MQPEVDVRALTEVLDGEYAAIRDLVRTNLVTHASVLEEADELGVDAYRERVRELVVEMAATGQTGMGFPAKYGGGGDVGASIAAFETLAFGDLSVLVKVGVQFGLFGGAILHLGTGRHHDAYLPDLITGKLMGCFAMTETGHGSNVQALGTLATYDAATQEFVITTDGDQARKDYIGNAARHAELAVVFAQLEVGGESKGVHAFVVPVRTGGEVVPGVRIEDDGRKMGLNGVDNGRIRFDGVRVPREALLNRFADVTPDGVYESPIENPDRRFFTMLGTLVQGRVSVGGAGVNAAKVALTIATKYAVRRRQFDAAPDTEEQLLLDYGLHQRRLLPLLARTYALHFAQDVVRTHLHEVLSGIKDDAYERRQLESRAAGTKALGTWHATRVVQECREACGGAGYLAVNRFAALKSDSDIFTTFEGDNHVLLQLVAKGLLTHYASEFEDLDQLGMVRHVTGLAVETVIEKTSAHKLLERVRDLLPGGDEWDQEAGLRDSEYQLAMLRYREEHMLAGVARRLKRGIDQKRDPGAVFSQVQDHVIAVAHAHVERLVLEAFVDKLRAQPEGGNKVALGLLCDLFALSTIEADRAWFMEHGRLTVQRSKAISREVHDLCRKVRPLAVDLVDAWGIPPEMLRAPDLVG

SEQ ID NO: 1777 - protein, 414 aa, Desulfobacterium autotrophicum; identical to SEQ ID NO: 1765

SEQ ID NO: 1778 - protein, 576 aa, Streptomyces griseus
MADSASLLFNPRTYDPEHFDPETRRLLRATVDWFEARGKRRLIEDYRSRAWLGDFLDFAAKEGLFATFLTPTAAGKGRDRRWDTARIAALNEIFGFYGLDYWYAWQVTILGLGPVWQSDNAEARARAAELLSQGEVFAFGLSEKTHGADIYSTDMLLEPDGEADGGFRAFGSKYYIGNGNAAGLVSVFGRRTDVEGPDGYVFFAADSRHEAYHLVKNVVESSKYVSEFRLDGYPVAPADILHTGRAAFDAALNTVNVGKFNLCTASIGICEHAMYEAVTHASNRILYGRPVTAFPHVRRELTDAYVRLVGMKLFSDRAVDYFRSAGPEDRRYLLFNPMTKMKVTTEGEKVIDLMWDVIAAKGFEKDTYFAQAAVEIRGLPKLEGTVHVNLALILKFLRNHLLNPVDFPAVPTRLDAADDAFLFRQGPARGLGSVRFHDWRPAFDAYAEVPNVARFREQADALCAFVETAAPDEEQSRDLDLLLAVGQLFALVVHGQLILEQARLTGLDEELLDELFAVLVRDFSAHAVELHGKDSATGDQQSWALGAVRRPVVDAARSARIWERVEALSGAYEMAE

SEQ ID NO: 1779 - protein, 550 aa, Rhizobium sp.
MTIMNRTEEKLAALNQPKPWSGVNAYRSDPLLVDLTSTLARSLRDEYDVVGKYVTSPEAQELARMANASPPQLRTHGVRGERLDVTEYHPAYHALMRRSMSSGLHCSVWENQTDARGHEHKARAVRYFLTAQLESGHLCPLTMTSASVAALVASPAVQKEWTPKILSRKYDSANKPPMQKSAVTIGMGMTEKQGGTDVRANITSGERVGEGIYRLSGHKWFMSAPMSDAFVMLAQTRDGMGCFLVPRLLEDGSANGLEFQRLKDKIGNRSNASSEVEFDEAFGFLLGTPGDGVRTILDMVTLTRLDCALASAGMMRASMAEAVHHVRGRTVFGKKLIDQPLMTRVLADMALDVAAATALAFRLADSFDRARENPVDAAYARVMTPVVKYWICKIAPGLIYEAMESIGGSGYVEERPIARHYREAPVNAIWEGSGNVMALDVLRVLNRGKDLFETLFAGLERDLGASGKKTVEVLRAATALAERDEGAGRLLIEQLALAAGAAELYRLGAGKIADAFLETRLAGGWRHTYGVLDARFDARYVLDLLYPAAT

SEQ ID NO: 1780 - protein, 591 aa, Desulfitobacterium dichloroeliminans
MELELALKGGGFLLAEITPDQVVTPEELNEDHLQLKKMTRSFVENEIAPKIEALEEQEDGLMRSFMAQAGELGLLGLEVPEEFGGMSMDKCSAVVVGEEVPRGASFAVAFAAHTGIGTLPIVYFGSPEQKAKYLPGLASGETIAAYCLTEPGSGSDALGAKATAVLNAEGTHYILNGTKQFITNAGFADIFLVYAKVDGKLTNFIVERTMHGVSFGPEEKKMGIKGSSTRQVILEDVPVPVENVVGELGRGHVVAFNILNVGRFKLAAAAIGSAQLALEITLKYAEERKQFGVPLSSFGAIQTKFAEIATRTYLAESVVYRTAGLMEEACKDLDVTGDCRKEAGKALEEHAVECSLNKVIASEVLDLAVDEGVQVHGGYGFIAEYPIERMYRDSRINRLFEGTNEINRLLVPGTLLKRAISGELPLLAAAKNVSKDLMSASLGSEGEGLDALLDMTQKAKKLCLMASGIAAQNLGMELKDNQYVLLGLAEMVLQVYAMESGVLRALKVQGMDVTDDHKLFVEKAATLGAYSAMNIIEQHAKEVIGAAEQGDSLSTVLAGIRKLVRRPNVDMIGLRQEIAKLVVEKGKYPIR

SEQ ID NO: 1781 - protein, 591 aa, Desulfitobacterium dehalogenans
MELELGLKGGGFLLADVTPEQVYIPEELNEDHLQLKKMTRNFVEKEIGPKIEALEEQEDGLIRGFMAQAGELGLLGLEIPEDLGGMSMDKFSTVVVGEEVPRGSSFAVAFAAHTGIGTLPIVYFGTPEQKAKYLPGLASGEKIAAYCLTEPGSGSDALGAKSTAVLNAEGTHYILNGTKQFITNAGFADIFLVYAKVDGKLTNFIVERTMPGVSFGPEEKKMGIKGSSTRQVILEDVAVPVENVVGELGRGHVVAFNILNVGRFKLAAAAIGSAQLALEVTLKYAGERKQFGVPLSSFGAIQTKFAEIATQTYLAESVVYRTAGLMEEACKDLDVTGDCRKEAGKAIEEYAIECSLNKVLASEVLDLAVDEGVQIHGGYGFIAEYPIERMYRDSRINRLFEGTNEINRLLVPGTLLKRAMSGELPLLAAAKNVSKDLMSAGLGSEEEGLAALLDMTQKAKKLCLMAAGIAAQNLGMELKDNQYVLLGMAEMILQVYAMESGVLRALKVQDMDVTDDHKLFVEKAATLGAYSAMNIIEQHAKEVICAAEQGDSLSTVLAGMRKLLRRPNVDMIGLRQEIAKLVVEKGKYPIR

SEQ ID NO: 1782 - protein, 834 aa, Rhodothermus marinus
MNLPFYHFLEPISAGWIVLGVLVVALALAFTGAPLELWTLAAAMVLYGVGAPLWLWVVFGVLAVVFNLKLLRRTLVSGPLMAFMRASGFLPKISDTERTAIEAGTVWVEGELFAGKPNFNRLLRETNYPSLTDEERAFLEGPVEELCRMVNDWEVWRRRDLSPEVWQFIREKGFLGIIIPKEYGGLGFSSLANSAVVQKLSSRCGPLATTVMVPNSLGPAELLIHYGTQEQRDYYLPRLARGEEIPAFALTEPGAGSDAGAIQASGVVFRGEDGKLYIRLNFQKRYITLAAIATVLGLAFKLRDPDNLLGKGEDLGITCALIPTSTPGVKLGMRHDPLGVPFYNCPVEGHDVVVPIDAIIGGPEWAGKGWRMLMESLAAGRGISLPASSAGGLKLIYRVASAHARVRRQFGLPIGMFEGIEEPLARIGGFNYLVEAGRVYTCGGLDRGAKPAVVSAIMKYNTTELGRQAINDGMDILGGNGISRGPRNLLAHGYIAAPIGITVEGANILTRTLMIFGQGAIRCHPYAYKEISALERGDVQAFDDAFWKHVGLVVRNGARALLLSLSRGRLARTGVSGPAARYARKLAWASASFAFLADLAMAALGGNLKRKEKLTGRFADIFSWMYLATATMRRFEAEGRREEDRPFFDWAMQYAFHRMQQAFDGLFDNLRIPGLTWFLRGPAAWWSRLNRLSAPPSDRLGHRVAQLMLTPGEQRERMTAGMYVPSDPNEALGRLERAFRLAYQEDELLRKIYAAVKRGELPRARPEQLVRQAVEKGIITAEEAGLIQEAEAARWDAIQVDAFTLEEYRRYYNAPPAGIEAAGDGSREAVATES

SEQ ID NO: 1783 - protein, 558 aa, Rhodothermus marinus
MFVQEPPRLDNTYEADSPLRGYLARTLPADVLREIEPELQELGALAGGPLYRLQLEDRTDEPVHIPWNAWGERIDEVRLTRVWQEAEPLAVRFGLVATAYEQAHGAFSRIHQFAKVYLFAPSTDIYACPLAMTDGAARTLLDSGNRRLIERALPHLTSRDPATFWTSGQWMTELTGGSDVGSSQTVARREADGTWRLYGRKWFVSAITSQMALILARPEGNPPGGRGLALFYAELRDERGRPRGFQILRLKDKLGTRKLPTAEVLLEGLPAEPVAGLTHGTRAIAPMLNVTRTWNAITAAALMQRGLMLARDYARRRIAFGRPLAEHPLHLDTLAGLQAETAAAFHLAFLVAELMGRVEAEAASDDERALLRLLTPVAKLTTARQAVAVLSEVLEAFGGAGYVEDTGLPVLLRDAQVLPIWEGTTNVLALDVLRALEDTGGLKPLHRAFGTWLREVPEALAPLAHEARAALQAADAWLAETVDDPVRLQADARRFALTLGRAAALALLVRQAAWSQTRGDKRLAAAAHRFARHSVNLLPTGTPPAESRMLALDEPSKS

SEQ ID NO: 1784 - protein, 545 aa, Stenotrophomonas maltophilia; identical to SEQ ID NO: 1767

SEQ ID NO: 1785 - protein, 550 aa, Sinorhizobium meliloti; identical to SEQ ID NO: 1754

SEQ ID NO: 1786 - protein, 580 aa, Serratia sp.; identical to SEQ ID NO: 1755

SEQ ID NO: 1787 - protein, 550 aa, Sinorhizobium meliloti; identical to SEQ ID NO: 1753

SEQ ID NO: 1788 - protein, 567 aa, Delftia sp.
MNPEPQALAAMQSSPAQAFQAVPDRHGSNLYTTDSQLQPLLALYLPPEVNAHLQPHLERMGALAGREIDEWALTADRNPPELEHRDRTGRDAQRIVKHPAYVEMERVAYGEFGLAVMSHRTGVLGWDGKLPPLAKYALTYLFVQAEFGLCCPLSMTDSLARTLRKYGEPALVEKYWPRMTQLRFEDQAQGAMFMTEQAAGSDISNTQTLARPAADGSWRLSGDKWFCSNPDADFAMVLARVEGAPAGMKGISLFLLPRRLDDGSANHYRIVRLKHKLGTRSMASGEIVLDGAVAYLVGEQGRGFVQMADMVNNSRLSNGVRSAGLMRRAVAEAEYVARERRAFGKALQDMPLMQRQLDKLRIYSEQARTMVLQTAQALQRSDAGEDGAYALLRILTPMIKFRACRDARKVTGDAMEVRGGCGYIEEWSDPRLVRDSHLGSIWEGTSNIVALDVIRAIKREGSLPVLRDHAAQLLAQTEAATDFKAALSASMDKAAALALRAAEEGGDRLARAAASGLYHCFTATAMAWEASCTGSAERMRWAQLVLLHRVLPRDPLAAGDLPEGWTR

SEQ ID NO: 1789 - protein, 580 aa, Serratia sp.; identical to SEQ ID NO: 1755

SEQ ID NO: 1790 - protein, 694 aa, Cellulomonas fimi
MTTTTPRLTPADTEQGDPRLDADVRRIDVQHLARVLLGHYPELRLGARRLMADERFHQIPGLTLAEHRERVLAQLRLLAAEGDVHRSFPVRFGGAEDHGGFLARFEELTHADPSLQIKSGVQFGLFASAIYHLGTERNHEEFLRDALTLAVPGAFAMTETGHGSDVASIATTATYDPETQEFVVHTPFRAARKDYLGNAALHGTAAVVFARLITAPAGQPRVDHGVHALYVPVRDPQTLELLPGVGSEDDGLKGGLNGIDNGRLWFDHVRVPRTNLLSRYGDVAPDGTYSSPVASPGRRFFTMLGTLVQGRVSLDGAAVTASRLALTIAITYANQRRQFAGGDGDEVVLMDYAEHQRRLLPLLAETYASGFAHEDLLAAFDDVFSGRNDTPDTREDLETLAAALKPTSTWHALRTLQTCREACGGAGFLAENRLTGLRADLDVYATFEGDNTVLLQLVGKRLLTDYAKGFKHLDAVKVARLVAERASDAARFRTPLHRALQTISDVGDPRRSAGQLRETETQRALLVDRVETMVAEIAQALRPAQKADPAAAAAIFNSQQHALVEAARAHAELVQWESFTAALARVEDPGTQQVLTWVRDLFGLTVIERHLAWYLVNGRLSAGRARTVTSYIDRLVARLRPHAQDLVDAFGFEQAHLRAPIASGAEQARQDEARAYHRAQRASGDAPIPEKHTR

SEQ ID NO: 1791 - protein, 568 aa, Alicycliphilus denitrificans; identical to SEQ ID NO: 1775

SEQ ID NO: 1792 - protein, 409 aa, Pseudonocardia dioxanivorans; identical to SEQ ID NO: 1759

SEQ ID NO: 1793 - protein, 704 aa, Pseudonocardia dioxanivorans; identical to SEQ ID NO: 1760

SEQ ID NO: 1794 - protein, 505 aa, Sphingobacterium sp.; identical to SEQ ID NO: 1771

SEQ ID NO: 1795 - protein, 640 aa, Streptomyces flavogriseus; identical to SEQ ID NO: 1776

SEQ ID NO: 1796 - protein, 591 aa, Desulfitobacterium dehalogenans; identical to SEQ ID NO: 1781

SEQ ID NO: 1797 - protein, 591 aa, Desulfitobacterium dichloroeliminans; identical to SEQ ID NO: 1780

SEQ ID NO: 1798 - protein, 594 aa, Agrobacterium sp.; identical to SEQ ID NO: 1774

SEQ ID NO: 1799 - protein, 411 aa, Streptomyces violaceusniger; identical to SEQ ID NO: 1768

SEQ ID NO: 1800 - protein, 401 aa, Streptomyces violaceusniger; identical to SEQ ID NO: 1769

SEQ ID NO: 1801 - protein, 466 aa, Streptomyces violaceusniger; identical to SEQ ID NO: 1770

SEQ ID NO: 1802 - protein, 576 aa, Streptomyces griseus; identical to SEQ ID NO: 1778

SEQ ID NO: 1803 - protein, 421 aa, Frankia sp.
MDAAHPSGELEDFRRRARSWLAEHAVSQDDPGRRDAGAGQGSDDVSVFHNLSFAQEQALIERVAAWQRQKFDAGFGALGWPPEHGGAGLGPEFVEAFAAEEERYDIPAPHELVSVTVSLIAPTIRLVGTPEQRDLLMRTFLRCDSLCCQLFSEPGAGSDLAALATRAVRDGDEWVVGGQKVWSSGAQFAEWGMLLTRTDPDVPKHAGITAFLLRLDSPGVTVRPLRQMSGGTSFNEVFLDDVRIPDSLRLGEVGAGWKAALTTLGFEREGSGGGHPRVGGGWRELAPLARALGRLDDPLVRQRLADVYISERLAEVAALREAHDRRAGRPPGPEGSFRKLHWVTGMALASRAAELLLGPRLAADTGEWGTFAWTSHVLGAPGYRIAGGSDEIQRNIIAERILGLPGDVRVDRDRPWREIPR

SEQ ID NO: 1804 - protein, 417 aa, Frankia sp.
MEYDLGPAAAALRGRLRALVREHVPADYLGAFTANPADLAIAQDFCRLLADEGLLCMAWPEEFGGRGASLWEQTVVREEMWASHEPRGAQYMGVNWVGPTIMRHGTAAQRARHLPPISRGEVIWCQGFSEPGSGSDLASLRTAARPDESGDGTGGRAWRIHGQKIWTSYATMAQWCFLLARTSTTGRKQQGLTIFLVPMDSPGIEVRPIACMMGPHHLNEVFFDDVRVTERDVLGEVDGGWTVVQEVLAFERVGIARYARCERLLQEAPAALGDAWEQLPAELRGRWARMLVHARRARLLAYRVVSRQGTGQVSPVDSAAYRIAVTKLDQDSAEVLMEIVTAAEPAGDAGESVRYADWERWRRAVEDHARYSVASTVSSGSIEMQRILLSRALLAASGAPTSAQPRAAAPAKAGAAS

SEQ ID NO: 1805 - protein, 425 aa, Frankia sp.
MPSDTDSFVEEARAFLDAHATRRAGGGQAVQWGVGDDQVVYFSTDPPDVDAAKVAEAKAWQKARHTGGFGWITGPAEFGGRGLTSVHDLAYDAVEAEYDVPDTSVLSLIGLGMIGPTILAHAREHIRRRYLPAMYAGDIIACQLFSEPGAGSDLASVRTSAVRDGDEWVLNGQKVWTSVAQHAAIGLALCRTDPDKPKHRGITAFLVDMAAPGVEIRPLRQMSGGADFNEVFLTDVRVPDDHRLGDVDGGWAVAMTTLMNERASVGGEGTSGPAGRAVSLPFLTELLRANGRLDDAAARRELAGLYAEVAATDYLNRQSLRRARAGEQPGPEASVSKLMYARNLTRGAHFAAEIVGPRLVADTGEWGTFAWTELLLATPALRILGGTEEIMKNILAERVLGLPKEPGIDTKSPFRELRRSGRGES

SEQ ID NO: 1806 - protein, 433 aa, Frankia sp.
MSTTATSGTATDGDSQAGLRAEVEAWLAEHWDPELSVEQWWRLVATAGWTAPHLTAEQGGRGLPQRAGRTVRATFAAFGALQPPGGLGLLMAAPTILTLGTPEQIARHVPPILEGRLGWCQLFSEPGAGSDLAGLTTRAERDGDRWIINGQKVWSSQAREADYGMLLARTDFDVPKHAGISWFALKLDQPGVTIRPLREMTGDAVFNEVFLDDAVVAADDLVGGAGNGWMAANTTLHFERTGIGAGGAHAGFPPPGPKGGVLGLKAGDAALLRPPEGMVVTFADLVALAREHGRADDPAIRQKLARLHCYLQVGQWNAVRAKAEAAAGDAAAGASVASTGKIAQTRITKLSAEIGLEILGAGGLLAGPDAAASGKFANAFLFARASSIYGGTDEIQRNIAAERTLGLPREPSPDRKRPYREVLHALARRDDAS

SEQ ID NO: 1807 - protein, 433 aa, Frankia sp.; identical to SEQ ID NO: 1806

SEQ ID NO: 1808 - protein, 425 aa, Frankia sp.; identical to SEQ ID NO: 1805

SEQ ID NO: 1809 - protein, 417 aa, Frankia sp.; identical to SEQ ID NO: 1804

SEQ ID NO: 1810 - protein, 421 aa, Frankia sp.; identical to SEQ ID NO: 1803

SEQ ID NO: 1811 - protein, 552 aa, Bacillus coagulans
MNFYHDDPNLARLLKQYLDPLFFDWAEKELAEFGEMCAGEIDERATHTDREGQPKLIKYNRYGEDVSRVWVNEGYFKTVEQVYNKGIVGYVHKPIPALGQKGNYVYAFAQGYLLSQSELGFYCPVTLTAAASYLLDHYGSHELKQTYLPQLISTGEAERYEGATFLTERQGGSDVGANETKAVSEDGCYRLYGEKYFASNVGMCGVAMVLARREGAPSGTKGLSLFLVPWEKENGEKNGIYIRRLKDKLGVRAVPSGEVVFDGAKAYLVGDPRKGFYYMMEALNLSRICNAVASIGIMRRAYREARAYALRRTAFGSRLADYPMVKETLVKMAAKQEVETSAVFRLATLFDRTASGKADEKENIMARLLIAILKMETAEQAIHFAHEAIEMHGGNGYIEDFVTPRLLRDAQVLTVWEGTANILGLEVLRLMRKFKVHDIFIGMMREKIDQLQAGTWLSAGLEQLEETCRFVMKAKEEAVQTYHCKKVARQMVKIYESVTALEDALAGQRQKWIAEAYLRLAWHDPLAIDPELALVKHFEEIVMEKVPANEGN

SEQ ID NO: 1812 - protein, 555 aa, Acidovorax avenae; identical to SEQ ID NO: 1761

SEQ ID NO: 1813 - protein, 402 aa, Saccharomonospora paurometabolica
MINLEVPKKAKGLVNQARQAASEVFRPISRKYDRAEHEYPVELDMLASLLDGLNTSGEGGAGAAGVRRKEDEKDSGNRNGGNLSTVLGTIEMCWGDVAMLLSMPRQGLGNAAIASVSNDEQLERFAGTWSAMAITEPGCGSDSAAITTTATEDGDHYVLNGEKIFVTSGERADSVVVWATLDKNVGRAAIKSFVVEKGTPGFEVVRLEHKLGIRASDTAVLRFDNCRVPKQNLLGTPEIDTKKGFAGVMQTFDNTRPLVAAMAVGVARAALEETGRLLTEAGVTVDYDRPANLQHAAAARYLRLEADYEAAYLLTLESAWMADNREPNSLQASMAKAKAGRTAVDVTLGCVELAGTLGYSEESLLEKWSRDSKILDIFEGTQQIQQLIVARRLLGKSSSELK

SEQ ID NO: 1814 - protein, 402 aa, Saccharomonospora paurometabolica; identical to SEQ ID NO: 1813

SEQ ID NO: 1815 - protein, 541 aa, Hyphomicrobium denitrificans
MIEVANQPPPLEDYNLFESDAVLHEAVGREGATWAEPALSALGARLGSADTIALGADANRNAPVLRAFDRYGTRIDEVDFHPSWHALLGLAMETGLHSSPWAEPRRGAHVARAAGCYMLAQIESGVYCPVSMTYGSVPTLQRAPQIAADWLPRLFSRTYDRRFRPAAEKTSALIGMAMTENQGGSDLRTNVSRAEPYDVDGERRYYRLNGHKWFMSAPMCDAFLVLAQTGVGPTCFLVPRWKPDGTRNTIRIRRLKDKLGNRSNASSEVEFENTHAELLGEEGRGIPTIIEMGNYTRLDCAIGSSGLMRQAVAQAIHHAQYRTTFQKHLIDHALMANVLADLAIEAEAATLLALRLAQAYDEEGEAAVTFRRVATPAAKFWICKRAPTFAAEAMEVLGGNGYVEDFNLARIYREVPVNSIWEGSGNIMCLDVLRALARASLAVGVLADEMRDAATADRRLARFIDRMRAAAASAHDEAQARSFVRDLVVALQASLLIRHAPQMVADAFCASRLGGGSGAFGMLPPGVDTRRIVARAAPMLH

SEQ ID NO: 1816 - protein, 404 aa, Mycobacterium rhodesiae
MAINLEMPRKLEAVIEKAHQGAAEMLRPISRKYDVAEHAYPVELDTLATLFEGISEANTISFAGAEAFRDSDDGPKGNINGGNMSALLNALEISWGDIALLLSVPRQGLGNAAISGVATDEQLERLGKNVWAAMAITEPSFGSDSAAVSTTAVLDGDEYVINGEKIFVTAGSRATHIVVWATLDKALGRAAIKSFIVPREHPGVTVERLEHKLGIKASDTAVIRFDNARIPKENLLGDPEIHVEKGFAGVMETFDNTRPIVAAMAVGVARAALEELRTILTEAGVEISYDKPAHAQSAPAAEFLRMEADWEAGYLLTVRSAWQADNAIPNSKEASMGKAKAARVASDITLKAVELAGTAGYSEQTLLEKWARDSKILDIFEGTQQIQQLVVARRLLGLSSTELK

SEQ ID NO: 1817 - protein, 414 aa, Mycobacterium rhodesiae
MSSDLQSFARQAEDWLAQHLPRRVAGKEQVGPDDVAVFHNLTHDHEARLVADAAAWQAQKWQAGYGAIDWPSEFGGLDLTAEHARLFGAIEAGFEVPADHELRRITTNLVAPTLRKYGSAAQIDQLMMDLLSCRQLTCQLFSEPGAGSDLAGLATRAVRATDNSWIINGSKVWVSGAQFADWGLLIARTDPDVPKHAGLTAFLVPMNSPGLEVRPIRQMSGGTSFNEIFFTDVRVPDGRRLGPLGAGWQVTLTMLAFERNQSGSKAGVGGSWEQLLMLARLRERTTDPVVAQELVNVYIHERVRELTRRRAAQARAIGSEVGPEGSLGKLLWAQGLTAIGNAAAQLLGPDILADTGESGTYAWASHLLGAPGFRIAGGSDEIQRNIIAERVLGLPPEPRVDTGVPWRELRSSVG

SEQ ID NO: 1818 - protein, 579 aa, Mycobacterium rhodesiae
MTGTGELLFNPNTYDPRQFDPVTRRQLRALIDWFEERGKTRLLQDDLDAVWVADFLDFIKRARIFATFLTPSEFGVGDDNKRWDTSRNAALSEILGFYGLAYWYAEQVTILGLGPIWQSDNIKAKQRAAEQLEAGGVMAFALSERDHGADIYNTDMILTPAEADAEGVVFRATGQKYYIGNGNVAGMVSVFSRRADIDGPEGYVWFVADSSHPAYQLIGNVVHGQMFVSNFVLQDYPVHTEDILCTGPEAFSVALNTVNIGKFNLCTASIGMCEHAFYEAITHADNRILYGNPVTDFPHVRASFVDAYARLIAMKLFSDRAIDYFRTASLDDRRYLLFNPVTKAKVTSEGETVVRILWDVLAAKGFERNTYFSEVRQMIGALPRLEGTVHVNVAQILKFMPNYLFNPGSYPQIGTRDDPADDVFFWAQGPAKGASKVQFADWVPVFERASGIPNVACFTEQVRALQVLLTTAAPDAEQQRDLDFMLVIGHLFTLVVYGQLILEQAELRGLDHDLVDQIFDVQVRDFSGYVVALHGKASSTPAQQDWAISAVRKPVADTERFDRVWQQVRAYDGAYEMRP

SEQ ID NO: 1819 - protein, 567 aa, Delftia sp.; identical to SEQ ID NO: 1788

SEQ ID NO: 1820 - protein, 694 aa, Cellulomonas fimi; identical to SEQ ID NO: 1790

SEQ ID NO: 1821 - protein, 552 aa, Bacillus coagulans; identical to SEQ ID NO: 1811

SEQ ID NO: 1822 - protein, 834 aa, Rhodothermus marinus; identical to SEQ ID NO: 1782

SEQ ID NO: 1823 - protein, 558 aa, Rhodothermus marinus; identical to SEQ ID NO: 1783

SEQ ID NO: 1824 - protein, 659 aa, Zea mays
MASSGLAYPDRFYAAAAYAGFGAGGATSSAAISRFQNDVALLLYGLHQQATVGPFNVPKPRAWNPVEQSKWTSWHGLGSMPSAEAMRLFVKILEEEDPGWYSRVPEFNPEPVVDIQMHKPKDEPQSVPASTNGTSISEPKIISENGSSVETQDKDVILEGLSTVISHDEWTPLSVSGLRPKPRYEHGATVLQNKMYIFGGNHNGRYLSDLQALDLKSLIWSKVDTKFQAEPADSTKTTQIPPCAGHSLISWGNKFLSIAGHTKDPSEGITVKEFDPHTCTWSIAKTYGKPPVSRGGQTVTLVGTTLVLFGGEDAKRCLLNDLHILDLETMTWDDVDAIGNPPSPRSDHAAACHADRYLLIFGGGSHATCFNDLHVLDLQTMEWSRPKQQGLTPSPRAGHAGATVGENWYIVGGGNNKSGVSETLVLNMSTLTWSVVSTVEGRVPLASEGMTLVHSNYNGYDYLVSFGGYNGRYSNEVYTLKLSLKSDSQPIVEEETVSDTISRVREPETEISQDGRIREIAMDSADSDLNNRNDEASEQLVADLKAQKEELEATINREQLQTVQLKEDIAQAETRNAELTKELQAVRGQLASEQSRCFKLEVDVAELRQKLQSMDALEKEVELLRRQKPASEQAALDAKQRQGSGGMWGWLAGSPPPSQ

SEQ ID NO: 1825 - protein, 655 aa, Oryza sativa
MASSGLAYPDRFYAAAAYAGFGAGGATSSSAISRFQNDVALLLYGLYQQATVGPCNVPKPRAWNPVEQSKWTSWHGLGSMPSAEAMRLFVKILEEEDPGWYSRVPEFNPEPVVDIEMHKPKEDPKVILASTNGTSVPEPKTISENGSSVETQDKVVILEGLSAVSVHEEWTPLSVNGQRPKPRYEHGATVVQDKMYIFGGNHNGRYLSDLQALDLKSLTWSKIDAKFQAGSTDSSKSAQVSSCAGHSLISWGNKFFSVAGHTKDPSENITVKEFDPHTCTWSIVKTYGKPPVSRGGQSVTLVGTTLVLFGGEDAKRCLLNDLHILDLETMTWDDVDAIGTPPPRSDHAAACHADRYLLIFGGGSHATCFNDLHVLDLQTMEWSRPKQQGLAPSPRAGHAGATVGENWYIVGGGNNKSGVSETLVLNMSTLTWSVVSSVEGRVPLASEGMTLVHSNYNGDDYLISFGGYNGRYSNEVFALKLTLKSDLQSKTKEHASDGTSSVLEPEVELSHDGKIREIAMDSADSDLKDDANELLVALKAEKEELEAALNREQVQTIQLKEEIAEAEARNAELTKELQTVRGQLAAEQSRCFKLEVDVAELRQKLQSMDALEREVELLRRQKAASEQAALEAKQRQSSSGMWGWLVGTPPDKSES

SEQ ID NO: 1826 - protein, 668 aa, Arabidopsis thaliana; identical to SEQ ID NO: 1100

SEQ ID NO: 1827 - protein, 655 aa, Oryza sativa; identical to SEQ ID NO: 1825

SEQ ID NO: 1828 - protein, 659 aa, Sorghum bicolor
MASSGLAYPDRFYAAAAYAGFGAGGATSSAAISRFQNDVALLLYGLHQQATVGPCNVPKPRAWNPVEQSKWTSWHGLGSMPSAEAMRLFVKILEEEDPGWYSRVPEFNPEPVVDIQMHKPKDEPQSVPASTNGTSIPEPKIISENGSSVEIQDKDVILEGLSTVSSHDEWTPLSVSGLRPKPRYEHGATVLQNKMYIFGGNHNGRYLSDLQALDLKSLTWSKVDAKLQAESADSTKTTQIAPCAGHSLISWGNKFLSIAGHTKDPSEGITVKEFDPHTCTWSIVKTYGKPPVSRGGQTVTLVGTTLVLFGGEDAKRCLLNDLHILDLETMTWDDVDAIGTPPSPRSDHAAACHADRYLLIFGGGSHATCFNDLHVLDLQTMEWSRPKQQGLTPSPRAGHAGATVGENWYIVGGGNNKSGVSETLVLNMSTLTWSVVSTVEGRVPLASEGMTLVHSNYSGYDYLISFGGYNGRYSNEVYTLKLSLKSDSQSTVNEETVSDTTSRVIEPEAEISQDGKIREIAMDSADSDLNNRNDEASEQLIADLKAQKEELEATLSREQLQTVQLKEDIAQAETRNAELTKELQAVRGQLASEQSRCFKLEVDVAELRQKLQSMDALEKEVELLRRQKAASEQAALDAKQRQSSGGMWGWLAGSPPPTV

SEQ ID NO: 1829 - protein, 659 aa, Sorghum bicolor; identical to SEQ ID NO: 1828

SEQ ID NO: 1830 - protein, 685 aa, Oryza sativa; identical to SEQ ID NO: 733

SEQ ID NO: 1831 - protein, 700 aa, Pongo abelii; identical to SEQ ID NO: 351

SEQ ID NO: 1832 - protein, 761 aa, Homo sapiens
MVILEAPHLLRRKEPETPGLSSRIGPSLCPGFCRKRSVSCCFQNLCNNPMEKIISQCRFFVSMNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 1833 - protein, 438 aa, Mus musculus
MSLRGVSARLLSRRSGLRFPRFPRTWSSAAAHTEKTQIRPAKSSRPVFDWKDPLILEEQLTADEKLIRDTFRNYCQERLMSRILLANRNEVFHRDIVYEMGELGVLGPTIKGYGCAGVSSVAYGLLTRELERVDSGYRSMMSVQSSLVMHPIYTYGSEEQRQKYLPGLAKGELLGCFGLTEPNHGSDPGGMETRARHNPSNQSYTLSGTKTWITNSPVADLFIVWARCEDNCIRGFILEKGMRGLSAPRIEGKFSLRASATGMIIMDSVEVPEENVLPNVSSLAGPFGCLNTARYGITWGVLGAAEFCLHTARQYALDRIQFGVPLARNQLVQKKLADMLTEITLGLHACLQLGRLKDQDKATPEMVSMLKRNNCGKALDIARQARDILGGNGISDEYHVIRHAMNLEAVNTYEGTHDIHALILGRAITGIQAFTVGK

SEQ ID NO: 1834 - protein, 408 aa, Sus scrofa
KGGKTQGRSAKSSRPEFDWRDPLVLEEQLTADEILIRDTFRTYCQEHLMPRIVLANRNEVFHREIISEMGELGVLGPTIKGYGCAGVSSVAYGLLARELERVDSGYRSAMSVQSSLVMHPIYAYGSEEQQQQKYLPRLAKGELLGCFGLTEPNHGSDPGSMETRALHNPSNRSYTLNGAKTWITNSPVADLFVVWARCEDNCIRGFLLEKGMRGLSAPKIEGKFSLRASATGMIIMDDVEVPEENVLPKASSLAVPFGCLNNARYGISWGVLGAAEFCLHTARQYTLDRIQFGVPLAKNQLIQRKLADMLTEITLGLHACLQLGRLKDQDKVTPEMVSLLKRNNCGKALDIARQARDMLGGNGISDEYHVIRHAMNLEAVNTYEGTHDIHALILGRAITGIQAFTTDK

SEQ ID NO: 1835 - protein, 403 aa, Sinorhizobium meliloti
MGNISQFAGKTKPTPHRIESEEEALAIARELALRFSDRASERDLERVLPHDELDQLAQSGLLAISIPSEYEGIDVSNVVLAEITAILSEADSSIGQIPQGHFYVLEALRQHATEEQKQFFFGRAMAGDRFGSALSESGDKIIGDDKTQITGNGAGYRINGRKQYCTGVLFADWLAISALDAADRMTISFVPRAAEGVRIIDDWDSFGQRVTGSGTAVLENVHVDLGSVVPHHRGFERPNTVRSVGQIIHAGVDLGIARAAFRETLDLVRDAAAAKGSGMERASEDALTTARVGEVAIRLEAATALIEHAGRKVDTAQVDPTEEHAVEASLSVTAAKVLAAEAALEAANALFDLAGSASAKVALNLDRYWRNARAHALQDPVRWKHHLVGNYHLKGVKPRSGLL

SEQ ID NO: 1836 - protein, 403 aa, Sinorhizobium meliloti
MGNISQFAGKTKPTPHRIESEEEALAIARELALRFSGRASERDLERVLPHDELDQLAQSGLLAISIPSEYEGIDVSNVVLAEITAILSEADSSIGQIPQGHFYVLEALRQHATEEQKQFFFGRAMAGDRFGSALSESGDKIIGDDKTRITGNGAGYRINGRKQYCTGVLFADWLAISALDAADRMTISFVPRAAEGVRIIDDWDSFGQRVTGSGTAVLENVHVDLGSVVPHHRGFERPNTVGSVGQIIHAGVDLGIARAAFRETLDLVRDAAAAKGNGMERASEDALTAARVGEVAIRLEAATALIEHAGRKVDTAQVDPTEEHAVEASLSVTAAKVLAAEAALEAANALFDLAGSASAKVALNLDRYWRNARAHALQDPVRWKHHLVGNYHLKGVKPRSGLL

SEQ ID NO: 1837 - protein, 818 aa, Serratia plymuthica
MMVLSIVVLLALIGVVFYHRVNLTLSSLILLAYTAAMGVIGLWTFWMLLPLAIVLLPLNVTSLRRSMLSAPALRAFRKVMPPMSTTEKEAIEAGTTWWEGDLFRGQPDWNKLHNYPKPQLTAEEQAFIDGPVEEACRMANDFQITHELADLPPELWAYLKEHRFFAMIIKKEYGGLDFSPYAQARVLQKLSGVSGILAITVGVPNSLGPGELLQHYGTDEQKNHYLPGLARGDEIPCFALTSPEAGSDAGAIPDVGTVCMGEWQGEQVLGMRLTWNKRYITLAPVATVLGLAFKLYDPNHLLSTNESPGITCALIPTSTPGVEIGNRHFPLNVPFQNGPTRGNDVFVPIDYIIGGPKMAGQGWRMLVECLSVGRGITLPSNSTGSVKSMALAIGAYAHIRRQFKISIGKMEGIEEPLARIAGNTYVMDAAATLITSGLMLGEKPAVLSAIVKYHCTHRGQQAIIDAMDIAGGKGIMLGKSNFLARAYQGAPIAITVEGANILTRTMMIFGQGAIRCHPYVLDEMAAAQSNDLNAFDKSLFGHLGHVGSSKVRSFWLGLTNGRTSSTPTKDATRRYYQQLNRLSANLALLSDVSMGVLGGSLKRRERISARLGDILSQMYLASATLKRFEDEGRQKEDLPLVHWGVQDSLHQAEQALDDLLRNFPNPFIAGVMRFVIFPFGRVHTAPSDRLDHQLAKIIQQPSATRSRLGRGQYLTPSEHNPVGLLEAALTDVIAAEPIHLRLCKESGKNLPFTRLDRLAQRALEEGKISADEAKILVKAEESRLRSINVDDFEPDALAANKPEKPVAPSKRQQHTEAA

SEQ ID NO: 1838 - protein, 701 aa, Microbacterium laevaniformans
MTDAAVRPKKPATSTRTPAGGAPTAAHTAAEAHESRIHVDTVTDLLLGTWAQTRREAREMIKDPALWKIEGLSVADHRERVFGQLQILVDNNGSRRAFPKKYGGLEDNGANLAGFMELVLADPSLQIKSGVQWGLFGSAIYQLGTEKHHEAWLRDVIELTLPGAFAMTEIGHGSDVAAIGTTATYDPETEEFVINTPFRGAWKDYLGNAAVHGRAATVFAQLITGGVNYGVHCFFVPIRDDDGTMLPGVQSEDDGVKGGLNGIDNGRLAFDHVRVPRFNLLNRYGDVAADGTYSSDIPSPGRRFFTMLGALVQGRVSLDGAATTATALALHIAITYAGQRRQFDSGSGSDEVVLLDYGKHQRRLLPRLAQVYAQFFANDELLRTFDGVFSGRTDTPDERENLETLAAALKPLSTWNALDTIQECREACGGSGFMADNRLVGLHHDLDVYATFEGDNNVLLQLVGKRLLNDFAKQFKGADAAKLASFAAKQTAGKVFHGAGLRQLGQAVTDFGSTARSVELGLRAEQQHELLAGRVRQMIEDIAGRLRPASKASPAEAAAIFNANQAELIEAARAHGELLQWEAFSDGIAGIADAGTAQVLGWLRDLFGLHLIEKHLAWYLINGRLSAQRAASVSKYIDRLLLRLRPHAQDLVDAFAFEPEHVRAPIASGAEQERQAEARAYYADLAASGEAPVSEKSLKKK

SEQ ID NO: 1839 - protein, 818 aa, Serratia plymuthica; identical to SEQ ID NO: 1837

SEQ ID NO: 1840 - protein, 818 aa, Serratia sp.; identical to SEQ ID NO: 1837

SEQ ID NO: 1841 - protein, 445 aa, Pseudonocardia dioxanivorans
MSIDFELTRRQRALKYDVREFAREVLRPAAERADAMSDAQAAFVAMKPAFEQAYMMGLATSFLPREYGGGGASNVDMVIATEELCAVDAGFATIILVNGLALLPVVWFGTERQRERWITAATGCPTMDHLGGWVVSERGGTANFDHPHPSAGIQLFAHHDKANSEYVLNGEKHWPCNAGGWDLRGADTNVCIVRTDRTRGGTQALSAVVVDRGTPGLEYEVIDKIGLRTCQNVTMRFDDVRVPEENLFAEGNGDLVVNRAFTWSAPMASAAAVGVARGAYEFALKWAKTYTGGGSSPIIAHQAVGHLLTEIAARIEAGRYMCWKAAHYLDRHDGQGHALAAMNKVYCADLMKDVVVDCMRIVGVNALDRKFGMEKFYREAIVFPLYDAGNLGMQRRKSWGVMADPAFTPDLFADDDPFAFTKSMEGYGVLGGSPADAAPPRFRTT

SEQ ID NO: 1842 - protein, 412 aa, Pseudonocardia dioxanivorans
MPIDFTPSDEQRAVRARAREFARDVLSRVAKETHGLATARERYVATRPFYEEMVRAGFLRLLVPQALGGDGTGAVTVAILAEELIGGDPSVALSLFSTSLGLAPLLRGGSPEQHERFLGPFLRTEGAPVASLAFSEPGGSANYLSTAPGTGLRTTARARGGSLVIDGTKQWVSGATGWDGTGPDLMSVACRLTARRAADRGVAVVAVPGPVEGLRVTGELDPLGHRAHLLPRFDLVGVTVPRENVLGGPGEGPALLASAFGGAAVGACAVGVMRAAFAHALDFARSDRRGGPVPVIDHQGVAFVLADVKTRIKATRALTWRACHAADRREPYAEELGIHAKVFGSEAAVQSLTELMRVVGVQSYSHESPLAGLMADALAYPLFSGGNIGFRRRRLQEIFSDPGYDAVATADA

SEQ ID NO: 1843 - protein, 442 aa, Pseudonocardia dioxanivorans
MPEGDIVAVDFALTDRQRALKRNAREFAREVLRPAAEAADRIADPHEAFRAMKPVYEQAAAAGMTTMFLPAEYGGGGASNVDFLIAIEELCAVDPGFPTILLVNGLALMPVLWHGTDEQRERWLGYATGPRRSDFLAGWAVSERGGTANFDHPSPRAGIQLLAELDAATDEYVLTGEKHWPCNSGGWDLDGADMSVCIVRTDRSGGGTEALSAIIVERGTPGITYESIDKLAHRTCQNVTMTFRGARVPAANLLCPGDGDLLISRNFTWSGPIAAIASVGVARGAYDFALKWAKSYTGGGAGPIIEHQAVGHLLTDIAARIEAARYFCWKAAHYLDAHPDGGHAIGAMNKTFCGDLMQRVVFDCMRLVGVNALDTRFPLARLYRESVVFPLYDAGNLGMQRRRAWGVMADRGFSPDTFVDGDPLPFTKAMEGYGAGGVPGLP

SEQ ID NO: 1844 - protein, 701 aa, Arthrobacter phenanthrenivorans
MTEVVDRPAGKGQRPAASSTVPATTQPVVDVEALGRQLLGKWAAVRVQARDLAARPELHKIEGLTHTEHRTRVFGQLKYLVENEAVHRAFPTALGGSDDHGGNIAGFEELVVADPSLQIKAGVQWGLFGSAVMHLGTAKHHAKWLPGIMNLDIPGCFAMTETGHGSDVASIATTATYDLSTEEFVVHTPFRAAWKDYIGNAAIDGLGAVVFAQLITRGVKHGVHAFYVDLRDPETKEFLPGIGGEDDGAKGGLNGIDNGRLHFTNVRIPRTNLLNRYGDVAPDGTYTSPIASPGRRFFTMLGTLVQGRVSLDGAAVAASKVALQAAVRYATERRQFNASSHTDEEVLLDYQRHQRRLFTRLATTYAAGFAHEQLLQKFDDVFSGAHDTDADRQDLETLAAALKALSTWHALDTLQECREACGGAGFLIENRFASLRADLDVYATFEGDNTVLLQLVAKRLLADYAKEFRNVDFGVLARYVVGQATGAAIHRTGLRQVAQFMADTGSVQKAAIALRDEEGQRALLTDRVQTMVAEAAAALKGSNRLSQEQGAALFNRHQNELIDAAQAHAELLQWEAFTDALREVEDSGTRIVLTWLRDLFGLSLIEKNLSWYLMNGRLSMQRGRTVGEYINRLLVKIRPHALDLVDAFGYSGDHVRAAIATGAEKQRQDEARAYFRSQRASGGAPVDEKFLLARTVPGKRN

SEQ ID NO: 1845 - protein, 425 aa, Acidovorax avenae
MTAHTPQERHSLQQAAPTLPASPVPPPPARRPPVLATPGQILGAAAALAREWAPQAPARDRERRLPWTEIEAYSASGLWGITVPQAHGGPGADAWTLAQTIATVSAADGSLGHIPQNHFYALEVLRVGGTEAQQRFFHGRVLQGERFGNALSETGHRDYRRRTRLERSGSGWVLHGRKSYCTGAIFAHWIPTQAMQQLDDGREASVIAFVPRHAPGVTVEDDWDGMGQRVTGSGSVALDGVRVEPEWIVPFQASFERPTAIGPFAQIMHAAIDLGIGEGALQAALPFIRTRARPWIDAQVEHATDDPLTLHAVGDVDLRLRAARAMLRRAARFVDTARHAPDEDAVAAASVAVAEARALAHRAGLLAANKLLELGGTSATAAEHGFDRFWRNVRTHTLHDPVRWKYHAVGNYLLNGTRPPRHGAL

SEQ ID NO: 1846 - protein, 663 aa, Kytococcus sedentarius
MTTTPTPELTAAITACLDGHWAGTRQRIRAEVDPHTVLLPAEGSLEDKRAATTAALLQLAEQDLAGMGYAETGGARNDVGGTVVAFETIAALDLSLTVKMGVQFGLFGGAISNLGNPEQHAAWLPLTGSGELLGCFAMTEVGHGSDVQSLETTATYDAATGEFVIDSPTRSSTKTYIGNAARDGQMAVVFAQLITPDDDSLPDGIEDDDPTHRGIHALVVPIRDEAGQPMPGVTLGDNGAKGGLPGVDNGTISFDAVRVPRGNLLDRFGAVDAQGVYSSPIDSPGRRFFTMLGTLVRGRVSVGGGASSAARAGLTIATRYAAQRSQFDGPDGEVTLLDYRAHQRKLLPAIARSYAFAFAQNELVETLDEIQTADPADRDERAQRELESRAAGLKAVQTEEANRVLQLCREACGGAGYMATSGLTQRRMDADVFATFEGDNTVLLQLVAKGLLTNYSKAIGSLNMTGMLRFGATQFSGVVIERTAAKGFVNRLVEAARRRDTEDVVMDRAWQVECFEFREKHLLETAAQRMRRADRGTEAEQFAAFNDVQDHLLLAARAHIDRVVLEAFAQQVEECEDPALTELLDQVCDLYALSVIEENAAWFLEHEHMRPAKSKSVTSTINALCADLRPHAVTLVDAFAIPDAWLASTLLDGQDDAGLVRED

SEQ ID NO: 1847 - protein, 713 aa, Brachybacterium faecium
MTTDSRTAAASRTTESGTTADPTGPIPLPPGGSPRLDVEQVSEALLGQWAEARRTARERAARPELHRPLDATVAEHRDRVFGQLQLLAEEDVSRPMLPEHLGGPNDNGANVAAFEELVVADPSLQIKAGVQWGLYTSAIVQLGNEEQQQAWVPGAMDLTTPGAFAMTEIGHGSDVQSLATTATYDPSGGEDGEWVIHTPFRAAWKDFLGNAAIHAKAATVFARLITKGVDHGVHCFYVPVRDAEGELLPGVSSEDDGPKGGLNGIDNGRLAFDHVRIPRTNLLGRYGDVAADGTYTSPIESPGRRFFTMLGTLVQGRVSLDGSAIRASQLALHIAITYATQRRQFTAADPTQETVLMDYQAHLHRLLPKLAATYAGAFAHEQLLQAFDDVFSGRAEDPESREDLETLAATLKPTSTWLALDTIQECREACGGSGFMAENQLVGLHQDLDVYATFEGDNTILLQLVAKRLLSDYTSELKNVDRAGIGRFIAQRAEVLAKRHTPWARLGQNVADRGNARRAFDSMRQAEFQEEMLADRARVKVEEVALALRGAAKMSPADAAAEVNKHQVEMLDAARAHADLVRWRAFTTGIEALEDEGSRAVLTDVRDLFGLTAINDDLAWFLLSGMISAQRGRQIEGDLRRLLWRLRPHVLDLVAAFDVRPGHVRAPIALGGEQERQDEAAAHFRAQRASNDAPVSEKALRDRAKKAARARTR

SEQ ID NO: 1848 - protein, 602 aa, Desulfobacterium autotrophicum
MAEWIADKKEIDFILYEMFDAETLLQHDKFKDFSKKMFDMVISEARKLAIKEILPTLADSDQNGARFENGQVKAPESFHRARKAVIEAEFTSPTEDPAWGGQGLPYLISIAMMEYVIGANYALSSYVNMGHGTGKMIEIFGTDRLKALFVENLYTAHWSGTMLLTEPEAGSDVGALTTSAKKNPDGTYSITGNKIFITGGDHDLAENIIHPVLARVEGAPSGSKGISIFIVPKIWVNDDKSLGKNNDVQCTGIEEKMGMHGSATCSMSLGSKGNCRGFLLGQENQGLAIMFHMMNEARLNVGFQGSSAASMAYLYALDYAKQRIQGKALHDMKNPEAKSVPIIQHPDVRRMLTWMKAHVDGMRSLVFYVSNLFDTQGLFPDTPEGEQAGKLIELLTPIVKAYCAQRGFEVCVQAVQVHGGYGYISEFPVEQLVRDVKIASIYEGTDGIQAMDLLARKLGMDGGKVFTGLLEIIGKTIKSAQDNTTLAPLADELEKTVNALCLTAMVIGGTARSKKYATAFAHAYPFLDVIGDVCLGWMHLWRAKAAADALGNNTKGKSRLFYEGIIHTARFYIQTVLPVTLGKMNSVQALCDASLTIDQTAF

SEQ ID NO: 1849 - protein, 653 aa, Mycobacterium gilvum; identical to SEQ ID NO: 1711

SEQ ID NO: 1850 - protein, 701 aa, Microbacterium laevaniformans; identical to SEQ ID NO: 1838

SEQ ID NO: 1851 - protein, 548 aa, Streptomyces violaceusniger
MSATHEVLNQAPPLVGFSTADDPALLEALRRDGGGWGEPEVRDLGARAGSAEVQDWARMAEEHSPALHTHDRYGHRIDEVEYHPAYHQLMDVAVASGQHAAAWSETRPGAHLVRAAKFYAFAQAEPGHGCPISMTYAAVPALRAEPELAAVYEPLLAARTYDFGLRPPLAKRGLIAGMSMTEKQGGSDVRANTTQAVPDGAGGYALTGHKWFTSAPMSDVFLTLAQTEEGLTCFLVPRVLPDGSRNPLRLMRLKNKLGNRSNASAEIEYESAMAWRVGEPGRGVRTIVEMVNVTRLDCVIGSAAGMRAGLRQALHHAGHRRAFGAELIDQPLMRNVLADLAVESEAATTLAMRLATALDRAEAGDEGEAALRRLGLAVSKYWVCKRGSTHAAEALECLGGNGYVEESGMPRLYREAPLLSIWEGSGNIAALDVLRALSRESGALEAFLAEVDAAAGADARLDAAVDRLRGLLPQLADPERAQLMARRLAEQMTLALQGSLLVRYSHPAVADAFCASRLDGDWGHAFGTLPPGTDTGPILERARPKDAR

SEQ ID NO: 1852 - protein, 682 aa, Desulfovibrio sp.
MEILRTLPGDDVRQIMWRFADRFDLQMAVQSARSVARGLVARLVADGVRHSHEWTPEKDQLLQAFDDAGITSVFLDPHQGGYIEGPKNMALALVAFELSWVDAGAATCSLASNLALSPIHERGTTEQRDHYMSLCAPAPGKAPWRGAFGLTEPLPYVGVDTGVLCGKVRVDSWEDGQEPMLHIDKRGRFITGMDFANFATVAVDTADPRIKTSCMVILEETDPGLFDRGAPTLKMVHQLSSTRDPVFNMKVPASRIIGGYTVKDGCIVPNYSHSEIIAAVFHRTRVPVALMTTAKLLSAVEPVIRYQRTRFRGGDACADGTPKFELGLQQKQDAPIRLAELWAAGEAGASLGFATARLFDHLDPTEKAKEHALAAAGVTGMRAQLTALKKVQPQAVEYVNLLFAPEETRDAARFAALDADPVVKYQALEAEAGVLCPACKLWNTGYGATVMREAVAMMGGYGITEDCPGFLFHKWNDSQLEATYEGPECVQRRQLSITMASDIFLAYCDNYVAEMDRVAATNPETGAASVAAGFRVWRAAFDFLAAGKDADGKKLYHSTRQAVTFPLADALCPLLASRLLILDTLELAAKGPENPVVAEGLPGYVAFFSDLAKIQAAKAATEAARACAGLVHGYAPAGADLAAFAGLRQAVDASLAGLGAARERAGAAISQVMIPEALDYPM

SEQ ID NO: 1853 - protein, 816 aa, Brenneria sp.
MVAVSILLLLIIIGALFYHRLNLLLGSAILLAYFAAMAAILLWPAWLLIPLVILLLPFNLPPLRRRLFSSSALNLMQKVMPPMSNTEKEAIEAGTTWWEGDLFRGAPDWKKLHSYPPPRLTAEEQAFIEGPVEEACRMANDFEITHERADLPPELWAFLKQHRFFAMIIKKQYGGLEFSAYAQAQVLQKLAGVSSIVAITVGVPNSLGPGELLQHYGTDEQKDHYLPRLARGQEIPCFALTSPEAGSDAGSIPDSGVVCYGDWRGEQVLGMRLTWNKRYITLAPVATVLGLAFKLYDPDRLLGETEELGITCALIPTDTAGVQIGRRHFPLNIPFQNGPTQGENIFVPLDYIIGGPKMAGQGWRMLMECLSVGRGITLPANSTGGLKTIALGVGAYAHIRRQFKVSIGKMEGIEEPLARIAGNTYVMDAAATLITCGIMQGEKPAVLSAIVKYHCTHRGQRAVMDAMDITGGKGICLGPSNFLARSYQGSPIAITVEGANILTRSMIIFGQGAIRCHPYLLDEMAATQTKDVARFDRALFGHIGHIGGSAVRGFWLGLTDGRLSRAPVNDATRRYYQRLNRLSANMALLADVSLAVLGGSLKRRERISARLGDILSQLYLASATLKRYDDEGRQKADLPLVHWGVEDCLHQAEQALVDLLRNFPNRAAAGLLRFILLPLGRRCHAPSDRLDHQVAKLLQTPSATRSRLGRGQYLTASEHNPVGLLEEALRDIIAAEPIYQRLSQASGRHQPFMRLDELAEQALADGNITADEAEILIKAEASRLRSINVDDFAAHKLASQPQETATPARREKTQAA

SEQ ID NO: 1854 - protein, 417 aa, Frankia symbiont
MTDRPSDAGARPSSVAAAAAVVRSDAEALEIARKAAAGFAVHADARDRHRRLPMAEVDELSASGLLGITVPARFGGADVSVATLTEVFRVLAVADASLAQIPHSHFVFLDALRRRGGDEQQAFYFGEALAGRRFANAQSERGSRTIADDATTLRRRPGGGYVLRGEKYYCTGALFAHWLVVRAVLPDTPPRPGGAVPRALAYIRRDSPGVSVEDDWDGMGQRTTASGTVRLDDVPVTADQVVDFSSIFDGPTTYGARAQVLHAALDAGIARGALDAAVGQVARARPWFESDEQRAADDPLLVQQAGELEIAVRAAEALLREAAAAIDAAERDPTEASTARASVATAVAKVTAARAAVRAADELFELGGTRSAAGPLNLSRHWRDGRTHTLHDPVRWKVQHIGRWLLSGAPPPRHGQI

SEQ ID NO: 1855 - protein, 759 aa, Shewanella baltica
MLTIIILALIAIVVLFAVKNIRMQFITRPVFSFFKKVLPPLSDTEREAMEAGDVWWEGELFRGNPNWNTLHSYGKPTLSAEEKDFIDNQVMTALTMIDDFDIVHNRKDLPPELWEYFKKEGFFALIIPKKFGGKAFSAYANSTIVSKLASRSVSAAVTVMVPNSLGPGELLTHYGTSEQKERWLPALAKGDEIPCFALTGPEAGSDAGAIPDVGIVCRDTFNGEEMLGLKLTWDKRYITLAPVATVLGLAFQMRDPEGLLGDKKNLGITCALIPTDHPGVVIGRRHNPLGMAFMNGTTQGKEVFIPLDWIIGGPEFAGKGWRMLVECLSAGRGISLPALATASGHMATKTTTAYSYVRHQFGMAIGQFEGVQEALARIIANTYQLEAARRLTTTGIDLKVKPSVVTAIAKYHMTELGRSVMNDAMDIQSGKGIQLGPKNYLGHPYMSNPISITVEGANILTRSLMIFGQGATRCHPYVLAEMEAAAMENQHEALERFDALLMGHMGYATRNAFSALFSALSGSRFGSAPVSGETKQYYKDMSRISSALALMTDLSMLIMGGDLKRKEMLSARMGDVLSQLYLGSATLKLFEDNGRQQDDLPAVRYVMANRLHLAAKALEDTIRNFPSRPVAWLLRGLIFPLGNHFNAPSDKMATDLVGGMLKPGPARDRITFLCPEFEGDKGGIAEVEQAFVAQYACKDIYKKLKKAQRAGELPAKVPNLVLFAKALETGVITADEEQKLQHADKLRLAAINVNDFEAL

SEQ ID NO: 1856 - protein, 645 aa, Mycobacterium tusciae
MTTIAQHLRNALDGRWRDVKNQMREELSSEVFRPHYTPNTVIARTKVAEQLKIMASQGAAEDGFRKEHGGNGNVGAAVTQIEMLAMSDLSLMVKAGVQWGLFGGAVENLGTERHHEAYVQRIIDLDLLGCFAMTETGHGSDVQALETTATYDPASREFVIDSPTRTSRKDYIGGAAETARVAAVFAQLITPDGEGHGVHCFVVPIRDDEGNDLPGVTTSDCHYKGGLPGVDNGRIQFDHVRVPRENLLNKYADVAEDGTYSSPIENPGRRFFTMLGTLIRGRVTVGGSAGAAARVALDIATRYALERRQFEAPGEDNEVLIMDYLVHQRRLFPLIAKSYALQFAQNELVAKCHELQTADDPDPEEQRELESRAAGLKAANTWHATRAIQEAREACGGAGYMAENRLIALKADTDVFTTFEGDNHVLTQLVAKELLTTYADDIKGMSPVEWVRFAANFAGERVLKRTAAETIMQTILDTRQDNEEEGSLFNRGTQVKMFEDREEYMLSTVARRLQGKSKEMSAFDAFNSVQDHVLHTARAHIDRIILEAFVAGIDSCESTSVEGQEAREILNLVCDLYALTVIEEDRAWFMEHRFLSTERAKAVTRGINERCRDLRPHAELLVDGFGIPEQLRYAEMLHPENIVDT

SEQ ID NO: 1857 - protein, 759 aa, Shewanella baltica
MLTIIILALIAIVVLFAVKNIRMQFITRPVFSFFKKVLPPLSDTEREAMEAGDVWWEGELFRGNPNWNTLHSYGKPTLSAEEKDFIDNQVMTALTMIDDFDIVHNRKDLPPELWEYFKKEGFFALIIPKKFGGKAFSAYANSTIVSKLASRSVSAAVTVMVPNSLGPGELLTHYGTSEQKERWLPSLAKGDEIPCFALTGPEAGSDAGAIPDVGIVCRDTFNGEEMLGLKLTWDKRYITLAPVATVLGLAFQMRDPEGLLGDKKNLGITCALIPTDHPGVVIGRRHNPLGMAFMNGTTQGKEVFIPLDWIIGGPEFAGKGWRMLVECLSAGRGISLPALATASGHMATKTTTAYSYVRHQFGMAIGQFEGVQEALARIIANTYQLEAARRLTTTGIDLKVKPSVVTAIAKYHMTELGRSVMNDAMDIQSGKGIQLGPKNYLGHPYMSNPISITVEGANILTRSLMIFGQGATRCHPYVLAEMEAAAMENQHEALERFDALLMGHMGYATRNAFSALFSALSGSRFGSAPVSGETKQYYKDMSRISSALALMTDLSMLIMGGDLKRKEMLSARMGDVLSQLYLGSATLKLFEDNGRQQDDLPAVRYVMANRLHLAAKALEDTIRNFPSRPVAWLLRGLIFPLGNHFNAPSDKMATDLVGGMLKPGPARDRITFLCPEFEGDKGGIAEVEQAFVAQYACKDIYKKLKKAQRAGELPAKVPNLVLFAKALETGVITADEEQKLQHADKLRLAAINVNDFEAL

SEQ ID NO: 1858 - protein, 759 aa, Shewanella baltica; identical to SEQ ID NO: 1855

SEQ ID NO: 1859 - protein, 759 aa, Shewanella baltica; identical to SEQ ID NO: 1855

SEQ ID NO: 1860 - protein, 553 aa, Alicycliphilus denitrificans
MDWTTHHVFNQFPELYDYDPLATDPALCEALARTGAGWARPALNGYAARLGRTETYMLAEQANRHLPELRRFDSRGRRIDALEFHPGWHALMALYRGQGLVSQPFREARAGRWAAWAAGFYLHGQVEQGTLCPATMTQAAIPLLQKEPALWAQLQERLYSDAYDARDLPVQDKASIWLGMGMTEKQGGSDVRANTTVATAVGAGGRGGEYLLRGHKWFFSAPQCDAHLVTARVQEGGPFACFYVPRWRPDGSRNAVRVQRLKDKLGNRSNASGEVEFEDAWGVLMGEEGRGIPTIIEMAGYTRLNCVAGSAAILRQATVQAIAYARQRHAFGKALAEQPLMRAVLADLALESEASLVLLMRLAEAFEREGDGDPAQRAWKRAMTPAAKFWVCKRAVELTGEAMEVFGGNGYVEDGVMARLFREAPVNSIWEGSGNVMCLDVLRALAREPGAARALLAELQPAAQGEPRIAAALQGLQALLAASADELEALGRVLAQRLVLVAQACLLRAHAPACVADAFIATRLGDGGAGRVAGAIDTRGMDVDAILARAFPA

SEQ ID NO: 1861 - protein, 688 aa, Cellvibrio gilvus
MTTTAEPRHDRPSRTPLTTTAEPRVDVAALTDQLLGQYADLRREARAVAGLPDFHKVEPMPMAEHRDRVLHQLRELAAHHDVLRAFPAHLGGADDHGGSLSRFEELVAADPSLQIKAGVQWGLFASAILHLGTQRHHEELLPAAMSVDVPGAFAMTETGHGSDVSSIGTTAEYDPETGEFVLHTPFRAAWKDYLGNAAQHGTAAVVFAQLITAAPGGPRVNHGVHAFYVPLRDPATGEFLPGIGGEDDGFKGGLNGIDNGRLHFDHVRVPRDRLLNRYGDVAADGTYSSPIASPGRRFFTMLGTLVQGRVSLDGAAANASKIALAIAVTYANQRRQFAGAGADEVVLLDYQRHQRRLLPLLAETYAATFAHEELLAMFDEVFSGRGDTPEGREDLETLAAALKPSSTWHALRTLQECREACGGAGFLAENRLVGLHQDLDVYVTFEGDNTVLYQLVGKRLLGDYAKALKAGGAGDVARFVADRAVHRTPLIRAAQTLADVGDARRSAGQLRDEATQRELLTDRVEVMVAELAAALRPASKLPADQAAALVNAHQHELVEAARAHAERVLWEAFTRGVHAATDPGTQQVLTWLRDLFGLTLVERHLAWYLVNGRLSAGRARTVSSYIDRLLVRLRPHAQDLVDAFGYGPEHLRAPIASGAEAQRQDEARAHYRAERVAGREAVPEKHVR

SEQ ID NO: 1862 - protein, 602 aa, Desulfobacterium autotrophicum; identical to SEQ ID NO: 1848

SEQ ID NO: 1863 - protein, 653 aa, Mycobacterium gilvum; identical to SEQ ID NO: 1711

SEQ ID NO: 1864 - protein, 814 aa, Enterobacter asburiae
MMILSILATVVLLGVLFYHRVSLFLSSLILLAWTAAFGVAGLWNIWLLVPLAIILLPFNFTPMRKSMISAPVFKGFRKVMPPMSRTEKEAIDAGTTWWEGDLFQGNPDWKKLHNYPQPRLTAEEQAFIDGPVEEACRMANDFAITHEMADLPPELWAYLKEHRFFAMIIKKEYGGLEFSAYAQARVLQKLAGVSGILAITVGVPNSLGPGELLQHYGTEEQKDHYLPRLARGLEIPCFALTSPEAGSDAGAIPDTGVVCMGEWQGEQVLGMRLTWNKRYITLAPIATVLGLAFKLSDPEKLLGGEEDLGITCALIPTSTPGVEIGRRHFPLNVPFQNGPTRGQDIFVPIDYIIGGPKMAGQGWRMLVECLSVGRGITLPSNSTGGLKSVAMGIGAYAHIRRQFKISIGKMEGIEEPLARIAGNAYVMDAAASLITYGIMLGEKPAVLSAIVKYHCTHRAQQSIIDAMDIAGGKGIMLGEGNFLARGYQGAPIAITVEGANILTRSMMIFGQGAIRCHPYVLEEMAAAQNNDVDAFDKLLFKHIGHVGSNKMRSFWLGLTNGRTSSTPTGDATKRYYQQLNRLSANLALLSDVSMAVLGGSLKRRERISARLGDVLSQVFLASAVLKRYDDEGRQEADLPLVHWGVQDAMHQAEQAIDDLLANFPNRFVAGALRVVIFPTGRHHLAPSDKLDHKVAKILQVPSATRSRIGRGQYLAPTEHNPVGLLEEALLDVMAADPIHQKICKQLGKNLPFTRLDELAKQALAGGIIDKDEAATLVKAEESRLRSINVDDFEPEELATQPVKLPEKHRKPEAA

SEQ ID NO: 1865 - protein, 643 aa, Mycobacterium rhodesiae
MTTTAEHLRNTLDGRWRDVKNRMREELSGEVFKPHYTPNTVIARTKVAEQLKIMAAQGAAEDGFKKEHGGNGDVGAAVTQIEMLAMSDLSLMVKAGVQWGLFGGAVENLGTERHHEAYVQRIIDLDLLGCFAMTETGHGSDVQALETTATYDPATQEFVIDSPTRTSRKDYIGGAAETARVAAVFAQLITPDGEGHGVHCFVVPIRDDEGNDLPGVTTGDCHYKGGLPGVDNGRIQFDHVRIPRENLLNRYADVAEDGTYSSPIENQGRRFFTMLGTLIRGRVTVGGSAGAAARVGLDIATRYALERRQFEAPGEDQEVLLMDYLVHQRRLFPLIAKSYALQFAQNELVAKCHELQTSDDPDVEEQRELESRAAGLKAANTWHATRAIQEAREACGGAGYLAENRLIALKADTDVFTTFEGDNHVLTQLVAKELLTAYADDIKGMSPVEWVRFAANFAGERVLKRTAAETIMQTILDTRQDNEEEGSLFNRGTQVKMFEDREEYMLATVARRLQGKSKEMSAFDAFNSVQDHVLHTARVHIERIILEAFVAGIDACEDEEAREILNMVCDLYALSVIEEDRAWFMEHRFLSTERAKAVTRGINERCRNLRPYAEVLVDGFGIPEQLRYAEMLHPENIASPDSP

SEQ ID NO: 1866 - protein, 555 aa, Streptomyces griseus
MAATTHTVTNQVPPLVGHDVFAADRALSEAVERHVAPGVLPVALEELGELGRAAGSAQVQEWGARANAHPPVLRTHDRFGHRVDEVDFHPSWHRLLGHAVSAGLTDAWGRPAGHVRRAAGFLVWTQAEAGHGCPLSMTHAAVPTLRTDPALAAEWEPLLTSHTYVEGLRNPMEKAGALLGMGMTEKQGGTDVRSNTTRAEALSGADGYLLTGHKWFCSAPMSDGFLVLAQAAGGLSCFLVPRVLPDGTRNVFAIQRLKDKLGNRSNASAEVEFDGTWARRVGEEGRGVRTIIEMVAATRLDCVVGSAALMRQAVSQAVHHSAYRRAFGGLLIDKPLMRNVLADLALESEAATVLAMRLAAAYDEDTDEERAFLRLAVPAAKYWVTKRCSAVVGEALECLGGNGYVEESGMPRLLREAPLNSIWEGSGNVQALDVLRALQREPRALDAFLREVGRARGADHRLDAAIKGLLTELADLEGVEARARRVVERIALVLQGSLLVRWAPPEVSDAFCASRLGGDWGSAFGTLPHSLDLASVVARARPDADQRRGRGSDGG

SEQ ID NO: 1867 - protein, 645 aa, Mycobacterium tusciae; identical to SEQ ID NO: 1856

SEQ ID NO: 1868 - protein, 688 aa, Cellvibrio gilvus; identical to SEQ ID NO: 1861

SEQ ID NO: 1869 - protein, 417 aa, Frankia symbiont; identical to SEQ ID NO: 1854

SEQ ID NO: 1870 - protein, 818 aa, Serratia sp.; identical to SEQ ID NO: 1837

SEQ ID NO: 1871 - protein, 564 aa, Delftia sp.
MSTGQTLQTGHTWNTHDVLNQVDELTDFNLLEADPALAEALQRNGAARHIPSLSRYAQQLGERATWELAEQANRHTPELHRFDARGRIIDAVEFHPSWHTLLGLYRQQGLISLPFEDSSAGRWSAWAAGFYLHGQVEQGTLCPATMTTAAIPLLQKEPALWQQLQGKLFSHEYDPRDLPVADKASMWLGMGMTEKQGGSDVRANTTVAMPVHAGGRGGEYLLRGHKWFFSAPMCDAHLVVARMGEGGGQACFYVPRWRPDGSRNAVRVQRLKDKVGNRSNSSSEVEFEDAWGILMGEEGRGIPTIIEMATYTRLNCVLGSAAILRSATVQALAYARRRSVFGKQLAEQPLMRTVLADLALESEAALQIAMRLAQAYERGGDEGDPLEQAWKRIMTPAAKFWVCKRGVELTGEAMEVLGGNGYVDTGVMARLFREAPVNSIWEGSGNVMCLDVLRAISREPDGAQLLLQDLIDTAAGEPALLQQAQSLARRLSGPPDQLEAQARRLVQDLVLLAQACLLRRHAPPAMADGFIATRLGAQQGAMVAGAFDPAGLDIAAILQRALPA

SEQ ID NO: 1872 - protein, 818 aa, Serratia sp.; identical to SEQ ID NO: 1837

SEQ ID NO: 1873 - protein, 671 aa, Marinomonas posidonica
MSDESPTSISAQALKAAGDLAQAEDVAVLEQAADAASRHLATTRSSLIERMIYGPKPAIKELLSGVDNMKQSVTSEASSILQAGLSCLQQGEAFGEDEKITSVLRNAVAKEGAYGFTVPTQYGGQGKRYSEFACLMENFAANGLGALSVEISGQLTIGSSALLGYGTEAQKSKYLPVISGGQLIAFALTEVGVGVNAKRVKAYVEDDKENACWRLFAEGECNKLYITSATHGGLMAIVARKGKDSKELALFVTELPEEDIDGEFSFYCQSSNVTAFQQNINSRIHFKNFPIPYEQEILGNGVEVLFYCLRMGRCMLAAQAAGFQRMMAADAVNYAAQREGVGGKVIKHELPRLALAKILGGALTAQALSHLALAQDQNKVDLAGLRDVTKSASAHYLLGSLIACERVMGGRSLDKGSRISDIRATAHAFGIVEGEDDLIRLGMVRDLTKSFTESYMAGLLALLQRANTDKNGRSVAKEKRILKLSLGHFFKSPIRMSNLLLSLVMSAGFWRLLGWITRNSALSLIDRCAQWLPSRLIKRYSSIPSPLKPHLRFAEYQLRQCRWHYFKISAAYQLELTQAQLPLQQLGKRIETLVCIAALCAHASQLDESTQRIALAKIEILRSELEGNSMSVKRMESVRSSVKEVAEDILKEECSLIQSIKAQPFAHPWGE

SEQ ID NO: 1874 - protein, 553 aa, Alicycliphilus denitrificans; identical to SEQ ID NO: 1860

SEQ ID NO: 1875 - protein, 445 aa, Pseudonocardia dioxanivorans; identical to SEQ ID NO: 1841

SEQ ID NO: 1876 - protein, 412 aa, Pseudonocardia dioxanivorans; identical to SEQ ID NO: 1842

SEQ ID NO: 1877 - protein, 442 aa, Pseudonocardia dioxanivorans; identical to SEQ ID NO: 1843

SEQ ID NO: 1878 - protein, 701 aa, Arthrobacter phenanthrenivorans; identical to SEQ ID NO: 1844

SEQ ID NO: 1879 - protein, 669 aa, Mycobacterium vanbaalenii
MRHHGLRIPRDGYRPDMTTTAEHLRNSLDGRFRDVKNRVRRELSDEVFRPHYTPNTVIARTKVAEQLKIMAAQGAAEDGFKKEHGGNGDVGAAVTQIEMLAMSDLSLMVKAGVQWGLFGGAIENLGTERHHKAYVKKLIDLELLGCFAMTETGHGSDVQSLETTATYDPATEEFVIDSPTRTSRKDYIGGAAETARVAAVFAQLITPDGETHGVHCFVVPIRDDDGNDLPGVTTSDCHYKGGLPGVDNGRIQFDQVRVPRENLLNRYADVAADGTYTSPIENPNRRFFTMLGTLIRGRVTVGGSAGAAARVALDIATRYALQRRQFSDPDGGEVLLMDYLVHQRRLFPLIARSYALQFAQNELVAKCHELQTADDPDPEEQRELESRAAGLKAANTWHATRAIQEAREACGGAGYMAENRLIALKADTDVFTTFEGDNHVLYQLVAKELLTAYADDIKGMSPVEWVRFAASFAGERVLKRTAAQTIMQTVLDTRQDNEEEGSLFNRGTQVKMFEDREEYMVASVARRLQGKAKEMSAFDAFNSVQDHVLHVAQAHIERVVLEAFVAGIDACEDRLAREILGMVCDLYALSVIEEDKAWFVEHRFLSTERAKAVTRGINDRCRRLRPYAELLVDGFGIPEQLRYAEMLHPEHIPDADEHTRQDATSAGTI

SEQ ID NO: 1880 - protein, 657 aa, Nocardioides sp.; identical to SEQ ID NO: 532

SEQ ID NO: 1881 - protein, 617 aa, Caenorhabditis elegans
MHRALIRLQKLHKCNVRCLSDAAKSKEVAGISEKSKFAIRTLDNTSSIEKRSLSRGFAMNKFEKDFMIYPEYTDSDDVRNIEGFVDVLRKSLELSVDSKLIEKEGKLASDTIEALRSNAIFSLAIGKYFDGIGMCNKDLSKVFEELSVDWNVYTTSHISLLVANILTIYGSDEQKSKYLGILGSGKLRPAVAIVKDTNGGVCEQTAGPGGKSMLNGQNIRVMGHHNANFYVVFGNNNGEKTCFLLDEAELGTTDKIQFTRDETIGLKGIDVGRIELTALVTDKNLLGTPGHGSEIASELVGSGRMPFAAATIGMARRALRELSIWCNRTPSRQNDRTTLADDSRSQRIVTELALKVYALESSLYYLSGLIDEGLSVVVDIENSLLSIMTRDVLQAVISAQLELVGVAASDASFPHEKLFRDVTTLLSIIDEGADVEQIGLATIATWATSTSHKRVVSTLKRWLKNEKEADELRNPGLSHYIAEHAHPSLQLACQELEFSMSRINNVVSKLLTSQGKNIEQDYGSLEALVNVLKNNLVMVSTISRASRSYSIGLRNADIELAWATIICSRLSRATWFELDSLSDLFGLVRFNPSLLNAGRAVFDLGGYIIESPLEKNW

SEQ ID NO: 1882 - protein, 643 aa, Mycobacterium rhodesiae; identical to SEQ ID NO: 1865

SEQ ID NO: 1883 - protein, 548 aa, Streptomyces violaceusniger; identical to SEQ ID NO: 1851

SEQ ID NO: 1884 - protein, 403 aa, Sinorhizobium meliloti; identical to SEQ ID NO: 1836

SEQ ID NO: 1885 - protein, 403 aa, Sinorhizobium meliloti; identical to SEQ ID NO: 1835

SEQ ID NO: 1886 - protein, 555 aa, Streptomyces griseus; identical to SEQ ID NO: 1866

SEQ ID NO: 1887 - protein, 422 aa, Frankia sp.
MTADAGVEDVESFRRRAAAWMRGNLRAVSGPPTHNLDGLGRSEDEELAEITRQRQLQRVFFDGGFAGICVPREYGGQGLTPAHQRAFNEEIAGYEFPMDLQSPTFNPCLAVLLEFGTEEQKRQHVPAILRGDEIWMQFLSEPSGGSDVAGALTSAVRDGDEWVLNGSKIWTTGAWYSDWALCLARTNWDVPKHRGLTVFILPLLRDGVELTRIEMVNGNREFCQEYLTDVRVPDSDRIGEVDGGWTVGTRWMFHEKMLYNSPYITMPAGLSDGFGAGWVSGVARDAARLGDPHVRGLVGEAHMLDLAAHALQRRVALGLATGRLSDQAAAVARLFTGVATSRRTEIAFDIAGPLGGTWTEQDGEAAGSGLAYLVRQATCIGGGTTEMARNVVSERLLGMPREPALDRDRPFRDVPRGPATRT

SEQ ID NO: 1888 - protein, 583 aa, Frankia sp.
MTVASESTAPGSTAPGSAGRVGPPAGREPVHSRPAATHEVRNQPPPLGDHDVADDPVLVEGVEREGAGYYLDDLHRLGWLAGSEQAARWGDEANRYPPELRTHDRYGNRIDEVDFHPSWHALMDVAVREGLAGSAWGSSRPGVHVARAAGLHVWSTVEQGHTCPVSMTYAVIPALRAAPDLSRAYEKLLTSRVYDPGLNPPLTKLGLIAGMGMTEKQGGSDVRANTTVATPHPDGGYRLRGHKWFTSAPMSDLFLVLAQAPGGLSCFLVPRVLPDGSHNTFRIQRLKDKLGNRSNASSEPEFDDTVGWLVGPEGRGVRTIIEMVAMTRFDSALGSASGMRAALIQALHHTRHRSAFGGLLIDKPLMRNVLADLALESEAATTLVLRLAGGIDRSTRGDAGERAFLRLATALAKFWICKRQPAFVAEALECLGGNGYAEESPMPRLYREAPLNGIWEGAGNVNALDVLRALGREPEAFAAYRAEVELAADGDKRLDAAWSAVRADLDELRGLGPDDLEFGARSLVERLALVLQASLLVRHAPAAVADAFCATRLGEAGGRVFGTLPRGTDVEALIARVPPATRG

SEQ ID NO: 1889 - protein, 682 aa, Desulfovibrio sp.; identical to SEQ ID NO: 1852

SEQ ID NO: 1890 - protein, 583 aa, Frankia sp.; identical to SEQ ID NO: 1888

SEQ ID NO: 1891 - protein, 422 aa, Frankia sp.; identical to SEQ ID NO: 1887

SEQ ID NO: 1892 - protein, 816 aa, Brenneria sp.; identical to SEQ ID NO: 1853

SEQ ID NO: 1893 - protein, 669 aa, Mycobacterium vanbaalenii; identical to SEQ ID NO: 1879

SEQ ID NO: 1894 - protein, 425 aa, Acidovorax avenae; identical to SEQ ID NO: 1845

SEQ ID NO: 1895 - protein, 442 aa, Saccharomonospora paurometabolica
MARQNATKRDAMGLGLAALNRLAGSTLLDRAGLRKPVENVVATATRQGFRAAGAAQRTFQATTRMSEPARPTDAPDTGLFDLTPTDEQQMIVETVTEFAAEQLRPAAAGADEKLTPPDGLLGRAAELGLTAVGVPEELGGMGTERSSVTNALVAEALAHGDLGLAVAVLAPSAVANVLAEHGDAHQQSTYLPAFTDENVPAAALALQEQRPLFDVFAPATKARRTPDGYTLDGVKNLVPRAAQAELFVVSADLEGRGPALFLVESGTAGLSVEADPAMGLRGAATGKVVLDGAKVPAEALIGGGRADVFTRVVRSSRLGWAALACGTGKAVLDYVVPYVNERQAFGEPVSHRQGVAFQVADIGIELESMRLTMLRAAARAEQGRDNAREVALAHSLAAEKGMRIGNAGVQLLGGHGYIKEHPVERWYRDLRAIAVMEGVVSA

SEQ ID NO: 1896 - protein, 543 aa, Saccharomonospora paurometabolica
MPPTHEVTNQVPALAEHDVAEDPALLDGLRREGAGWAESEVRELGVLAGGERAQEWGRLVNENPPVLRTHDRVGHRIDEVEFHPHWHDLMTVAVSHGLHATPWSQDRPGAHVARTAKFYVWSQVEAGHTCPISMTYSAVPALRHNPDLAATFEPLLAAPEYDYGLRTPTGKRGLIAGMSMTEKQGGSDVRANTTRAEPTGDGAYRLTGHKWFTSAPMSDVFLTLAQAPGGLTCLLVPRVLPDGTRNGLHLQRLKDKLGNRSNASAEIEYDGALGWAVGEEGRGVRTIIEMVNNTRLDCVTGTAAAMRYGTVRAAHHARHRAAFGTTLIRQPAMANVLADLAVEAEAATTVALRLAGASERANAGDAQESALRRLALAVTKYWVCKRGPAHAAEALECLGGNGYVEESGMPRLFRESPLASIWEGSGNVAALDTLRAMAREPESVEAFLAEVDEAAGADARLDAAITDVRRELGDLDDVEYRARRVVERMALVLQGSLLVRHGDKAVADAFCASRLDGDRGTAFGTLPRGVDTDAVLARTGTGR

SEQ ID NO: 1897 - protein, 543 aa, Saccharomonospora paurometabolica; identical to SEQ ID NO: 1896

SEQ ID NO: 1898 - protein, 442 aa, Saccharomonospora paurometabolica; identical to SEQ ID NO: 1895

SEQ ID NO: 1899 - protein, 825 aa, Hyphomicrobium denitrificans
MAAVVLLILALGGFLALGMIRAPLWGWAAAVGVLTLLATYDCTSALGWLAWLPFVGLALLSIPSLRRSLIVAPVFATVRKILPKVSDTEAQALEAGTVGFDAELFSGTPDWNKLQSIPPIELSAEERAFLDGPTEELCRMISDWQVRHTLREIPDEIWDFVKKHGFLGMLISKEHGGLGFSAQAQSLILGKIASRSPDIVTIVMVPNSLGPGELIEKYGTDEQKHYYLPRLAKGEEVPCFSLTGPTSGSDAATMRDIGYVTRGTYQGKDTLGIRLSWEKRYITLGPNATLVGLAFRLFDKDNLLGKGEDVGITLALIPADHPGVNIGRRHLPSGAAFPNGPNWGSDVFIPIDWVIGGEVMAGNGWRMLMECLSAGRAISLPSSATAGAKMMLRVTSAYARIRKQFGLPVSRMEGVEEPLVRIIETAYVNEAARAMTAAMVSRGEKPSVISALMKYQTTEKMRRAVNDAMDIHGGRGICDGPSNYLQSAYQMVPVGITVEGANILTRTLITFAQGALRSHPFLYKEVQAAQDADRTRGLAAFEDAFNNHIAFSLSNATGAFVHNVSGGALASSPDGAQRMSHWYRQLARASRSYAFVADLTVALLGGGLKTKQKITGRMADALAELYMLSATLKRYDDDGRPAGDEHIVELVAQNALYRFQDAVGGVIDNFPVGWARPLMRVVVFPFGRRFRPASDALAHQVARHALQPGEVRDRLTRNIFVSRDVNDPTGILEVTLEKVIAAEPAEKKLEKAIRDGLVRRYHGIDWFAEAEAKGIISAEETDQLREVEQLVARVIAVDHFDPAELKPNYATLGHNARGSEKLAAE

SEQ ID NO: 1900 - protein, 542 aa, Mycobacterium rhodesiae
MSDTHVVTNQVPPLLDHNPADSPVLIEALIREGGRWGVEEVTELGALSGSAQAQRWGDLADRNQPILHTHDRYGHRVDEIEYDPAYHELMRTAIAHGMHAAPWADDRPGAHVVRAAKMGVWTPEPGHICPISMTYAVVPALRHNPDLATVYEPLLTSREYDPELKVPATKVGITAGMSMTEKQGGSDVRAGTTQAVPNGDGSYTLTGHKWFTSAAMSDIFLVLAQAPGGLSCFMLPRVLPDGTRNRMFLQRLKDKLGNHANASSEVEYDGAVAWLIGEEGRGVPTIIEMVNLTRLDCTLGSATSMRSGLTRAVHHAQHRKAFGAYLIDQPLMRNVLADLAVEAEAATIIAMRMAGATDAAVRGDERETLLRRIGLAAAKYWVCKRATPHAGEAMECLGGNGYAEESGMPRLYREAPLMGIWEGSGNVSALDTLRAMATRPECVDVLFDELATSAGQDVRLDTHVAELRAELGNFDAIEYRARKITEDIALALQGSLLVRHGHPAVAEAFLATRMGGNWGGAFGTLPDGLDLAPILERCLVKG

SEQ ID NO: 1901 - protein, 564 aa, Delftia sp.; identical to SEQ ID NO: 1871

SEQ ID NO: 1902 - protein, 671 aa, Marinomonas posidonica; identical to SEQ ID NO: 1873

SEQ ID NO: 1903 - protein, 663 aa, Kytococcus sedentarius; identical to SEQ ID NO: 1846

SEQ ID NO: 1904 - protein, 814 aa, Enterobacter asburiae; identical to SEQ ID NO: 1864

SEQ ID NO: 1905 - protein, 624 aa, Mycobacterium avium
MRETLSEDLFRPHYTPNTVIARTKVAEQMRIMAAFGAAADGFRKEHGGTGDVGAAITMIEMLAMSDLSLMVKAGVQWGLFGGAVENLGTERHHETYVPKIISLELRGCFAMTETGHGSDVQSLETTATYDPATDEFVIDSPTPSARKDYIGGAAETATVAAVFAQLITTEDGKPVNHGVHCLLVPIRDADGNDLPGVTTSDCEYKGGLPGVDNGRIVFDHVRVPRVNLLNKYGDVAPDGTYSSPIENPNRRFFTMLGTLVRGRITVGGSAGAAGRVALDIATRYALQRKQFTTPDGDSEVLIMDYLVHQRRLFPLIAKSYALQFAQNELVSKCHDIQSADDPDADEQRELEARAAGLKAANTWHATRAIQESREACGGAGYMAENRLIALRGDTDVFTTFEGDNHVLTQLVAKELLTAYADDTKSMSPVEWVRFAANAVGDRVIKRTAAETIIQTIVDARQDSEEEGSLFNRGTQIKMFEDREEYLLASVARRLQAKSKEMSEFDAFNSVQDHVLHAASAHIDRVVLEAFVAGIDGCPDEQARELLGILCDLYALSVIEDDKAWYIEHRYLSTERAKAVTRGINDRCRALRPHAQTLVDGFGIPERLRYAEMLHPENLSEALTS

SEQ ID NO: 1906 - protein, 633 aa, Selaginella moellendorffii
LPYPAKFHVAAAYAGFSADDDDYENVALPLGSLFTPEMALLLYGLYMQATVGPCTAAKPRMWNTQEHFKWKSWSEFKELPSIEAMRLFVRTLEEQDPDWYFKSQGREPVQDNDLDPSLQEEDIPAVNNSPPSPPLPSANGGIGTEVKMEENDVECSTIMEIDVRNEWLSPLVSGRRPAARYQHAAAVVHDKMFVIGGNHNGRYLNDVQVLDLRTLTWSKVEQKLPTSPLSSSMPPIPSNQILSPCAGHSLIRKNRMLFVVGGHSKNSPDSVSVHAFDTETFTWSLFPTYGQAPIARRGQSVSLIGSNLVMFGGEDSKRRLLNDLNIFDLETMTWEAVDAIGPPPSPRADHAAAVYAGHYLYIFGGGSHSSCFSDLHVLNLKTMEWSRKETEYTPTPRAGHAGATVGDLWYIVGGGDNKSGISETIVLNMKTLDWSLVTSVPARTYIACEGLSLVSACLNGEETLIAFGGYNGKYSNEVCCFFLFLRLSIISKEPENGGYNTPKLLELKRELEVALASCQDENNKLKSELSITANDLSMVFPRFVHETLVLQFLFTVQELQSVRGQFVAEQTRCFKLEVEVAELRQKLQSMEALQKEVDLLRRQKAASDQVAAQLVQQKQNASGGMWSWLAGTP

SEQ ID NO: 1907 - protein, 668 aa, Unknown; identical to SEQ ID NO: 1100
  Description of Unknown: Acyl CoA binding protein polypeptide

SEQ ID NO: 1908 - protein, 713 aa, Brachybacterium faecium; identical to SEQ ID NO: 1847

SEQ ID NO: 1909 - protein, 688 aa, Thellungiella halophila
MESRRGNQMEFSELPATRRIQRLSSHISPAVTAPPQQPMVQTEACASRSKKLEVNGEALSLYMRGKHMDIQEKVYEFFNSRPDLQTPIEISKDDHRELCMRQLYGVVREAGIRPFRYVADDPEKYFAIMEAVGSVDMSLGIKLGVQYSLWGGSVINLGTKKHRDKYFDGIDNLDYTGCFAMTELHHGSNVQGLQTTATFDPITDEFIIDTPHDGAIKWWIGNAAVHGKFATVFARLILPTHDSKGVSDMGVHAFIVPIRDLKTHQALPGVEIQDCGHKVGLNGVDNGALRFRSVRIPRDNLLNRFGDVSRDGKYTSSLPTINKRFGATLGELVGGRVGLAYASVGVLKISATIAIRYSLLRQQFGPPKQPEVSILDYQSHQHKLMPMLASTYAYHFATVYLVEKYSEMKKTHDEQLVADVHALSAGLKSYVTSYTAKSLSVCREACGGHGYAAVNRFGSLRNDHDIFQTFEGDNTVLLQQVAADLLKQYKEKFQGGTLTVTWSYLRESMNSYLAQPNPVTARWEGEDHLRDPKFQLDAFRYRTSRLLQSVAMRLKKHTKTLGTFGAWNRCLNHLLTLAESHIESVILARFIEAVQNCSDASARAALKLVCDLYALDRIWKDIGTYRNVDYVAPNKAKAIHKLTEYLSFQVRNVAKELVDAFELPDHVTRAPIAMQSDAYAQYTQVVGF

SEQ ID NO: 1910 - protein, 633 aa, Selaginella moellendorffii; identical to SEQ ID NO: 1906

SEQ ID NO: 1911 - protein, 646 aa, Arabidopsis thaliana
MESRREKNPMTEGESDGLIAARRIQRLSLHLSPSLTPSPSLPLVQTETCSARSKKLDVNGEALPLYMRGKHIDIQEKIFDFFNSRPDLQTPIEISKDDHRELCMNQLIGLVREAGVRPFRYVADDPEKYFAIMEAVGSVDMSLGIKMGVQYSLWGGSVINLGTKKHRDKYFDGIDNLDYTGCFAMTELHHGSNVQGLQTTATFDPLKDEFVIDTPNDGAIKWWIGNAAVHGKFATVFARLILPTHDSKGVSDMGVHAFIVPIRDMKTHQTLPGVEIQDCGHKVGLSGVDNGALRFRSVRIPRDNLLNRFGDVSRDGTYTSSLPTINKRFGATLGELVGGRVGLAYASVGVLKISATIAIRYSLLRQQFGPPKQPEVSILDYQSQQHKLMPMLASTYAYHFATVYLVEKYSEMKKTHDEQLVADVHALSAGLKSYVTSYTAKALSVCREACGGHGYAAVNRFGSLRNDHDIFQTFEGDNTVLLQQVAADLLKRYKEKFQGGTLTVTWSYLRESMNTYLSQPNPVTARWEGEDHLRDPKFQLDAFRYRTSRLLQNVAARLQKHSKTLGGFGAWNRCLNHLLTLAESHIETVILAKFIEAVKNCPDPSAKAALKLACDLYALDRIWKDIGTYRNVDYVAPNKAKVCFLV

SEQ ID NO: 1912 - protein, 669 aa, Oryza sativa; identical to SEQ ID NO: 987

SEQ ID NO: 1913 - protein, 660 aa, Pongo abelii; identical to SEQ ID NO: 481

SEQ ID NO: 1914 - protein, 585 aa, Shewanella baltica; identical to SEQ ID NO: 1320

SEQ ID NO: 1915 - protein, 596 aa, Shewanella baltica; identical to SEQ ID NO: 1321

SEQ ID NO: 1916 - protein, 650 aa, Shewanella baltica; identical to SEQ ID NO: 1318

SEQ ID NO: 1917 - protein, 585 aa, Shewanella baltica; identical to SEQ ID NO: 1317

SEQ ID NO: 1918 - protein, 665 aa, Picea sitchensis
MARSSSAMAYPDRFYAAAAYAGLGSSQDSSKAAISRFQNENALLLYGLYQQATVGPCNVSKPRSWNPIEHSKWTSWNNLGNMPSQEAMRLFVKILEEEDPAWYSKVPESAPEPEVEVEKPSKESAFHHDNSVSVPKDTAIDNGSFVETQDKDVILEGLGSVAVYDQWVSLSVTGRQLKARYEHAAAVVQEKMYVFGGNHNGRYLNDLQVLDLKSLMWSKVDTKMASDSSQELLSPCAGHCLIQWGNKILAVAGHTKDPSDIVTVRSFDTESCTWCVLKSYGKAPIARGGQSVTLVGSSLVMFGGEDSMRSLLNDLNILDLETMTWDAIEAVGTPPSPRSDHTATVHANRYLLIFGGGSHSTCFNDLHVLDLQSMEWSRPKMQGTLPTPRAGHAGVTIGENWYIVGGGDNKSGVSETMVLNMSTLVWSVVTTVQGRVPLASEGLSLVVTSNNGEDILVAFGGYNGRYSNEVHVLKPSHKGMLQQKMLESSAGASVDPVLPTSNGVRDIEYEDLAQDGKVREIVMDNPQSDSMLQKSDEAKERIIVSLKEDKDNLEATLSAEHSLTSRLKQELAEAQTANADLTEELRSVRGQLASEQSRCFRLEVDVAELRQKMQQMEALQKEVELLQRQKAASDQAAANAARRQSSGGVWSWIAGSPPDAKSVEA

SEQ ID NO: 1919 - protein, 438 aa, Bos taurus
MALRGVYAQLLNRGPGLRVFRSWSSATAQTEKGEKTQSRSAKPSRPEFDWRDPLLLEEQLTADEILIRDTFRTYCQERLMPRILLANRNEVFHREIISEMGELGMLGPTIQGYSCAGVSSVAYGLLARELERVDSGYRSAMSVQSSLVMYPIYAYGSEEQKQKYLPRLAKGELLGCFGLTEPNHGSDPSGMETRARHNPSSRSYILSGSKTWITNSPVADLLIVWARCEDSCIRGFLLEKGMRGLSTPRIEGKFSLRASSTGMIIMDDVEVPEENVLPGVSGLAGPFGCLNNARYGITWGVLGAAEFCLHTARQYTLDRIQFGVPLAKNQLIQKKLADMLTEITLGLHACLQLGRLKDQDKAAPEMVSLLKRNNCGKALDIARQARDMLGGNGISDEYHVIRHVMNLESVNTYEGTHDIHALILGRAITGIQAFVAGK

SEQ ID NO: 1920 - protein, 438 aa, Macaca fascicularis
MALRGVSVQLLSRVPGLRVFRTWVSSAAQTEKVGRTQSQLAKSSRPEFDWRDPLVLEEQLTTDEILIRDTFRTYCQERLMPRILLANRNEVFHREIISQMGELGVLGPTIKGYGCAGVSSVAYGLLARELERVDSGYRSAMSVQSPLVMHPIYAYGSEEQRQKYLPRLAKGELLGCFGLTEPNSGSDPSSMETRARYNSSNKSYTLNGTKTWITNSPMADLFVVWARCEDGRIRGFLLEKGMRGLSAPRIQGKFSLRASATGMIIMDGVEVPEENMLPGASSLGGSFGCLNNGRYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 1921 - protein, 541 aa, Thermus thermophilus
MPLHQEEAVEWISYAYGKNHYEADPELRDLLRHFWPGAGEREAELLAWGAYMGREVYEAAYHIDQDAGPELVMHDLDGNRVDRVRLSPVQREVLKRLRPIVRPPYEGGSWHHHFALGYLLADGGLYCILTITHQVAYPIHKYAPGLASWKERVLYGEAFGATWMTEIQGGSDLGANRTVARREGEVWRLYGGDKYFASGAGLADVALVTARPEGAPPGPKGLALFLLPRLDREGRLNYRVRRLKRKSGTRAVPSGEVELEGSEAYLVGRAEEGIYYTLETLTVSRLANAIAAMGIAAKALLETRERVRRRQSFGRFLADHPLVRYDLLDLAVRQAGGLALALAAVEAFDRAWHERPPYGEAYHLARFLSHLAKNRTAEHSAEITRLAMELFGGLGFLEEYAVARWHRESLITPIWEGPSNIQALDLLEAMQKKGAHRPFLAWLEARLKGRGEEAEGALAAARKTLDRLAALEPEAAQFSAKTALRRLADAAAVAGLLEASATAGPRYRELAGLYARRFLLGEDYPPEALGARALYLPEGGA

SEQ ID NO: 1922 - protein, 537 aa, Ostreococcus tauri
MRGPERFYLACAFRTRAKRPPSSSSSSSSSSKLEVMRTMGREAMLKSMDDGETDGSGPLFDEDRTLLLDALERQASSGPCVGARPWGFWDPRGALEWEAWSMLRKISADKAMELYCEVIEMRYPDWFNILVRGMSEKQKRALIATAKECALDYYRALASGELGDTAKATSKQARQVLAFDSAASPTAFLDEIFVSAADDEFAKLPVLDDSSPRARSGHVAAMVHGDTLFVSHGRSANSRLLGDLWGLDLSTGTWSARSLRWPGSPCAGMASALIDSKLFCFRGKSAADCDASAVYVLNVSTIELSADFSSSDSQFKWTHVRATNEGEALPRARLAHTATVVGDSVLIFGGVDSASGDDMAECWAFNPRNASWRRLADGTRARSSHTATALDDRYLIVCGGSEANELCDCSMVDVFDAQSNEWCTIQCASNVEAPSPRAGHAAVVVGSRWYIIGGGDNERALQDAYCVDLRGCVDERRTAYWSVFARDNPLIGREGMSASAVMNAATGRAYILLHGGSNFAASALNDTLACRLSTVHA

SEQ ID NO: 1923 - protein, 424 aa, Mus musculus
MHRLQVVLGHLAGRPESSSALQAAPCSARFPQASASDVVVVHGRRTPIGRASRGGFKNTTPDELLSAVLTAVLQDVRLKPEQLGDISVGNVLEPGAGAVMARIAQFLSGIPETVPLSTVNRQCSSGLQAVANIAGGIRNGSYDIGMACGVESMSLSGMGNPGNISSRLLESEKARDCLTPMGMTSENVAERFGISRQKQDDFALASQQKAASAQSRGCFRAEIVPVTTTVLDDKGDKKTITVSQDEGVRPSTTMQGLAKLKPAFKDGGSTTAGNSSQVSDGAAAVLLARRSKAEELGLPILGVLRSYAVVGVPPDVMGIGPAYAIPAALQKAGLTVNDIDIFEINEAFASQAVYCVEKLGIPAEKVNPLGGAIALGHPLGCTGARQVVTLLNELKRRGRRAYGVVSMCIGTGMGAAAVFEYPGN

SEQ ID NO: 1924 - protein, 401 aa, Arthrobacter phenanthrenivorans
MSNAPEARAEFDADPSDILALDSLLSTDELNTRQRVRDFTHQRIKPGIARWYDDAVFPLELAQELGELGVLGMHLEGYGCPGRSAVEYGLAAMELEAGDSGIRTFVSVQGSLAMTAIHTWGSEDQKQEWLPRMAAGEIIGCFALTEPTAGSDPSAMATLAWRDGPGEEAGWVLNGTKRWIGLASVAGVMVVWAATDDGVHGFLVPAGTPGVTAVPIPQKLSMRASIQCDVVFDDVRLGPEALLPAARGLRGPFTCLNEARYGIAWGAMGAARDSYEAALAYSQERLQFGKPLAGYQLTQEKLVNMLLEIQKGTLLALHLGRLKDAGKLRPEQISLGKLNNVREALAIAREARSILGGNGITLDYSPLRHAANLESVRTYEGTDEVHTLVLGRHITGLNAFR

SEQ ID NO: 1925 - protein, 402 aa, Arthrobacter phenanthrenivorans
MMAGDSLPDLPSADFFAFESLLDQKERDKLAELREFLAAEIAPFAGDWWNKAEFPAHILPKLAALELSTPAQRGYSHLFAGLVIAEMTRVDTSIATFFLVHHDLFVESLYAFGSEDQKRRLLDAAANLEITGAFALTEPNHGSDVAGGMETGARRISSATGEADDGGTAWVLNGAKRWIGNGTFCDYMLVWARDETDGSVRGFIVDATLPGVSRTRIENKTALRTVQNADILLTDVRVAEADRFASINSFEDTKELLRGSRIMVAWQAVGQQLAAFDVARQYAVERHQFGRPLAHFQLIQQQLVTMLGNAVASMAMMAGLARLQDEGAADMPQVALAKSYISARMRETVALGRSILGGNGILTDYRMAKIFSDAEAIYTYEGSFEINTLIVGRAVTGISAIT

SEQ ID NO: 1926 - protein, 414 aa, Xylanimonas cellulosilytica
MSAAQPIMPGVTAPEYDVSRPLDLDYVGAFADVTPAERAHQLAVREFVQDRVLPVIDGYWERAEVPFELVKELGARDFLRDGVSVPDRPEISLTAEGLAAMEMSRGDGSVATVCGVQGGLALRSIMMHGSDAQIARYAEPMARGDVLGAFALTEPTHGSDSVSLETTAVRTVRDGVEGYAINGEKKWIGFGSCGHITVVWARLVGDAGDSQVHGFIVPQDADGYRATTIEGKVALRAITQAHIVLDDVFVPLDAALPGATSFKATSQVLFATRLAVAWSAVGHAIACYEAALEYVGQRVQFGRPLAASQLVQERLTRMLSTISQLQLLVARLTRVAEAGGLTGAQASLAKYSCTRGAREVAALARDMLGGNGILLANRVARHFADIEALHTYEGTESMNALIVGRDITGFSAFA

SEQ ID NO: 1927 - protein, 411 aa, Arthrobacter chlorophenolicus
MSAAAGRQASAGLPDADFFAVESLLSQAERNKLAELRDFLAAEIAPHAGDWWNNAEFPAHILPKLAALELSTPAQRGYSHLFAGLVIAEMTRVDTSIATFFLVHHDLFVQSLHAFGSPGQKERLLADASDLRTTGAFALTEPLHGSDVAGGMETTARRISSATGEDDDGGDAWVLNGAKRWIGNGTFCDYMLVWARDESAAPDNPSGSVRGFIVDATLPGITRSRMENKIALRTVQNADIVFKDVRVAEADRFTQVSSFDDTKELLRSSRIMVAWQAVGQQLAAFDVARQYAVERRQFGRPLAHFQLIQQQLVTMLGNAVASMGMLVQLARLQEEGSADMAQVALAKSYASARMRETVALGRSILGGNGIVTDYRMAKIFADAEAIYTYEGSYEINTLIVGRAITGISAIA

SEQ ID NO: 1928 - protein, 411 aa, Arthrobacter chlorophenolicus; identical to SEQ ID NO: 1927

SEQ ID NO: 1929 - protein, 660 aa, Kineococcus radiotolerans
MTTTELRAPDVPTAPDSAPETAPEPLDTDVLRRFLDGRFADLREQFRREAPADLFTPSHDLSTREHRDLTRARLRTLAELGGHELGYSSRWGGGDSPGGQVAQFDMLGYGDASLMIKSGVQWGLFGGAVQALGTERHHSTLLGPLLRLELVGCFGMTETGHGSDVASIGTTATYDPAAQEFVVHTPDASCRKDYIGGAAEDADVAVVFAQLVTGGESRGVHAFVVPLRVDGVDVPGVWRGDDGRKMGLNGLDNGRLAFDHVRVPRTALLNRYADVAEDGTYSSPIASANSRFFTMLGALVKGRVSVSGGALSQTKVALEIALRYAQRRTQFKRPGGDGEVVLLDYLAHQRRLLIPLATTYALTFAQDELMGEMDELLRVQLAGGEADANRQRAFESHAAGLKVASTWHATRTIQTCREACGGNGFLADSRLPQLKADTDVFTTFEGDNTVLLQLVAKGQLTAYAQQFSDLDTLGMARFATRDFVTTYAGRSPARSLVADVVEAGRVPEDLHDRGWQLRMLAERERHVVESLAKRMRKARSRPEAERFEAVDELQDHLLLAGRAHVDRVVAEAFAAAIARCDDPAVAALLSDVFDLHALSVLEAEKGWYLQHRRMTTLRAKAITTAVNALCRKLRPRTGELLDGFGIPREWLASSLVPERG

SEQ ID NO: 1930 - protein, 454 aa, Chitinophaga pinensis
MAVKLSTIRQAFHLLKNIDFEQLGRLSEKIDLPKVMATVGKMNDQQLSGLMRMLQSSGGERKKELPPVNGDFYDLSGMLSPEDRALQLKVREFMESEVQPIVNEHWVKSDFPFQLLPKLAALDICGSTYEGYGGIQSSFLMEGIITMEIARVDCSMATFFGVQSGLAMGSIYLLGSEEQKKEWLPGMQRLEKIGAFGLTEPEVGSGAAGGLTTTAKRDGDTWILNGQKKWIGNATFADVLVIWARDVDDNEVKGFLVKKDTPGFSVEKMHDKMALRIVQNGVITLKDCVVEEKDRLQHANSFKDTAKVLRMTRAGVAWLAVGCARGAYENALAYTQKRKQFGRPIGSFQLIQNHLVEMLSNLTAMQTMVYRLSELQDEGRLEDEHASIAKVFCSLRTRDIVSRAREVMGGNGILLEYNVARFVADAEAIYSYEGTKEINSLIVGRAITGFSAFV

SEQ ID NO: 1931 - protein, 452 aa, Dyadobacter fermentans
MNLFKSFSQLRNLLKSIDIEAVSKLSQKVDLNQLMGVVSKMSEEDLGKMLKFMQAGSGKKKAPPVVNGDFYELASTLSPEEREIQLKVRDFMETEIRPIANYYWNNAQFPMHIIALMARLNICGLTYQGYGCAGRSALLEGFIAMEMARVDSSISTFFGVHSGLAMGSIYLCGSEEQKQQWLPVMQRMELIGAFGLTEPEVGSGAAGGLTTTCKKEGDEWVINGQKKWIGNATFSDITIIWARDLGDNQVKGFIVKKENPGFKAEKMEDKMALRTVQNALITLTDCRVPETDRLQNANSFKDTANVLRMTRAGVAWQAVGCGRGAYELALKYTMQRKQFGRPIAGFQLVQDLLVTMLGDLTAMQTMVYRLSQLQDAGDLADEHASLAKVFCTLRMRSIVDHARELFGGNGILLEYDIARFVADAEAIYSYEGTKEINSLIVGRAITGESAFV

SEQ ID NO: 1932 - protein, 670 aa, Chlorella variabilis
MSASICQLPYPERFSEASAFVAAHGDNLTEESKLLLYSLHQQATVGPCNEPKPWGWSVVNNAKWQSWKQLGDMPAVEAMRLYVRTLEEEVPDWWAQHQASGVGAPTANGTAEGAPAAAAGEAPPAAPPAPAAAGGGRPAPKSRSVTEVVVEGSWVSPYISDRRPPPRYEHATALIGSELFIVGGNYGGRYLNDTWALNLENLTWKSYAWPGSKAGAASGAAEGAPPQPAALPAIAGHVAVAWQGNVVIVGGHMKAKEASPEMPVRLLDTQAGTWSAIQCTAADEEEELPRPRGGHSAAAGSSRGGSSSSSRQQQRRQRLLLTVLLLTGVLVGSKLYIFGGEDVMRRPLGDLLCLDLATWQWSVPETTGTPPGPRSAHAAALYRGRYMLVFGGGSVAHCNNELHCLDLETLEWGVPEAEGPVPPPRAGHAGAILGDVWFLVGGGNNTSGCADMYALDLSPLATGPVQWTLVGNTPVESAIASEGLSLLPVPMAGCMISFGGYNGRYHNAVHVYRPEGYLTGGAPAAAPPAPQQPAAAAPPKAAAQPAAAAAAAAAAAAASGAAEQERAWAEVEAARREAAAAKEAVSHEMAIMRRQLESAQATAADADRSLEEVRAALEAEQGKSMRLEVELAEARQQLGRMEELERELQKYRMTSQEKKGSGIWGYISGQ

SEQ ID NO: 1933 - protein, 419 aa, Nakamurella multipartita
MTTTEAVSSENGSARPRPTGIYDGAVTEPQTPITDRARDYLNLDSLFTAEELAQRDKVRAFVDARIRPNIAQWYEDAHFPVEIAREFGDLGLLGMHLKGYGCPGRSSVEYGLTALELEAGDSGLRTFVSVQGSLAMSAIHKHGSEEQKQQWLPGMATGELIGCFGLTEPTAGSDPAGMVTHAVRDGSDWVLNGAKRWIGLASVAQVAIIWATTEDGVRGFVVPTDTPGFTATPIEPKLSMRASIQCDITLTDVRLPADAMLPNVVGLKGPFACLNEARYGIIWGAMGAARDSYETALRYMLDRKQFDTPLAGFQLSQRRLTDMVLEIQKGILVALQTGRLKDAGTLHPQQISFGKLNNVREAIAICREARAMLGGNGITLDYSPLRHANNLESVRTYEGTDEVHTLIMGQAITGLPAYR

SEQ ID NO: 1934 - protein, 409 aa, Nakamurella multipartita
MSSKLNLAAELTKDLTTARGTDYYLLHDLLSDEEREIRDRVRSFVDADVLPIINDYWERAEFPFELVPKLAKLGIVGGAIQGYGCPGLSRLAQGMVTLELSRGDGSVNTFIGVQSGLAMGSINMLGSPEQKQRWLPGLATLDKIGAFALTEPQHGSDSVALETSARRDGDHWVLNGSKRWIGNGSIGHVVIVWARDEADGKVKGFVVEKDDQGAYPEGYTAELITGKIGKRAIWQPDIVLDNVRVPEANRLAHANGFRDVSRVLTATRGGASWEAAGHAVAAYEAALTYATHRQQFSKPIAAYQLVQNKLATMLAETTAIQLMCFRMAQLQEQGKLTGPMASMAKMYTASTARSICAEARDILGGNGLLLDFHVARHMTDMEVVHTYEGTDSIQSLIIGRDVTGISAFG

SEQ ID NO: 1935 - protein, 419 aa, Nakamurella multipartita; identical to SEQ ID NO: 1933

SEQ ID NO: 1936 - protein, 409 aa, Nakamurella multipartita; identical to SEQ ID NO: 1934

SEQ ID NO: 1937 - protein, 454 aa, Chitinophaga pinensis; identical to SEQ ID NO: 1930

SEQ ID NO: 1938 - protein, 453 aa, Pedobacter heparinus
MANIFSSLKNAYTLFKHVDFRKLEALSKKVDLTKMIDSVSNLDETQLQGLMKMMGGQGKKRELPPIEGDFYQLGEEALKDEDRALQLKVRAFLEKEVKPVVNKYWLKAEFPFELIPKIAELNICGLTYQGYGCPGKSNLMEGMLAMEMARVDTSMSTFFGVQSGLAMGAIYLLGSEAQKQQWLPDMQQMKIIGAFGLTEPEVGSGVAGGLTTTAKRQGNKWLLNGQKKWIGNATFSDITVIWARDVDDNQVKGFLVRKGSKGFAVEKMQDKMALRIVQNGLITLTNCEVDEEDRLQNANSFKDTAKVLKMTRAGVAWQAVGCARGAYESALNYTRTRKQFGKPIASYQLIQNHLVEMLSNLTAMQTLCFRLSQLQDQGLLTDEHASLAKVFCSMRTRDVVSRAREVMGGNGILLEYDVARFVADAEAIYSYEGTKEINTLIVGRAITGFSAFV

SEQ ID NO: 1939 - protein, 453 aa, Pedobacter heparinus; identical to SEQ ID NO: 1938

SEQ ID NO: 1940 - protein, 452 aa, Dyadobacter fermentans; identical to SEQ ID NO: 1931

SEQ ID NO: 1941 - protein, 442 aa, Chloroflexus aggregans
MAFVTLPANLTRMMQQVQVPFVDTFRALRGVTPQEIGLLLKSITAKRRPKRVPPVNSDFYDILAELSPEEQAIQQKIRSYMEEKIRPIANSFWERGEFPHEIVPGFARLIAETFGSRPYAIDALGPVLTGVACMEMARVDPSIYTFFGVHWGLCMGSIDLFGSPEQKQRWLPPMQRFELIGSWALTEPDVGSATAAGLQTTARFERGHWVLNGAKKWSGNAPIADINIIWARDVSNNQVQGFIVERNTPGYEVERLEGKIALRTVQNANIRLVNCRIPEANRLPNVGGFRGVARQLAITRAAVAWAMTGVAMGAYEQALTYAQQRIQFGRPIGSFQLVQNSLVQMLANVTAMQTMCLRMSQIAARTGKISQEQASLAKVFCGEKMRETVALARAVLGGNGILLEHGVARYFADAEALYSYEGTHEMNTLIVGRAITGISAFV

SEQ ID NO: 1942 - protein, 442 aa, Chloroflexus aurantiacus
MAFVTLPASLTRMFQHVHVPLFDTIRALRSVTPQEIGLLWKSITSKRHPKRVPPINSDFYDILADLSPEERAIQQKIRTYMEERVRPLANTYWERGEFPHEIVPGFAHLIAETFGTRPYKIDALGPVLTGIACMELARVDPSIYTFFGVHWGLCMGSIDLFGSPEQKQRWLPPMQRFELIGSWALTEPDVGSATAAGLTTTARFERGVWVLDGAKKWSGNAPIADINIIWARDVSNNQVQGFIVERGTPGYEVERLEGKIALRTVQNANIRLNGCRVPEANRLPNVGGFRGIARQLAITRAAVAWAMTGVAMGAYERALAYAQQRIQFGRPIGGFQLVQNSLVQMLANVTAMQTMCLRMSQIAARTGKVSQEQASLAKVFCGEKMRETVALARAVLGGNGILLEHEVARYFADAEALYSYEGTHEMNTLIVGRAITGISAFV

SEQ ID NO: 1943 - protein, 407 aa, Geodermatophilus obscurus
MTAGTRRERTDVTLAEDIGKALSTDYFQLREDLSPEQMDHLLRTRTFVEDEVLPVINGYWERAEFPRELAEKLGAAGLVGDGIEGYGCPPMDALSAGLVHMELNRGDGSLGTFLGVQAGLAMKSIAMLGSEEQKQRWLPPMARCEALGAFALTEPDHGSDSIALETSARRDGESYVLNGSKKWIGNGTIADVVVVWARDTDDGQVKGFLVEKGTQGYRARRIEGKGSLRAVWQAEIELEDVRVPAENMLPGGRSFKDTGAVLATTRGSCAWMALGHAVAGYEAALTYAGRRKQFGKPLVEFQLIQERLVGMLAKVTSMQLYCRRLADLALAGRIEPTLAGLAKAHNTSTARAVLAEARDLLGGNGILLDFHVIRHMADIESIHTFEGTETIQTLIVGRDITGASAFA

SEQ ID NO: 1944 - protein, 408 aa, Micrococcus luteus
MTTPFHAEADSFLGRADVVGLDSLFSAEEKAVALQVRGFVDEHIRPHIARWYDDAVFPREIVPELGRLGVLGMPYEGHGMPGRSAVEYGLAAQELEAGDSGLRTFVSVQGSLAMGAIHKHGSEEQKAQWLPRMTIGEAVGCFGLTEPGAGSDPASMTTTARQEPGGDWVLDGVKRWIGLATLADVAIIWAQTGEPGDGRGVRGFVVPTDTPGFRAEAITQKLSMRASVQCEIHLDGVRLPASAMLPADSAVGLKGPFQCLNEARYGIIWGAMGAARDSFDAVLDYAMERQQFGVPLASHQLTQAKLADMAVAIGKGYLLAHQIGRAKDAGPLTPAMISAGKLDNCRVAIGIAREAREMLGGNGITLEHSPLRHANNLESVRTYEGTDEVHQLTLGRHLTGIGAFAPAR

SEQ ID NO: 1945 - protein, 404 aa, Micrococcus luteus
MTETLPTVEPEYDVATPLDTDFYLALADVSDAEKDVWRRARAFALEPDVLPRIREAWDRHEYPLDLVARLGQADLLRDGVPVDGLPDVSRVAAGLAMMELSRLDGSIATMTGVQGGLAMRSIQLCGSEEQRAEHLPAMARGELYGAFALTEPTHGSDSVSLETRAERVDGGWRLHGHKKWIGNGAAGGVTVVWARSAEDEKVRGFIVRQESEGYTAEVIKGKVALRAIDQAHITLDGVFVPDADVLPEARSFKDTSRVLFATRVGVAWSALGKAVGCYEAAVHYAGQRVQFGRPLAAAQSVQTRLAEMLSQLTQVQLLVLRATRLEDEGRLTGPMASLAKYSATRAARSIAANARDLLGGNGILIQNEVARHFADIEAIHTYEGTETVQGLIIGREITGVGAFV

SEQ ID NO: 1946 - protein, 402 aa, Micrococcus luteus
MTALADRPVPASGAPAVPPGLPHVDLLRLRDRLEPVERARLDAIEDHLQTRVRPHLTRYWDAEEFAFDLLPGLAELGLGRLVLDGSSSLFQQLVHAEIARVDLSLSALVGIHNELNLGMIAGLGSERQKATWQGRLESFDALGAFCLTEPDHGSDIAGGLATTATRDGDEWVIRGAKRWIGAGTIADVALVWARDTADGEIKGFVVPTDTPGYEATKISGKMGLRIMQNADITLDVRLPADAILPGATTFAATRALLRDSRMWVGWQGVGAQMGVLDVLRSYALRREQFGRPLAAFQLIQAQIAEVAGNLAASAGMMLQVDALRQEGRMEMMHAAMAKATSTRLARSSAALARDALGGNGLLTEHEIAKIMGDVEAIYSYEGSYGMNTLIVGRALTGVSAFV

SEQ ID NO: 1947 - protein, 612 aa, Alicycliphilus denitrificans
MTFLPRYSAFAKPRPATSRQSSDKLASDCAGLDFFEIDPGLQQLLPLYVPQAELQYFLPHLKRLGQLAGGRLNELATVADKHGPVLHARSRWGEDEDWVEYHPAYQEMEHIAFEQFQFHAMTHRPGAMGYPGTLSPVTKYAFQYLFVQSEFGQMCPISVTDTSIHLIRKFGSEELKARLLPRMLAEKLEDLWKGTQFMTEKAGGSDVGQVETTARLIDGQWHLFGEKWFSSHVDADVALILARPENAPAGTRGLALFAMPRQREDGSRNSYRIVRLKDKLGTRSMASGELRIEGAFAYLVGDPTRGLKQMMEQVNLSRLSHAVRAAAMMRRCLNEALQAASNRHAFGQRVMDYPLMQRQLLKIMVPTEAALSVTLATADMMAKGYAGDKQAAAALRLLTPLLKLRTCRDNITVATGAMEVRGGNGYIEDFVNARLVRDAHIGVLWEGTSNINALDAIGRAVRKDRAHLALQAVLREKLHGVQHSAPDMARQLGHALDQAIALAETVATRPEFENETRRAASAVYYAAAAVLLAWEATQPGVDGRRLLLADAVLRTHLLAADPMAAPSTLTHPREAALLGSARLSLQEAREFLAPAQRTATAPAAAAQPELVG

SEQ ID NO: 1948 - protein, 614 aa, Streptomyces flavogriseus
MTVTLTDIAPPSTTDLLTGVLLGPEFRREHGFWQRLISTEPFRRPAGGTPEERLALAYERLRVLNRALDSGARLAADPRALAALHAWLGPVDPALTTVAGIHYNLFLGSLLDHDSVGSRDLSDYLTMRRIGTFLCTEVAHGNNAAAMETTATYDRERDGFVLHTPNAGAQKFMPNTSPAGGAKSGLVAARLVADGADHGVRLFLVPLTDDAEALPGVRVRLLPARMGSPVDHCLTSFDHLFVARDALLGSGEEGDAEGMFRTEPGDRRRRFLTSIGRVTPGRIAMSACAAGSARATLAVAVRYGGHRLISGSRGAPPVPVNAHRTHHGPLASAMATVFAMTLLYRRAQERWEACADGEGRAEAGTLVDVAKAWITWRARDVIVESRERCGAQALLENNGMTELVTGVEGAITAEGDNIALYTKAAADMLFAADPGGAGTPAPYTGDLADPRFLGTLLASVQEIWFARARERVLSATDADALGRWNAASGPALRGVEAYAYRQAAAAYAEARVALPEGAAKDRLGELERLFAVEWLARNSGDLLAAGRLSGDQVEALAGDAEDLIAAVAAHAPQLADSFALPEALLADWPIAGPGYADAYDDPEGPWNTGAAEAR

SEQ ID NO: 1949 - protein, 439 aa, Owenweeksia hongkongensis
MSIFSNIKKLSNLFSQIDVSDTIEALGKLDRTELYQIMKIIKSKSKPYQAPEIEGDYYQLARLLTKEEREKQLEVREFMNEHVKPIANEYWNKAQFPMHIIPKMAELNIAGLTYEGYNSPMGSYLLEGFITVEMARVDTSISTFFGVQSGLAMGSIYFCGSEEQKKKWLPPMQRLEKIGAFGLTEPNVGSAVAGGLETTCKKEGDKWILNGQKKWIGNATFADLVIIWARNVEDNEVRGFIVEKGTAGFKAEKQEDKMALRTVQNALITLTDCEVSEENRLQNCDSFRDTSKVLKATRAGVAWQAVGCARGAYELALNYSHTRKQFGKPIGSFQLVQDLLVEMLTDLTAIQSMAFHLSKLQDEGRMTDQQASLAKVACSRHTREIVGKAREIFGGNGILLEHDIARFVADAEAIYTYEGTKEVNSLIVGRDITGISAFV

SEQ ID NO: 1950 - protein, 552 aa, Streptomyces griseus
MSTPVAPHSRPTDVTHEVTNQPPPLTGHDAADDAVLLEGIRREGAAWHVDELHRFGRYVGSEEAQHWADQANRHEPELRTHDRFGHRIDEVEFHPAYHSLMEASVRAGLAGAAWADERPGAHVARAGGFMLATMLEQGHLCPVSMTYAVVPALRRSPDLAKTYEPLLTSRVYEPGLSAPTAKRGLLAGMGMTEKQGGTDVRANTTAAVERADGTWRLRGHKWFTSAPMNDLFLVLAQSPGGLSCFLVPRVLADGSRNTFRIQRLKDKLGNRSNASSEPEFDDTVAWLVGDEGKGVRTIIDMVTMTRLDCVLGSAAGIRAALAQAAHHARHRSVFGARLVDQPLMRNVLADLSLESEAATTLALRLAGAADRAHRGDDGERAFLRLATAIGKYWVCKRQPMAVAEALECLGGNGYDEASGMPRLYREAPLNGIWEGSGNVNALDMLRALTREPASLEAFHAETEAAAGADARLDAARRELRAELARAQDAQLRARRVVERAALVLQGSLLVRHAPTAVADAFCASRLAGDQGLAFGTLPAGTDFGALLGRLPA

SEQ ID NO: 1951 - protein, 442 aa, Chloroflexus aggregans; identical to SEQ ID NO: 1941

SEQ ID NO: 1952 - protein, 557 aa, Geobacillus thermoglucosidasius
MRRLSDVDPNLLANLKKYLDKELYAYAEKELEQFYQLCMTDIDRRAVHTDREGQPRLIKYDRFGNEISEVWVNEGYQQTAKQTYETGIVGYVHKPIPELGRKGNYIYSYAQGYLLSQVETGVYCPVTLTMATAYLLEHFADENLKKKYLPHVISTGEIELYEGATFLTERQGGSDVGANAVRAVPCGDHYKLFGEKYFASNAGRCGVAAVLARIDGSEPGTKGLSLFLVPWRNEDGTLNSIQIRRLKDKLGVRAVPSAEVVFDGAKAYVIGDPKKGFYYMMEALNLSRVCNAVGSIGIMKRALEEAKQYAANRTAFGHKLTDYPMVRETLADLTARQEVQTSACFEMISVFERVMTAPDEATEEEKAWNRLLIALLKMRTAEEAIAFAHEAIEMHGGNGYIEDFVTPRLLRDAQVLTVWEGTANILGLEVLRLMRKYRVHEQFIAKMAEALSSLSDDVEPLASPVKQGLHELAEALKRLDGQPEEVQTFHAKKIANRLCDIYLSVVALERAQENERNCLIAQLFLQHIWNRHLVDEQMLSVRHFEVIIHGQRQLSPS

SEQ ID NO: 1953 - protein, 612 aa, Alicycliphilus denitrificans; identical to SEQ ID NO: 1947

SEQ ID NO: 1954 - protein, 401 aa, Arthrobacter phenanthrenivorans; identical to SEQ ID NO: 1924

SEQ ID NO: 1955 - protein, 402 aa, Arthrobacter phenanthrenivorans; identical to SEQ ID NO: 1925

SEQ ID NO: 1956 - protein, 614 aa, Streptomyces flavogriseus; identical to SEQ ID NO: 1948

SEQ ID NO: 1957 - protein, 442 aa, Chloroflexus aurantiacus; identical to SEQ ID NO: 1942

SEQ ID NO: 1958 - protein, 660 aa, Kineococcus radiotolerans; identical to SEQ ID NO: 1929

SEQ ID NO: 1959 - protein, 541 aa, Thermus thermophilus; identical to SEQ ID NO: 1921

SEQ ID NO: 1960 - protein, 439 aa, Owenweeksia hongkongensis; identical to SEQ ID NO: 1949

SEQ ID NO: 1961 - protein, 552 aa, Streptomyces griseus; identical to SEQ ID NO: 1950

SEQ ID NO: 1962 - protein, 653 aa, Streptomyces sp.
MVTDEAPTEASGYVQPEIDVPALAALLDGEYAEIRELVRSNLKTYASILEEAEELSLDAYRERVRELVVEMAATGQTGMGFPREYGGGGDVGASIAAFETLAFGDLSVLVKVGVQFGLFGGAILQLGTERHHDAYLPDLITGKLMGCFAMTETGHGSNVQALGTVARYDARSQEFVLTTPGEEARKDYIGNAARHGEVAVVFAQLEVDGTSEGVHAFVVPIRAGGEPAPGVRIEDDGRKMGLNGVDNGRLHFDGVRIPREALLNRFADVTPEGVYESPIDNPNRRFFTMLGTLVQGRVSVGGAAVNAAKVALTVATRYATRRRQFEPSPGEREQLLLDYGLHQRRLLPLIARTYALHFAQDVVRTRLHEVFSGNETDAQARRELEARAAGTKALTTWHATRTIQECREACGGAGYLSVNRFAALKSDSDIFTTFEGDNHVLLQLVAKGLLTDYASEFEDLDQLGTVRHVTGLAVETLLEKTSAHKLLERVRDLLPGGDEWDQEAGLLDSEYQLAMVRYREEHMLAGVARRLKSGVDQKRDPGAVFSEVQDHVIALAHAHVERLVLEAFVAKVRELPEGGEKVALGLLCDLFALSTIEADRAWFMEHGRLTVQRSKAITREVNDLCRKIRPLALDLVDAWGVPPELLRAPELVG

SEQ ID NO: 1963 - protein, 664 aa, Medicago truncatula
MSMAMARASSGLQYPERFYAAASYVGLDGSNSPTKSLTSKFPKSTALLLYSLYQQASVGPCNIPEPSSWKIVEHSKWASWNQLGNMSSTEAMRLFVKILEEEDPGWYSRASNSFAEPVIDVQMNHNSKVEPVIENGNTYPETKTISSENGSQVGTQDKDVVVESFGSVGVYDQWIAPPISGQRPKARYEHGAAAMQDKLYIYGGNHNGRYLSDLHVLDLRSWTWSKLEVKAGDESSTTLDPCAGHSLIAWGNKLLSIAGHTKDPSESIQVREFDLQRATWSTLKTYGKPPISRGGQSVSLVGNTLVIFGGQDAKRTLLNDLHILDLETMTWDEIDAVGVPPSPRSDHTAAVHVDRYLLIFGGGSHATCYNDLHVLDLQTMEWSRPTQQGEIPTPRAGHAGVTVGENWFIVGGGDNKSGASETVVLNMSTLTWSVVTSVQGRVSVASEGLSLVVSSYNGEDVLVSFGGYNGRYNSEVYVLKPSHKSTLQSKIIENSIPDSVSAIPNATNATRDMGSEFGAGHEGKILEIAMDNSYTTKSKGDLISVLKAEREELESSLSKEKLHTLQLKQELADAESSNSDLYKELQSVRGQLAAEQSRCFKLEVEVAELGQKLQNFGTLQKELELLQRQKAASEQAALSAKQRQGSGGVWGWLAGTPGQNADDE

SEQ ID NO: 1964 - protein, 664 aa, Medicago truncatula; identical to SEQ ID NO: 1963

SEQ ID NO: 1965 - protein, 696 aa, Micromonas sp.
MAHKLPFPDRFYAAVGFAANPPLGSRAVSDETRLLLYALYQQVTAGPCTTPKPFWNQLERAKWNSWNSLGSLSTIDAMRMYVSGIEDENPDWYDLVTNDGDEERVREVAEAAAEAVAAAGMDAKAQLARLDDRGDGGQKDQPSPRTPGPPPAGRRSLGRSPRPSADNLTQSVSRSSLSSRDPPLDPAVAKIPCLEDGTWTDVTYAVGGAKPRGRSGHASVRIGASEVWTVGGVRNGRRIADVCVFDTIKMEWASDDELRCSMKPGEVDVAHLTGWPARSGHAAVAFGTKILVIGGHTREDDPVDAQCEVWVLETTSREWSRLKVEGDAPCARGGHTATMVEGKGGRNPRVVVFGGEDRRGRLLDDARVLDLTKMRWIEDERTRTNKAPRGRGVKAPTWPAARSGHVACCFGYGSPDVYVFGGVKAGGAGEPTDELFCLNSMTMTWHRLNPAGVVPAPRTNSAGCVLDDGIWLIIGGGNGGGGLADTVGLKLANPRGVGANQVSGLEWFTAGEVQRGSALAAEGMTCVSVGGNPGECGAIIAFGGYDGRRYSNCTHAMRRPGRARMDTRGETKPREAAHEVGDASGHSARSVASPGVVAAMSRSNNGSAVSLRRVSSENSEIRRLRSENEAAKEALRRANERLAELGAAPIDFVIGDESGSGDKRSPPPPTRRRGLWAFISGGDADDVDSGYDSPAR

SEQ ID NO: 1966 - protein, 668 aa, Brachypodium distachyon
MASAGIAYPDRFYAAAAYAGFGAYGATTSSSAAISRFQNDVALLLYGLHQQATVGPCNVPKPRAWNPVEQSKWTSWHGLGSMPQAEAMRLFVKILEEEDPGWYSRVPELNPRPVVDIEMLKPKEEPNVLPASTNGTTPIPEPKTISENGSSVETQDKVVILEGLSTVSAHEEWTALSPSGQRPKPRYEHGATVLQDKMYIFGGNHNGRYLSDLQVLDLKSLSWSKIDAKLQAGSSDLAKTTQVSPCAGHSLISWGNRFFSIAGHTKDPSDNVTVKEFDPHTCTWSIVSTYGKPPVSRGGQSVTLVGTTLVVFGGEDAKRCLLNDLHILDLESMTWDDVDAIGTPPAPRSDHAAACHADRYLLIFGGGSHATCFNDLHVLDLQTMEWSRPKQQGLLPSPRAGHAGATVGENWYIVGGGNNKSGVSETLVLNMSTLAWSVVSTVEGRVPLASEGMTLVCSNYSGEDYLISFGGYNGRYSNEVYALKLSVKSDLQSNTEDQPISDSTSRVLEPEVEISQDGKIREIAMDNSDSVMSCFHVNRNDEASEQLLAALKAEKEELEATLNREGLQTVQLKEEITEAEARNAELTKELQAVRGQLAAEQSRCFKLEVDVAELRQKLQSLDALEREVELLRRQRAASEQAALDAKQKQGSGGVWGWLVGTPPDDSES

SEQ ID NO: 1967 - protein, 662 aa, Brachypodium distachyon
MASAGIAYPDRFYAAAAYAGFGAYGATTSSSAAISRFQNDVALLLYGLHQQATVGPCNVPKPRAWNPVEQSKWTSWHGLGSMPQAEAMRLFVKILEEEDPGWYSRVPELNPRPVVDIEMLKPKEEPNVLPASTNGTTPIPEPKTISENGSSVETQDKVVILEGLSTVSAHEEWTALSPSGQRPKPRYEHGATVLQDKMYIFGGNHNGRYLSDLQVLDLKSLSWSKIDAKLQAGSSDLAKTTQVSPCAGHSLISWGNRFFSIAGHTKDPSDNVTVKEFDPHTCTWSIVSTYGKPPVSRGGQSVTLVGTTLVVFGGEDAKRCLLNDLHILDLESMTWDDVDAIGTPPAPRSDHAAACHADRYLLIFGGGSHATCFNDLHVLDLQTMEWSRPKQQGLLPSPRAGHAGATVGENWYIVGGGNNKSGVSETLVLNMSTLAWSVVSTVEGRVPLASEGMTLVCSNYSGEDYLISFGGYNGRYSNEVYALKLSVKSDLQSNTEDQPISDSTSRVLEPEVEISQDGKIREIAMDNSDSVNRNDEASEQLLAALKAEKEELEATLNREGLQTVQLKEEITEAEARNAELTKELQAVRGQLAAEQSRCFKLEVDVAELRQKLQSLDALEREVELLRRQRAASEQAALDAKQKQGSGGVWGWLVGTPPDDSES

SEQ ID NO: 1968 - protein, 659 aa, Glycine max
MARASSGLQYPERFYAAASYVGFDGSTKSLTSKFSNSTALLLYSLYQQASIGPCNVPEPSSWKLVEHSKWASWNQLGNMSSTEAMRLFVKILEEEDPGWYSRASNSVLDPVVDVQMNHNSKVEPVIENANAYPEIKTISTENGSHVGTQDKDVVIEGFGSVGVYDQWVAPPVSGQRPKARYEHGAAVVQDKLYIYGGNHNGRYLNDLHVLDLRSWTWSKIEAEVVESTNSSSITFPCAGHSLIPWENKLLSIAGHTKDPNESIQVKVFDLPNATWTTLKTYGKPPVSRGGQSVTFVGTSLVIFGGEDAKRTLLNDLHILDLETMTWDEIDAVGVPPSPRSDHAAAVHVERYLLIFGGGSHATCYNDLHVLDMQTMEWSRPTQLGEIPTPRAGHAGVTVGENWFIVGGGDNKSGVSETVVLNMATLTWSVVTSVQGRVPVASEGSSLVVSSYDGEDILVSFGGYNGHYNNEVYVLKPSHKSTLQSKLIENPIPYSVSGAHNAANATRDLDSEAGHKGIIKELVMDSVDSIKSKGDVITVLKVEKEDLESSLYKEKLQTLQLKQELSETKTRNSDLCKELQSIRGQLASEQSRCFKLEVEVAELSQKLQTIGTLQKELELLQRQKAASELAALNAKQKQGSGGVWGWLAGAPPPTQKEDDG

SEQ ID NO: 1969 - protein, 662 aa, Glycine max
MARASSGLQYPERFYAAASYVGFDGSSPTKSLTSKFPQSTALLLYSLYQQASVGPCNITEPSTWKIVEHGKWASWNQLGNMSSTEAMRLFVKILEEEDPGWYSRLSNSVVEPVVDVQMNHNSKVEPVIENGNSYPETKTISISTQNGSEVGTQDKDTVVEGFGSVEVYDQWIAPPVSGGSPKARYEHGAAVVQDKLYIYGGNHNGRYLNDLHVLDLRSWTWSKIEAKTGVESPTTSIPCAGHSLIPWGNKLLSIAGHTKDPSESIQVKVFDLQMATWSTPKIFGKAPVSRGGQSVNLVGKTLVIFGGQDAKRTLLNDLHILDLETMTWDEIDAVGVPPSPRSDHTAAVHVERYLLIFGGGSHATCYNDLHVLDLQTMEWSRPMQLGEIPTPRAGHAGVTVGENWFIVGGGDNKSGVSETIVLNMSTLAWSVVTSVQGRVPVASEGLSLVVSSYDGEDVLVSFGGYNGRYNNEVYVLKPSHKSTLQSKIIENSIPDSVSAIPNVTNVESEFEAGHDSNPPVCIIAKDLRYFFLKSKGDIVSVLKAEKEELESSLIKEKHHALQLKQDLAEAESCNSDLYKELQSVRGQLASEQSRCFKLEVEVAELGQKLQTIGTLQKELELLQRQKAASEQAALNAKQRQSSGGVWGWLAGTPPPIQNADDA

SEQ ID NO: 1970 - protein, 646 aa, Glycine max
MAMARATSGLQYPERFYAAASYVGFDGSSPTKTLTSKFAKSTALLLYSLYQQASVGPCNIPEPSTWKLVEHSKWASWNQLGNMSSTEAMRLFVKILEEEDPGWYSRASNSVVEPVIDVQMNNSKVEPVIENGNSYPETKTISTQNGSEVGTQDKDIVVEGFGSVEVYDQWIAPPVSGGNPKARYEHGAAVVQDKLYIYGGNHNGRYLNDLHVLDLRSWTWSKIEAKTGVESPTTSIPCAGHSLIPWGNKLLSIAGHTKDPSESIQVKEFDLETAAWSTLKIFGKAPVSRGGQSVNLVGKTLVIFGGQDAKRTLLNDLHILDLETMTWDEIDAVGVPPSPRSDHTAAVHVDRYLLIFGGGSHATCYNDLHVLDLQTMEWSRPTQLGEIPSPRAGHAGVTVGENWFIVGGGDNKSGVSETVVLNMSTLTWSVVTSVQGRVPVASEGLSLVVSSYDGEDILVSFGGYNGRYNNEVYVLKPSHKSTLQSKIIENSIPDSVSAIPNVTNVESEFEAGHDADPPVCDLVSVLKAEKEELESSLSKEKQHALQLKQDLVEAESRNSDLYKELQSVRGQLASEQSRCFKLEVEVAELGQKLQTIGTLQKELELLQRQKAASEQAALNAKQRQSSGGVWGWLAGTPPPSRNADDA

SEQ ID NO: 1971 - protein, 658 aa, Glycine max
MAMARATSGLQYPERFYAAASYVGFDGSSPTKTLTSKFAKSTALLLYSLYQQASVGPCNIPEPSTWKLVEHSKWASWNQLGNMSSTEAMRLFVKILEEEDPGWYSRASNSVVEPVIDVQMNQNSKVEPVIENGNSYPETKTISTQNGSEVGTQDKDIVVEGFGSVEVYDQWIAPPVSGGNPKARYEHGAAVVQDKLYIYGGNHNGRYLNDLHVLDLRSWTWSKIEAKTGVESPTTSIPCAGHSLIPWGNKLLSIAGHTKDPSESIQVKEFDLETAAWSTLKIFGKAPVSRGGQSVNLVGKTLVIFGGQDAKRTLLNDLHILDLETMTWDEIDAVGVPPSPRSDHTAAVHVDRYLLIFGGGSHATCYNDLHVLDLQTMEWSRPTQLGEIPSPRAGHAGVTVGENWFIVGGGDNKSGVSETVVLNMSTLTWSVVTSVQGRVPVASEGLSLVVSSYDGEDILVSFGGYNGRYNNEVYVLKPSHKSTLQSKIIENSIPDSVSAIPNVTNVESEFEAGHDADPPVCIIDADPPKSKGDLVSVLKAEKEELESSLSKEKQHALQLKQDLVEAESRNSDLYKELQSVRGQLASEQSRCFKLEVEVAELGQKLQTIGTLQKELELLQRQKAASEQAALNAKQRQSSGGVWGWLAGTPPPSRNADDA

SEQ ID NO: 1972 - protein, 543 aa, Desulfosporosinus meridiei
MEKTIHFFEDKGLKSIKEDDQASRWYTDFLKLIKKEQIFSTLLTPAGYGASDSRFDLFRVCEFNEISAFYSLSYQYAYQVSILGLGPIWMGDNEKAKHFTAQKLREGAIFAFGLSEKTHGADLYSNEMSLTLNGEESYLANGGKYYIGNANEAALVSTFAKYSENNDYVFFVVDSQHRNYKLNKKISTSGVRSAYVGDYELIDYPITKDEILSSGTLAWDSALSTINIGKFQLGFASIGICTHAYYEALNHASYRELYGKKVTDFPHIQKIFTESYARLIAMKLYALRSLDYFRSASDDDRRYLLFNPIQKMKVTTQGMKIIEMLLDAIAAKGFEQDTYFETAIRDIGMIPRLEGTTHVNIALVIKFINNYFFNPVEYPAIPKRDDPADDSYLFRQKAGKLASVRFPNYHLPYEGIQIPNVIIFLEQIELFRTFLEQAGPNHEQLKNIDYMLALGEMFTLIVYAQLILENSKLNPISSELLSEIFSFIVRDFAQFALTQISNYNNTTQQEYFLKAMLKKPHLDSEITRKLWNNEVKPLIGIYQ

SEQ ID NO: 1973 - protein, 589 aa, Desulfitobacterium metallireducens
MELALKGGGFLLAEVTPDQVFVPEELNEDHLQLKTMAHNFVEKEIAPKIEKIEEQEDGLMKEFLHQAGELGLLGLEVPEEFGGSGMDKFSTVVVGEEVPRGASFAVSFAAHTGIGTLPIVYFGTPEQKAKYLPSLASGEKIAAYCLTEPGSGSDALGAKSTAVLNPEGTHYILNGTKQFITNAGFADIFLIYAKVDGKLTNFIVEREYPGVSFGPEEKKMGIKGSSTRQVILEDVKVPVENVVGEVGRGHVVAFNILNVGRFKLAAAAIGSAQLALEVSVKYAGERKQFGTPLSRFGAIQTKLAEVATQSYLAESVVYRTAGLMEEGFYGLDLTGDCRKEAGKALEEYAIECSLNKVLASEVLDLSVDEGVQIHGGYGFIQEYPIERMYRDSRINRLFEGTNEINRLLVPGTLLKRALTGELPLLAAAKAVSKDLLSGGLSSEGEGLAGLLQMTQKAKKVFLLAAGLATQNLGNELKDNQYVLLGLAEMVLQIYTMESGILRALKVQELNVSEEHKRFVEKAATLGAFEAMNVLEQQGKEVLCAVEKGDSLSTVLAGLRKLVRRPNVDMIELRQDIANAVIAKEKYPIR

SEQ ID NO: 1974 - protein, 543 aa, Desulfosporosinus meridiei; identical to SEQ ID NO: 1972

SEQ ID NO: 1975 - protein, 589 aa, Desulfitobacterium metallireducens; identical to SEQ ID NO: 1973

SEQ ID NO: 1976 - protein, 658 aa, Zea mays
MASSGLAYPDRFYAAAAYAGFGVGEATSSAAISRFQNDVALLLYGLHQQATVGPCNVPKPRAWNPVEQSKWTSWHGLGSMPSAEAMRLFVKILEEEDPGWYSRAPEFNPEPVVDIQMHKPKDEPHSVPGSTNGTSIPEPNISENGSSVEAQDKDVILEGLSTVSSHDQWTPLSVSGLRPKPRYEHGATVLQNKMYIFGGNHNGRYLSDLQALDLKSLTWSKVDAKLQAEPADSTKTTQIAPCAGHSLISWGNKFLSIAGHTKDPSEGVTVKEFDPHTCTWSIVRTYGKPPVSRGGQTVTLVGTTLVLFGGEDAERCLLNDLHILDLETMTWDDVDAIGTPPSPRSDHAAACHADRYLLIFGGGSHATCFNDLHVLDLQTMEWSRPKQQGPTPSPRAGHAGGTVGENWYIVGGGNNKSGVSETLVLNMSTLTWSVVSTVEGRVPLASEGMTLVHSNYGGYDYLISFGGYNGRYNNEVYTLKLSLKSDSQSTLKEETLSDTTSRVIEPEAEIYQDGKIREISVDNADSDLNNRNDEASEQLLADLKAQKEELEATLSREQLQTVQLKEDIARAETRNAELTKELQAVRGQLASEQSRCFKLEVDVAELRQKLQSMDALEKEVELLRRQRAASEQAAMDAKQRQSSGGMWGWLAGSPTPAV

SEQ ID NO: 1977 - protein, 609 aa, Natronobacterium gregoryi
MGSALDYSKFEEGRGVNYWKLDRAIRRELRRIYTDEEFEWAEPRLTAFGEVVGHTIADNADYVDDHGPELESYDKHGEVQNRVRYPAELLETERLAYEHGIVADAFETPPDRDEPMPLSHNLAMQYLLSYADPGFDCPVAMTAGAALVLEKFDDGSLAAYYEALTSRDYEGLIEGAMFLTEKQGGSDVGAAETLAEYDDEADCWRLTGEKWFCSNIDAEGTLALARTPDAPEGTDGLSMFLVPHADPDRSDGPWTKGDRLEDGPLSPGEVNDQRYRRLKDKLGTISVPTGAVEFGGAKASLVGEEERGFEQMTEMLNLERLSNAAASCGIIARALLESKIHAANREAFGETIDQYPLMREDLVDMTVDHEAATAYVFEVARLFSERERAERAGDTADDTYRLMRLLIPIAKLRTARMAVDTASYAMEVQGGNGYVNDFVTNRLLRDAQVLPIWEGTENILSLDVLRALEREDAHEPFRAAVEERLESVSHPALEDAAETVEAEFRDLETALVTLAGEDAEYAQLSAKRLSHYVFDVFTAALLLEEAQIEIEDGDGRLALVANRFVTNELEKREARGMTGGDRFVLEAFDAVVHHEPTDYESLLDRQEEV

SEQ ID NO: 1978 - protein, 609 aa, Natronobacterium gregoryi; identical to SEQ ID NO: 1977

SEQ ID NO: 1979 - protein, 407 aa, Geodermatophilus obscurus; identical to SEQ ID NO: 1943

SEQ ID NO: 1980 - protein, 414 aa, Xylanimonas cellulosilytica; identical to SEQ ID NO: 1926

SEQ ID NO: 1981 - protein, 408 aa, Micrococcus luteus; identical to SEQ ID NO: 1944

SEQ ID NO: 1982 - protein, 404 aa, Micrococcus luteus; identical to SEQ ID NO: 1945

SEQ ID NO: 1983 - protein, 402 aa, Micrococcus luteus; identical to SEQ ID NO: 1946

SEQ ID NO: 1984 - protein, 658 aa, Zea mays; identical to SEQ ID NO: 1976

SEQ ID NO: 1985 - protein, 557 aa, Geobacillus thermoglucosidasius; identical to SEQ ID NO: 1952

SEQ ID NO: 1986 - protein, 590 aa, Caldalkalibacillus thermarum
MSVQSQIDRRLYSDNIPRLEGRSKNFYLDDPNIQYLMRRYLPERMQEWAHRELTQFGERVAGPIDERAAYTDREGKPVLKKYNRLGEDISEIWKNEGYLQTVREVYGKGIVSYLYHAPKELGEKVPYLYSYLMGYLLSESEPGFYCPVTLTMSCAYLVDRYGDPELKQRYLPGLTTTDGEKVYEGATWLTERQGGSDVGANRTVARYDEQAGVYRLTGEKFFASNAGAMVATVLARVSDRPGTKGLGLFLVPWIKPNGERNRIYVRRLKEKLGVNAVPSAEVILEEAEGYLIGDPEKGFKYMAEALNISRICNAVASVGILRRAFAEALYYTTHRQAFGQPVIQYSMVKEMLIDMLVDLEVTTGAIFQMIDYFDQVVTFQKATEKERVMARLLIPLLKYRAGEVAVKGCHTSIELHGGNGYIEEYVTPRLLRDAQVTTVWEGTSNILALDLLRVIQKKRGHEVFFQVVQEELEFLSHPASQPFKPVIRNAMADIQTVLAKLPSFDYDRLTYKLKPLANLMIDVFLLLQILKEAEHQAKEKSNLRKFVVAELFKAKAFDPPREHKLFTERHLDLDYFEELVHYGKVNRLDQ

SEQ ID NO: 1987 - protein, 590 aa, Caldalkalibacillus thermarum; identical to SEQ ID NO: 1986

SEQ ID NO: 1988 - protein, 447 aa, Hordeum vulgare
FENVIFISVCCFSTGSNVQALQTTATFDPVTDEFIVDTPNDGAIKWWIGNAALHGKFATVFARLILPLQGKGGEPADMGIHAFIVPIRDLETHAVLPGIEINDCGHKIGLNGVDNGALRFRSVRIPRDNLLNRFGDVARDGKYTSSLPTINRRFAATLGELVGGRVGLAYSSVGVLKVSVTIAVRYALLRQQFGPPKEPEISVLDYQSHQHKLMPMLASAYAFHFARSYLVDMYSEMKKTNDEDLSADVHVLSSGLKSYITSYTAKAISICRESCGGHGYAAVNRFGGLRNDHDIFQTFEGDNTVLLQQVAGDLLKQYQQKFKGGTLSVTWNYLRDSMSTYLSQPNPVTARWEGEDHLRDPKFQLDAFRYRTSKLLHSVAARLQKHMKTLGGFGAWNRCLNHLLTLAESHIESVILARFIEAVKRYRFCAVTCPQLHCAYHHCLLAS

SEQ ID NO: 1989 - protein, 418 aa, Caenorhabditis remanei
MGNLDIQNRFIEDLSISADYEKVASKYRAIFEKIAQGVVEREQQRILPYEQIDWLKHAGFGALRVPVKFGGDGVSLPQLFQLLTELAQTDSNIVQALRGHFAFVEDRLNAHKFKSQELWFKRFVQGDLVGNAWTEIGHVKIGDVITRVTQNNNQLLVNGKKYYSTGTIFADWVDLFAYDERTDQHVIAAISRHASGVEVQDDWDGFGQKTTGSGTLTLSNVAVEADHILPFEQRFKYQTAFYQVIHLATLSGIAQSAVATFIHEVQKRDRIFSHGNADLVRNDPQILQVIGKASAQAYASESITTQTAEALQRAYISHFSESEVKNIQANNDAELEAAQGQVVISDLVLELTSKLFNALGASASTTTKQLDRFWRNARVVSSHNPVVYKEKVIGDWEVNREPLPFVWQIGTSPKVGAA

SEQ ID NO: 1990 - protein, 536 aa, Oryza sativa
MASSGLAYPDRFYAAAAYAGFGAGGATSSSAISRFQNDVALLLYGLYQQATVGPCNVPKPRAWNPVEQSKWTSWHGLGSMPSAEAMRLFVKILEEEDPGWYSRVPEFNPEPVVDIEMHKPKEDPKVILASTNGTSVPEPKTISENGSSVETQDKVVILEGLSAVSVHEEWTPLSVNGQRPKPRYEHGATVVQDKMYIFGGNHNGRYLSDLQALDLKSLTWSKIDAKFQAGSTDSSKSAQVSSCAGHSLISWGNKFFSVAGHTKDPSENITVKEFDPHTCTWSIVKTYGKPPVSRGGQSVTLVGTTLVLFGGEDAKRCLLNDLHILDLETMTWDDVDAIGTPPPRSDHAAACHADRYLLIFGGGSHATCFNDLHVLDLQTMEWSRPKQQGLAPSPRAGHAGATVGENWYIVGGGNNKSGVSETLVLNMSTLTWSVVSSVEGRVPLASEGMTLVHSNYNGDDYLISFGGYNGRYSNEVFALKLTLKSDLQSKTKEHASDGTSSVLEPEVELSHDGKIREIAMDSADSDLVISCAVHFD

SEQ ID NO: 1991 - protein, 655 aa, Oryza sativa; identical to SEQ ID NO: 1825

SEQ ID NO: 1992 - protein, 656 aa, Oryza sativa
MASSGLAYPDRFYAAAAYAGFGAGGATSSSAISRFQNDVALLLYGLYQQATVGPCNVPKPRAWNPVEQSKWTSWHGLGSMPSAEAMRLFVKILEEEDPGWYSRVPEFNPEPVVDIEMHKPKEDPKVILASTNGTSVPEPKTISENGSSVETQDKVVILEGLSAVSVHEEWTPLSVNGQRPKPRYEHGATVVQDKMYIFGGNHNGRYLSDLQALDLKSLTWSKIDAKFQAGSTDSSKSAQVSSCAGHSLISWGNKFFSVAGHTKDPSENITVKEFDPHTCTWSIVKTYGKPPVSRGGQSVTLVGTTLVLFGGEDAKRCLLNDLHILDLETMTWDDVDAIGTPPPRSDHAAACHADRYLLIFGGGSHATCFNDLHVLDLQTMEWSRPKQQGLAPSPRAGHAGATVGENWYIVGGGNNKSGVSETLVLNMSTLTWSVVSSVEGRVPLASEGMTLVHSNYNGDDYLISFGGYNGRYSNEVFALKLTLKSDLQSKTKEHASDGTSSVLEPEVELSHDGKIREIAMDSADSDLKKDDANELLVALKAEKEELEAALNREQVQTIQLKEEIAEAEARNAELTKELQTVRGQLAAEQSRCFKLEVDVAELRQKLQSMDALEREVELLRRQKAASEQAALEAKQRQSSSGMWGWLVGTPPDKSES

SEQ ID NO: 1993 - protein, 648 aa, Unknown; identical to SEQ ID NO: 1101
  Description of Unknown: Acyl CoA binding protein polypeptide

SEQ ID NO: 1994 - protein, 618 aa, Oryza sativa
MASSGLAYPDRFYAAAAYAGFGAGGATSSSAISRFQNDVALLLYGLYQQATVGPCNVPKPRAWNPVEQSKWTSWHGLGSMPSAEAMRLFVKILEEEDPGWYSRVPEFNPEPVVDIEMHKPKEDPKVILASTNGTSVPEPKTISENGSSVETQDKVVILEGLSAVSVHEEWTPLSVNGQRPKPRYEHGATVVQDKMYIFGGNHNGRYLSDLQISWGNKFFSVAGHTKDPSENITVKEFDPHTCTWSIVKTYGKPPVSRGGQSVTLVGTTLVLFGGEDAKRCLLNDLHILDLETMTWDDVDACTPPPRSDHAAACHADRYLLIFGGGSHATCFNDLHVLDLQTMEWSRPKQQGLAPSPRAGHAGATVGENWYIVGGGNNKSGVSETLVLNMSTLTWSVVSSVEGRVPLASEGMTLVHSNYNGDDYLISFGGYNGRYSNEVFALKLTLKSDLQSKTKEHASDGTSSVLEPEVELSHDGKIREIAMDSADSDLKKDDANELLVALKAEKEELEAALNREQVQTIQLKEEIAEAEARNAELTKELQTVRGQLAAEQSRCFKLEVDVAELRQKLQSMDALEREVELLRRQKAASEQAALEAKQRQSSSGMWGWLVGTPPDKSES

SEQ ID NO: 1995 - protein, 454 aa, Toxoplasma gondii
MGRAGRNIRAEGRLVQLSGQVKREPVDSTLCSKNSDGKSSNDNSSDELQDGKPAADMRHGKTGGGPIYALDFMHFDSLLTPRERTLRGRVQNIVSRYVEHAVLPLYEAAAFDSELVEICKKFGPAGLQIKGYGCPGLTHTEAILMAVEMARVDASFSTFYLVHCGLAMQSIAVAGTQEQKAMWLPKMSRLECIGSFGLTEPNHGSDATGLRTSAKKVEGGWILNGQKRWIGNATFSDIVVVWARDVHSEKILGFIVEKDFPGFSATKIENKVSLRIVQNADIVLKDCFVPDSHRLQHEGFSGATAQVLESSRAVVAAECVGVLLGAYDNALKYCTERKQFGRELATFQLVQERLMRVLGMLQGVLLLVLRLGRLMDEGKPHMMAHIALAKATCSRVAREGIALCREVLGGNGIVTDFGVAKFHADIEALYTYEGTYDINMLIAGRAVTGRSAFK

SEQ ID NO: 1996 - protein, 676 aa, Oryza sativa
MASSGLAYPDRFYAAAAYAGFGAGGATSSSAISRFQNDVALLLYGLYQQATVGPCNVPKPRAWNPVEQSKWTSWHGLGSMPSAEAMRLFVKILEEEDPGWYSRVPEFNPEPVVDIEMHKPKEDPKVILASTNGTSVPEPKTISENGSSVETQDKVVILEGLSAVSVHEEWTPLSVNGQRPKPRYEHGATVVQDKMYIFGGNHNGRYLSDLQALDLKSLTWSKIDAKFQAGSTDSSKSAQVSSCAGHSLISWGNKFFSVAGHTKDPSENITVKEFDPHTCTWSIVKTYGKPPVSRGGQSVTLVGTTLVLFGGEDAKRCLLNDLHILDLETMTWDDVDAIGTPPPRSDHAAACHADRYLLIFGGGSHATCFNDLHVLDLQTMEWSRPKQQGLAPSPRAGHAGATVGENWYIVGGGNNKSGVSETLVLNMSTLTWSVVSSVEGRVPLASEGMTLVHSNYNGDDYLISFGGYNGRYSNEVFALKLTLKSDLQSKTKEHASDGTSSVLEPEVELSHDGKIREIAMDSADSDLKKDDANELLVALKAEKEELEAALNREQVQTIQLKEEIAEAEARNAELTKELQTVRGQLAAEQSRCFKLEELQTVRGQLAAEQSRCFKLEVDVAELRQKLQSMDALEREVELLRRQKAASEQAALEAKQRQSSSGMWGWLVGTPPDKSES

SEQ ID NO: 1997 - protein, 494 aa, Ostreococcus lucimarinus
MSRAHDADGVEDAVLFDEDKTLLLDALERQASRGPCQGTRPWDLWDPAGALAYDAWSMLGNISPERAMELYCEVISSRYADWFDMLVRGMSEKQKRAMIATAKECALEYYRALASGALGESARLAQTKDARRALAFNSSTGPTAFLDEMFASAADDEFVRLPILSKVSPRARSGHMSAVVDGDTIFFSHGRGSRSRLLGDLWAFDLATGAWAERKLQWPGSTCAGAASATIGSKLYAFRGKSADDCDVDGVYSLTVSAIDLTADYASKDFKWTHVRCETSDEVSTPPRARSGHTSTAIGDRIFIFGGVDAKTGDDLDELWEFTPTTTVWKKLANGTRPRSSHAATSVDERYLLVCGGSTGNELCDCGAVDVYDVVKGEWGTVDGDNEDGDRPSPRAAHASVAIGNQWFVIGGGDNENATQDAYTFDLRACVDERKCRWTLFAESCALIGKEGMSASAVVSPSSKRVFLLLHGGLNEKGAVCDTIACRLAPLASH

SEQ ID NO: 1998 - protein, 537 aa, Ostreococcus tauri; identical to SEQ ID NO: 1922

SEQ ID NO: 1999 - protein, 418 aa, Caenorhabditis remanei; identical to SEQ ID NO: 1989

SEQ ID NO: 2000 - protein, 664 aa, Medicago truncatula; identical to SEQ ID NO: 1963

SEQ ID NO: 2001 - protein, 494 aa, Ostreococcus lucimarinus; identical to SEQ ID NO: 1997

SEQ ID NO: 2002 - protein, 669 aa, Arabidopsis lyrata
MAMPRATSGPAYPKRFYAAASYVGLDGSDSSAKNVSSKFSDDTALLLYALYHQATVGPCNTPKPSAWRPVEQSKWRSWQGLGTMPSIEAMRLFVKILEEDDPGWYSRASNDIPDPVVDVQINQRTKDEPVVENGNSFGETKTISTENGRLAETQDKDVVSEDSNTVSVYNQWTAPQTSGQRPKARYEHGAAVIQDKMYIYGGNHNGRYLGDLHVLDLKNWTWSRVETKVATDAQETSTPTLLAPCAGHSLIAWDNKLLSIGGHTKDPSESMQVKVFDPHTSTWSMLQTYGKPPVSRGGQSVTLVGKTLVIFGGQDAKRSLLNDLHILDLDTMTWDEIDAVGVSPSPRSDHAAAVHAERYLLIFGGGSHATCFDDLHVLDLQTMEWSRPAQQGDAPTPRAGHAGVTIGENWFIVGGGDNKSGASESVVLNMSTLSWSVVASVQGRVPLASEGLSLVVSSYNGEDVLVAFGGYNGRYNNEINLLKPSHKSTLQTKTLEAPLPGSLSAVNNATTRDIESEVEVSQEGRVREIVMDNVNPGSKVEGNSERIIATIKSEKEELEASLNKERMQTLQLRQELGEAELRNTDLYKELQSVRGQLAAEQSRCFKLEVDVAELRQKLQTLETLQKELELLQRQKAASEQAAMNAKRQSSGGVWGWLAGSPQEKDDDSP

SEQ ID NO: 2003 - protein, 685 aa, Oryza sativa; identical to SEQ ID NO: 733

SEQ ID NO: 2004 - protein, 669 aa, Arabidopsis lyrata; identical to SEQ ID NO: 2002

SEQ ID NO: 2005 - protein, 656 aa, Oryza sativa; identical to SEQ ID NO: 1992

SEQ ID NO: 2006 - protein, 668 aa, Arabidopsis thaliana; identical to SEQ ID NO: 1100

SEQ ID NO: 2007 - protein, 696 aa, Micromonas sp.; identical to SEQ ID NO: 1965

SEQ ID NO: 2008 - protein, 685 aa, Oryza sativa; identical to SEQ ID NO: 733

SEQ ID NO: 2009 - protein, 682 aa, Physcomitrella patens
MAQLPYPDRFHAAAEFAGFSSSSSPSSPSSTSSRSLSTQRLSEVLPDETRLILFALYKQATLGPCTVKKPWGWNVVEHVKWTSWNHLGNMNSLEAMRLFVRTVEGIDPNWYAKERTLNLRALEDSAAVESASKELTKLLLEKNVPTLSKASDSVVSKEKHMDEPVAEGIDAITSYREWVPVNVTGRKPLARYQHSAAVVEGKLYVIGGNHNGRYLNDVQVLDLKTLTWSKVDTRVPQSPFSSKQDPLQPWLPQCAGHRLIRWKELLLVVGGHAKPAAETVTVHSFDIHSLSWTKLSVYGQAPVSRGGHSVTLIGTQLYMFGGEDLKRRLFNDLNILDLETMTWKSVIASGACPSPRADHVATAYRDSCIFVFGGGSHSDCYNDLHALDLETMEWALVPTKGIVPRPRAGHAGATHGDNWYVVGGGDNTGAISETLVLNMATLSWSVEDVVQVTSATASEGLSVEVAENALLAFGGYNGYFSNEVHAYILGPALLPEIVNQVPPVEATEQNTTSLNEEGSSSDSEEIIESSALDEESDAKVVSKEDSPSTSRREAPPNDEIEQRFRNDELEQLRMAVGAAQAEVEKLKVENAAALSSLADVEQELLLVRSQLQGEQSRSFRLEVEIAELRQKLLSMEALQKELDLLHRQMAVSERAANEASQKDSKVGVWGWLAGAPPASRYD

SEQ ID NO: 2010 - protein, 454 aa, Toxoplasma gondii; identical to SEQ ID NO: 1995

SEQ ID NO: 2011 - protein, 659 aa, Zea mays; identical to SEQ ID NO: 1824

SEQ ID NO: 2012 - protein, 430 aa, Oryza sativa
MGSLAGGGGGGKVGLPALDVALAFPQATTASQFPPAVSDYYQFDDLLTDEEKTLRKKVRGIMEREIAPIMTEYWEKAEFPFHAIPKLATLGLAGGTTKGYGCPGLSLTASAISVAEVARVDASCSTFILVHSSLAMSTIALCGSEAQKQKYLPSLTQFRTIGCWALTEPDYGSDASSLRTAATKVPGGWHLDGQKRWIGNGTFADVLIILARNSDTNQLNGFIVKKGAPGLKCTKIENKIGLRMVQNADIVLNKVFVPDEDRLTGINSFQDINKVLAMSRIMVAWQPIGISMGVFDMCHRYLKERKQFGVPLAAFQLNQEKLVRMLGNIQAMLLVGWRLCKLYESGKMTPGHASLGKAWTSKKAREVVSLGRELLGGNGILADFLVAKAFCDLEPIFSYEGTYDINSLVTGREITGIASFKPAALTKSRL

SEQ ID NO: 2013 - protein, 433 aa, Oryza sativa
MAGKQGDGREEDGAKVGLPALDISLAFPQATPASIFPPSASDYYQIDDLLTTEEQSIRKNVRAIMEKEIAPIMATYWEKAEFPFHAIPKLSSLGVAGGTIKGYGCPGLSITASAITMAEIARVDASCSTFILVHSSLAMVTIALCGSEVQKQKYLPSLAQLTAVGCWALTEPNHGSDASSLITTATKVPGGWHIDGQKRWIGNSTFADVLVVLARNANTKQLNGFIVRKGAPGLKATKIENKIGLRMVQNGDIVFNKVFVPEEDRLPGVNSFQDISKVLAISRVMVAWQPIGISMGVFDVCHRYLKERKQFGVPLVAFQLNQEKLVRMLGNIQAMLLVGWRLCKLYESGKMTPGHASLGKGWTSRMAREVVSLGRELLGGNGILADFLVAKAFCDLEPIYSYEGTYDINSLVTGREITGIASFKPAALAKARL

SEQ ID NO: 2014 - protein, 682 aa, Physcomitrella patens; identical to SEQ ID NO: 2009

SEQ ID NO: 2015 - protein, 668 aa, Arabidopsis thaliana; identical to SEQ ID NO: 1100

SEQ ID NO: 2016 - protein, 709 aa, Candida maltosa; identical to SEQ ID NO: 117

SEQ ID NO: 2017 - protein, 752 aa, Joostella marina
MKKTTYTAEILKYIPFLYVIWSDELLSPSEISVFKKSIETDSISEAAKTTLKKWINAEESPLDETLVSWKKIINDSGLKLIESDAYPLTSFSMRLASNSQSTEIYDESLKYIEINLGIQPNHYHHLFDVKIETASSAAFYSAEKIDTLLKGEHAPYVDKFREKLNDPIFDFQIIRNKEEFRNHVLTQVKFLAKDGYGAMAYDNAYGGIGNMPTYASIFENLMYVDGSLTIKFGVQFGLFGGSIQNLGTKKHHDKYLKETGEANLLGCFAMTETRHGSNVRGVKTTATYVKETDSIVIETPGENDNKEYIGNALHAEMATVFAQLIVNGKNEGVHAILTRIRDKDGNLMPGVKVEDNGYKLGLNGVDNGKIWFSNVAVPRENLLNRYGDIDKDGNYTSPIENPNKRFFTMLGTLVGGRICVAKGALSGAKKALSIAVKYALQRRQFNSNEKIQEDLIMDYPTHQLRLIKPIAKSYVYHTVLDKLIKDYANSKEDGRREIETQAAALKASITWFSNQTIQECREACGGKGYLIENKIPHIKGDVDIFTTFEGDNTVLIQLAAKGILTNFKTEFNSDNFMDVLKYVGTQLSDRLTTINPIFTNKTDKEHLFDTEFHKEAFEYRTRRLTFSVASRVQKYIKKGIPSYQAFLKVQTHMVMLGKAYSEELSYNEFLNFVEKIQEEELRFLFKKLGALFALSEINHHAAWYLEHGYISANKSKAIRKQVERICSELRPHVNTLVDGFGIPKSCLKTPIL

SEQ ID NO: 2018 - protein, 752 aa, Joostella marina; identical to SEQ ID NO: 2017

SEQ ID NO: 2019 - protein, 408 aa, Arthrobacter sp.
MSLDTDTGTVAAARLYGVCDYYDAESLLTEDERRVLGRLRNFLDREAQPLLADYWERGEFPTQLAQPLIDLDLMEPAELTGALGAKSSPARGIYQGFRIFELARADASLATWYTSQAGLFRTAIRVGASPEQQAEWMPKVVDFSLKGVFSLTEPDSGSDIAGGLSTTARREGDSWVLNGAKRWIGGAVSADVLAVFARDQEDGQVKAFLVDRQAEGVTLEKIHGKTALRMMQNAHIRLDGVRVPESMRLHNVNSFKDVAAMLRAMRSDVAWIATGIQAGAFEAALRYVTERTQFGRQLGSFQLVQEKLARMLGNVTSSLSLVVRLTEQQARGIYRDQDSALAKMQTSLLMRETVALAREVVGGNGITLETDVARFHADAEAVYSYEGTHEINALIVGRALTGESAFTR

SEQ ID NO: 2020 - protein, 404 aa, Arthrobacter sp.
MPVQPQRRDDGETTTVPEQPPFPEADLMYIVDLLPAGERSRYLEVREFLQSRIRAASIEYWNREEFPFGLLAEMGKFGLGGLQTDGTSALFKGLMYVEVARADVSLSALVGIHNELIVGMIDELGSEAQKQRWLPGLKAFTQLGAFALTEPDHGSDIAGGLETSARLERGEWVINGAKRWIGAGTIADFALVWARDEADRQIKGFIVETDRPGYSATKISNKIGLRIMQNADIVLDEVRIPESNLLPGATDFSKANDLLRDSRAWVGWQCAGIQLAAFDVARAYALERKQFGKELARFQLIQQQLAEILGNASASLALMAQLARIQQDGKLEMVQAAMAKSTTTRLARASVAMGRSLMGGNGISSDYEMGKLFGDAEILYTYEGSYEINSLIVARAVTGKSAFV

SEQ ID NO: 2021 - protein, 663 aa, Verrucosispora maris; identical to SEQ ID NO: 568

SEQ ID NO: 2022 - protein, 402 aa, Tsukamurella paurometabola
MTDKTTEDLAEGIARSRGTDYLHMRELITDDEAALLLKVREFGERELLPIVNDYWERGEFPFEILPGLRELEIVGDTMQGYGTTPMTAVGQGLVSYELGRIDGSIGTFIGVHVGLAMQSIYILGSEEQRQRWLPAMARLEKIGAFALTEPNHGSDSVALEATATRDGDHWVINGAKRWPGNAVWCDIIIVFARDTADGKVKGFVVEKDDPGYRATKIGGKVSLRMVQNADIVLDDLRIPDDRRLVNCNGFPDVSKVLMGTRNQVAWASTGHAVAAYEIALNYAQKRVQFGKPIANTQVVQSKLVEMLGEVTAMQLYCIRLGRLLDEGAVTDTMAALAKYFCSVKARHVCRLARDVLGGNGITLEFHVMRHLCDMEALVTYEGTAEIQSLLVGREITGGGAFV

SEQ ID NO: 2023 - protein, 402 aa, Tsukamurella paurometabola; identical to SEQ ID NO: 2022

SEQ ID NO: 2024 - protein, 694 aa, Sanguibacter keddieii
MTTVSDRQRARTTPEADGDQPTVDVPALQTLMLGRWAGLRRRAREIGADPRFSKVEGASMHDARQRVLGQLKLLVEEGEVLRAFPERLGGSDDAGGNIAGFEELLVADPSLQIKAGVQWGLFGAAILHLGTPEQHDRLLPGAMSIEVPGAFAMTETGHGSDVASIATTATYDAGTEEFVIHTPFRAAWKDYLGNAAEHGTAAVVFAQLVTHGVNHGVHAFYTTIRETLPDGSAGPFVDGVGGDDDGLKGGLNGIDNGRLHFDQVRVPREDLLARYGQVAPDGTYSSPIESPGRRFFTMLGSLVQGRVSLDGAAGVASKIALATAVRYGNERRQFSSGTGSDETVLLDYGEHQRRLLPLVAHAYAGHFAHDRLLDLFHAVFSGETDTPESREDLETMAAALKPVSTWRALETLQTAREACGGQGFLTENRLVSLRADMDVYVTFEGDNTVLLQLVGKRLLADYAAGFKGIDGIGMARFVVERAADSVLYRTPLGRVAQTLQDRGEVRRSAGHLREEVAQRELLTDRVETMVAELANALRPASKMGREEAAALFNTHQHELIEAARAHADLVQWEAFSKALGDVDDPGTQLVLTWVRDLYGLSVIEKNLAWYLINGRLTAQRARTVSSYTDRLVARLRPYAQDLVDGFGYGPEHVRATIATGVEKQRQDEAREARRVARASGDEPVSEKAMGKKKA

SEQ ID NO: 2025 - protein, 415 aa, Rhodothermus marinus
MGSFPFNPDDAFLFESMLKEEDRLIMETAREYAQSCLEPRALEGNQQGIFHMEIPREMGELGLLGVTIDPKYGGGGASYTAYGLIARELERVDSAYRSFMSVQSSLVMFPIEKYGTEEQKRKYLPKLATGELIGCFGLTEPDHGSDPGSMETTARRVDGGWILNGTKAWITNAPIADIAVVWARAKEHPDDEGEIMGFILERDMPGLSTPETKNKMSLRASSTGEIVMEDVFVPDANVLPGVRGLRGPFSCLSNARYGIAWGTVGAAEDCYQRTRRYVMERTQFGYPLAAMQLIQTKLANMLTEITQMQLLVFRLGQLADEGKVTPAQISLAKRNNAGKALEIARMARDMHGANGIVGEYRVIHHMVNLESVNTYEGTYDIHGLILGREITGIQAFVPRGNDLPPKKKPAPATAS

SEQ ID NO: 2026 - protein, 415 aa, Rhodothermus marinus; identical to SEQ ID NO: 2025

SEQ ID NO: 2027 - protein, 402 aa, Staphylococcus carnosus
MSNKEEVLKELYPEDIMNISKGLTDGEVKLLKQLDDVLESKFRKDINRHWADATIPEGFFEEMGKLQYFTNPLLYEGREGAKTPSQLFQFFMSYTIGRFDVSLITLLGVHQGLGHNTFLFGGSKEQVAKYVPKLQSHELRTCFALTEPDHGSDVAGGLETIAEKKGDKWVINGSKKWIGGANVADVIPVFAVNKETGKPVCFVVRPEQDGVDIDVLQDKIALRIVPNALITLKDVEVSEEDRLQNINSFKDIAKILYSTRAGVAYMATGGMAGTLRATLDYVKQRKQFGKPLSNYQLVQEKLAMIQGNLAQAMSTCAALARMQEHGEYDEVATSAAKMMNALRFRESAAMGRGITGGNGILAGEYDIARFFSDAEAVYTYEGTHEINALVIGRALTGDSAFV

SEQ ID NO: 2028 - protein, 466 aa, Deinococcus geothermalis
MELPATHTWTEYNGSMTSQSQNPAELLAHLDLEALARLSQKVDLPALLAAASRLSDGQLRQLSRLLDRSTRPPRALPEPDGDFYRQLDDLTPEQQDVRLRVRRFMEERVAPIMNEYWSRDEFPRHLIPELRQLDLPRRVWNEDGTRQPDATLIEGLITLEACRIDVSTAVFFGVHTGLAFASIALGGSAEQKAEWLPKMLDLETIGAFGLTEPEGGSQVSQGMRTTCQRDGDHWILNGEKKWIGNSTFSDFTVVWARDVDTGEVRGFIVRAGTPGYDVRKIAGKIALRMVENGHITLTHCRVPDTDRLQETRGWRTTAEVLRLTRAGVAWQGVGCALGAYELALKYAQTREQFGKPIGAFQLIQNHLVHMLGNVTTTLSLCLRLSQMADAGQMRDEHAALAKVVTAARCRETVALARETFGGNGILLDHLVAKHFADTEAIYSYEGTNEINTLVVGRAITGLSAFV

SEQ ID NO: 2029 - protein, 550 aa, Agrobacterium sp.
MTGMNRTEESLAELNQPSLWSGINAYRSDPLIVDLTSGLSRNLRDEFDQLGRYVTSHEAQELARMANQGVPQLHTHGPRGERLDQVEFHPAWHALMRRSMSSGLHSSVWENAAETRGNEHKARATKFYLTSQLEAGHLCPLTMTSASVAAIMTSSRVQKEWVPKILSRKYDSSQKPALQKTAVTVGMGMTEKQGGTDVRANRSTAERVGEGIYRLSGHKWFLSAPMSDGFVMLAQMGDGMGCFLVPRYLEDGSANGLHFQRLKDKLGNRSNASAEVEFTDAFGYLLGEPGSGVRTILDMVTLTRLDCALASSGMMRASLAEAVHFARGRSVFGKTLVSQPIMTRVLADMALDVAAATALSFRLASAFDAARNNASEAAYARVMTPIVKYWCCKIAPALIYEAMECLGGNGYVEERPIARHYREAPVNAIWEGSGNVMALDVLRVLQRGKDLFDLVFQTLERDLGPAGKKTTDVLRAAIALAERDEGAARLLVEQFALAAAAAELCRLGAGKIADAFLETRLAGGWRHTYGMLDSRFDPNYIIDLLYPPAS

SEQ ID NO: 2030 - protein, 707 aa, Micrococcus luteus
MTVHEKLAPQSPTHSTEVPTDVAEIAPERPTPGSLDAAALEEALLGRWAAERRESRELAKDPALWRDPLLGMDEHRARVLRQLGVLVERNAVHRAFPREFGGEDNHGGNISAFGDLVLADPSLQIKAGVQWGLFSSAILHLGTAEHHRRWLPGAMDLSVPGAFAMTEIGHGSDVASIATTATYDEATQEFVIHTPFKGAWKDYLGNAALHGRAATVFAQLITQGVNHGVHCFYVPIRDEKGAFLPGVGGEDDGLKGGLNGIDNGRLHFTQVRIPRTNLLNRYGDVAEDGTYSSPIASPGRRFFTMLGTLVQGRVSLSLAATTASFLGLHGALAYAEQRRQFNASDPQREEVLLDYQNHQRRLIDRLARAYADAFASNELVVKFDDVFSGRSDTDVDRQELETLAAAVKPLTTWHALDTLQEAREACGGAGFLAENRVTQMRADLDVYVTFEGDNTVLLQLVGKRLLTDYSKEFGRLNVGAVSRYVVHQASDAIHRAGLHKAVQSVADGGSERRSANWFKDPAVQHELLTERVRAKTADVAGTLSGARGKGQAAQAEAFNTRQHELIEAARNHGELLQWEAFTRALEGITDETTKTVLTWLRDLFALRLIEDDLGWFVAHGRVSSQRARALRGYVNRLAERLRPFALELVEAFGLEPEHLRMAVATDAETQRQEEAHAWFTARRAAGEEPEDEKAVRAREKAARGRRG

SEQ ID NO: 2031 - protein, 645 aa, Mycobacterium sp.
MTTTAEHLRNALDGRWRDVKNDMRDKLSHEVFKPHYTPNTVIARTKVNEQLRIMAAEGAAEDGFAKEHGGNGNVGAAITQIEMLAMSDLSLMVKAGVQWGLFGGAVENLGTERHHEQYVKRIIDCDLLGCFAMTETGHGSDVQSLETTATYDPDTQEFVVNSPTPTARKDYIGGAAQTARMAAVFAQLITHEDGKPVNHGVHCVLVPIRDENGNDLPGVTTSDCDYKGGLPGVDNGRIVFDNVRVPRVNLLNRYGDVAEDGTYTSPIENPNRRFFTMLGTLIRGRVTVGGSGAAAARVALDIATRYALQRKQFSAPDGGEVVIMDYLVHQRRLLPLIARSYALQFAQNELVAKCHELQSAEHPDAEEQRELEARAAGLKAANTWHASRAIQESREACGGAGYLAENRLIGLRGDIDVFTTFEGDNHVLTQLVAKELLTAYADDVKGMSPVEWVRFAANTVGTRVMKRTAAETIMQTILDTRQDNEEEGSLFNRGTQVQMFEDREEYLLSSVARRLQGKSKEMSAFDAFNAVQDHVLHTAQAHIDRIVLEAFVAGIDACEDEEARNILGMVCDLYALSVIEEDKAWYIEHRFLSTERAKAVTRGINERCRSLRPYAELLVDGFGIPEQLRYAAMMDPKELLTAEPA

SEQ ID NO: 2032 - protein, 645 aa, Mycobacterium sp.
MTTTAEHLRNALDGRWRDVKNDMRDKLSHEVFKPHYTPNTVIARTKVNEQLRIMAAEGAAEDGFAKEHGGNGNVGAAITQIEMLAMSDLSLMVKAGVQWGLFGGAVENLGTERHHEQYVKHIIDCDLLGCFAMTETGHGSDVQSLETTATYDPDTQEFVVNSSTPTARKDYIGGAAQTARMAAVFAQLITHEDGKPVNHGVHCVLVPIRDENGNDLPGVTTSDCDYKGGLPGVDNGRIVFDNVRVPRVNLLNRYGDVAEDGTYTSPIENPNRRFFTMLGTLIRGRVTVGGSGAAAARVALDIATRYALQRKQFSAPDGGEVVIMDYLVHQRRLLPLIARSYALQFAQNELVAKCHELQSAEHPDAEEQRELEARAAGLKAANTWHASRAIQESREACGGAGYLAENRLIGLRGDIDVFTTFEGDNHVLTQLVAKELLTAYADDVKGMSPVEWVRFAANTVGTRVMKRTAAETIMQTILDTRQDNEEEGSLFNRGTQVQMFEDREEYLLSSVARRLQGKSKEMSAFDAFNAVQDHVLHTAQAHIDRIVLEAFVAGIDACEDEEARNILGMVCDLYALSVIEEDKAWYIEHRFLSTERAKAVTRGINERCRSLRPYAELLVDGFGIPEQLRYAAMMDHKELLTAEPA

SEQ ID NO: 2033 - protein, 704 aa, Debaryomyces hansenii
MSSVTKNVEFSEAPNPATLIGAEREAAVFNPETMNYFLEGSKEKSEEVKKFIQQMERDPILAASPKVYDLTKEEQRELTAQKINRVSRYIEVESFDELERRLSLISVFDPQLHTRIGVHLGLFLSCVRGNGSFEQLNYWALTKEAAYVKNIYGCFAMTEIAHGSNVAGLETTATFNEENDEFVINTPHIGATKWWIGGAAHSATHAAVYARLIVHGKDYGVKTFVVPLRDSNHDLMPGVSVGDIGAKMGRDGIDNGWIQFSGVRIPRFFMLQKFTKVTAEGKVTLPPNNQLSYSALLGGRVVMVKDAFRWSSRVITIALRYAVGRRQFKASKAGENDKENQLLDYPLHQRRLIPLLAMTYAFSNGSNVLQELSHKTMDELDDAVAEDDKAGIDKGIEAMKSLFVASGSLKSTCTWLTLSTIDQCRQACGGHGYSAYSGFGKIYNDWAVQCTWEGDNNILGMSIGKQLVKSISSVLRDGQNVTGILEFLTDSKKYLNRDVILQNEDMNDTRKVLHAVEVAIIRASNQALTTLDAHGEDWDFIGANLVQLSKLLAHFFLLKAFLDKVDSIEEKELVPVLDKLAQLYSATIILEEFSGIFLTYSVVSTESISILTDQHIPKLCKDLRPHVIPLTDSFQLSDMMINSSLGSYNGDIYENYFKIVKEANPPFNHKAPYSTDLEAMLNRPSQEDRQRHEYSDEAEEILSK

SEQ ID NO: 2034 - protein, 413 aa, Streptomyces griseus
MDAAFTAEQHEIRRTLRELLARSGGPDAIPAAVRTAEGYDPALWRRLAGGLGLPGLALAEEYGGAGCTVTELALACEETGRALLPTPLLATAVLAAPLIAALGTPDQRAALLPRIAAGTLTAALAVPGGSLATALGLTGDNADGAWAGGGRAGGIQARGPGQDGGRRLYGEADRVLDGHSAHLLLVAAHAGGYPRSRTQLFLVDAGAAGLARTRLTALDETRPLARVELRDTPAELLGADADADATAALAAAGRAAAAILAAEAVGTAASALERTVEYVKAREQFGRAVGSFQAVKHRLADLYVRVEAARSAAYHAARDPEAGPLALAQALEAAGITTGEAVQLHGGIGFTWEHEAHRYLKRAAGDELLFGPVHRLRDHAARRAGLFGAATAFRQPAATGSRPPAGIAYGAGV

SEQ ID NO: 2035 - protein, 823 aa, Nitrosomonas sp.
MLMFLFYVILLLVAVISLILAVPVIRRFLVSNQILKIFRKMLPQISQTEQEALDAGTVWWEGELFSGKPDWKKLLAYPKPQLTAEEQAFLNGPVEQLCAMLDEWQITHELKDLPPEVWQFIKEKGFFGLIIPKQYGGYGFSALAHSEVVMKIGSRSGTAAVTVMVPNSLGPAELLLHYGTEKQKEYYLPRLAKGLEVPCFALTSPEAGSDAGSMPDFAVVCRGEYEGKTDVLGMRVTWEKRYITLGPVATILGLAFKLYDPDKLLGGNEDLGITLALIPTNTPGVNIGRRHYPLNGAFQNGPNWGKEVFIPMDWIIGGQEGVGQGWRMLMNCLSVGRAISLPATSVGAAKLAARTAGAYSRVRTQFKTPIGYFEGIEEALARIGGNTYMMDAARVMTAGSVDLGEKPSVASAIVKYHLTERGRQAVNDAMDIHGGKAICIGPRNYLGRTYQQIPVSITVEGANILTRNMIIFGQGALRCHPYLLKEVNATHDKNPDSASLAFDEALIGHAKFTLCNTANSLVYALFGDYIKDNAPENSSPETAVYYRQLARFSASFAFIADVGLMRLGGSLKRKERLSARLGDILSMLYLCSATLKRFEDDGRPSADLPLLHWSMQDAMYQMQQAFDEFLTNFPGHIALIWLLRALVFPLGKRCKRPADDLAHEVSRLMMEPGAVRDRLTTGIYVPTADNEPMADLELALQCVIECGAVEAKLREATKLRQITARGDEKIAQALALKVITAAEADLLNKMKDLRSRVVKVDDFPPDFGKETKTASNGGGKATRSAVNSDKNTAAAKRGDDTASTASESTESAKTASENKDTVE

SEQ ID NO: 2036 - protein, 645 aa, Mycobacterium sp.; identical to SEQ ID NO: 2031

SEQ ID NO: 2037 - protein, 645 aa, Mycobacterium sp.; identical to SEQ ID NO: 2032

SEQ ID NO: 2038 - protein, 408 aa, Arthrobacter sp.; identical to SEQ ID NO: 2019

SEQ ID NO: 2039 - protein, 404 aa, Arthrobacter sp.; identical to SEQ ID NO: 2020

SEQ ID NO: 2040 - protein, 402 aa, Rubrobacter xylanophilus
MPCMPPNPHSAADFARTDRLLSREELAVRDRVRAFVEEEVIPVAAEHWDRAQFPFGLLKGLGELGLLGGTYEKRYGGSGMNNVAYGLGVAELARGSGSLSTFLHVQSGLAMAAIHELGSEEQKERWLPPMARCEKTGCFALTEPEAGSDPASMRTTASRAPGGYVLEGEKRWIGNASFADVAVVWAKGEDGRVRGFLVEKGAEGFEARVIPRKGSQRAVWQAHIRLRRCFVPEENRLPLAEGLGSTLSILTHSRYGVGWDGLGQAADCYERALEHSLRRRQFGHPIAAFQLVQHRLVRMATSLAELRLLAVHMGRLKDAGELDPPLVSMFKMSSLSKAREIAALARETLGGNGILLDHRVMEHMADIEGAYTYEGTDDINALIVGQAITGHRAFAPRPAGPA

SEQ ID NO: 2041 - protein, 404 aa, Rubrobacter xylanophilus
MRVLTRAEGLMSATDYYLLDELLGEEEREVRERVRAFCEKEVLPVIGDYWNREEFPFELVGKFADLGIVGGAIRGYGCPGLSRLAEGIVAAELARADGSINTFYGVHSGLAMGTIAMLGSEEQKQRWLPSMARMEKIGAFGLTEPEHGSDVVMLETTARREGDEWVLDGRKKWIGNASFADLVIVWARDLSDGEVKGFVVEREEAGEAFSAEVIKGKTGKRAVWQAEIELRGVRVPHENKLEGANSFKDTSKVLTATRYGVAWEGVGHAVAAYEAALAYAKERRIFTRPLESYQLIQNKLANMLSEITAMQLICFRLAQLFEQGKMTGGMASLAKMHTAKKARQVCLEARDILGGNGLLLEHVVGKHLADVEVVYTYEGTDIVQSLIVGREITGTQAFAPSRAG

SEQ ID NO: 2042 - protein, 401 aa, Rubrobacter xylanophilus
MSARAGGATAERAIDPRDFLELDALLSEEERAVRDRVRSFVEERVRPNIKGWYEEARFPRELVPEMGALGLLGMHLEGYGCAGRSAVEYGLACMELEAGDSGIRTFVSVQGSLAMSAIHRFGSEEQKQEWLPRMARGEAVGCFGLTEPTAGSDPASMKTFARRDGDGWVIEGAKRWIGMASIAEVAVIWARTDEEGNPVRGFLVPTAAQGFSATNIEPKLSMRASIQCDIELRGVRVPAGAMLPGAAGLRAPFSCLNEARYGIIWGSMGAARDCYECALEYSLRREQFGRPVASFQLTQKKLADMVVEIQKGMLLALHLGRMKDAGALKHQQISLGKLNNVREAIKIAREARAILGGNGVTLDYPPLRHANNLESVRTYEGTDEVHTLILGQAITGIEAFR

SEQ ID NO: 2043 - protein, 402 aa, Rubrobacter xylanophilus; identical to SEQ ID NO: 2040

SEQ ID NO: 2044 - protein, 404 aa, Rubrobacter xylanophilus; identical to SEQ ID NO: 2041

SEQ ID NO: 2045 - protein, 401 aa, Rubrobacter xylanophilus; identical to SEQ ID NO: 2042

SEQ ID NO: 2046 - protein, 466 aa, Deinococcus geothermalis; identical to SEQ ID NO: 2028

SEQ ID NO: 2047 - protein, 550 aa, Agrobacterium sp.; identical to SEQ ID NO: 2029

SEQ ID NO: 2048 - protein, 413 aa, Streptomyces griseus; identical to SEQ ID NO: 2034

SEQ ID NO: 2049 - protein, 406 aa, Frankia sp.
MTTATSGVRVESSAEPAVYDLPVPDLSAEALAAVTAEIAETAAEYDRTGETPWKGLDVAYRAGLLTATVGRRYGGPEVGQRDLVRILTAIGEGDASVGLLASNLLMSHAGQAIHPHWPVAYYDDLLRRSLDGPALVNAIRAEPELGAPARGGIPKTTATRTADGWVLRGHKAYGSGGEALAYHVVWAVADESGGDPARPRVGHVIVPGGLPGIRWVGTWDHLGLRATHTDDVIYENVELPADAFVEIPRGADGVYRDPAAMAGPGGFGHPALYVGVARAARAAFAEFARSRVPSALGRPIATTERIQSVAGEIDLQVVQAETLLHGALLRLEAGDAALVPELSVLKAAIARSVIAATQTAVAALGNPGLSRHHPLERHLRDALCIRVHPPQEDAALLASGRRVLGA

SEQ ID NO: 2050 - protein, 414 aa, Frankia sp.
MNAHSSELTSVAPTAAPGADAGADEELRAELRAVARDLLAAAGGKDGGDGAEVDWALLAEAGWLGLEVPDELDGAGVTVAETAVVCQELGRAAARAPYLGTAVLGVGALLALEPADGRDDLLRALAGDAPRLAVALPTGDAPLGPAGLPAAVPFRLAGAGGARRLTGRAQFVPDAAEAETLLLLALDEGDEPVVVRVAPGQRGVRVTATPVLDVSRSLSEVAATDAPVEAGSVWRFGGDGRAGGRLLLARGALAVACDSLGAAEAMLAATVEYASVRHQFGRPIGSFQAVKHGCADMLVSVSVGRGLVVEGTRALAAASAAQVAGGAGGAGGVDEAAVSAAEVAVSRAKSYMCAAAVDVAGKAMQLHGGIGYTWESGVHRYLKRAALSRALFGSPAAHRARLARRLDADAAGRA

SEQ ID NO: 2051 - protein, 414 aa, Frankia sp.; identical to SEQ ID NO: 2050

SEQ ID NO: 2052 - protein, 406 aa, Frankia sp.; identical to SEQ ID NO: 2049

SEQ ID NO: 2053 - protein, 818 aa, Methylobacter tundripaludum
MIWLIALLILVGVLAYGRASLRWTTLVLFGWLGLYSMAKGGGNFVLLLWVVFDAVFIPLNVPAIRKRLFSRVIFKIMKKMLPQMSQTEREALEAGNTWWDAELFSGNPDWKVLLDLPVAKLTAEEQAFIDGPVETLCSMLDDWDITHNRRDLPVEVWDYIKGHKFCGMIIPKRYGGLEFGEYAHSEIVMKISSRSSTAAVTVMVPNSLGPAKLLLAYGTEQQKNHYLPRLATGEEIPAFALTGPHAGSDAGAMPDTGVICYGKFEGQDKVLGIRLNWEKRYITLGPVATVLGLAFKLYDPEHLIGEKENIGITVALIPTDTQGVSIGRRHFPLDSAFQNGPNWGKDVFIPVDWIIGGVDQVGNGWKMLMQCLATGRAVSLPALSTGAAKMASRNTGAYARIRKQFNLPIGEFEGIEEPLSRIAGETYIIDAARKVTAAALDDGQKPSVISAIIKYELTERMRRVINDAMDIQGGSGICLGPKNYLGRMYQVIPVSITVEGANILTRTMMIFGQGAVRCHPYIQREMEALGQENPELALQQFDGVLFEHIGSVLHNLAAGFWLGLSNARFVDVPGDQDTQGYFRQIARLSVGFALVADFALLTLGGSLKRKERLSGRFADVLSNLYLCSCVLKHYQDQGRQQDDLPLLHWACQQTLHRAQQSLLAIFHTLPMRFPAYLLRAVLFPGGKPYSPPADHLIHQTAALLLKNSPARNRLTHGIYINHKPDDVTGRIEVAFQAVFAATHVETKIQTAQKQKQLPKGAILDVLDAAISKAIISKKEAELIVDAEKARFTAISVDDFSPEQLSSVGVKMQSNRNTI

SEQ ID NO: 2054 - protein, 818 aa, Methylobacter tundripaludum; identical to SEQ ID NO: 2053

SEQ ID NO: 2055 - protein, 694 aa, Sanguibacter keddieii; identical to SEQ ID NO: 2024

SEQ ID NO: 2056 - protein, 707 aa, Micrococcus luteus; identical to SEQ ID NO: 2030

SEQ ID NO: 2057 - protein, 402 aa, Staphylococcus carnosus; identical to SEQ ID NO: 2027

SEQ ID NO: 2058 - protein, 823 aa, Nitrosomonas sp.; identical to SEQ ID NO: 2035

SEQ ID NO: 2059 - protein, 613 aa, Chlamydomonas reinhardtii
MSCPLSYPDKFHAAARFWHLQLPGTKAFSQENQLLLYSLNQQATHGPNTTSRPWGWNTVEATKWQGWKELGKMSAMEAMRLFVKSLDEEQPDWWPLLQAADAKAAAGGSAAAEAAATTRSVPERSVLGLWTQLEMPAADKKPAPRYEAAAAVVGNAMYVLGGNYGGRYLSDVWALDLTSGTWSAVPLARPAEEGGSSGGAAPAPAAASGSGSGFPPTAGHSVTAWNGKLYVLGGHTKAKGAATMSLRVVDPAARTVTEPEASGTVPPARGGHTATLIGDKVWVFGGEDGSRRALADVFVLDLASLTWSTPEVSGKAPPPRSASCATVYQDRYLVAFGGGSVATCYSDVHVLDTETLTWSQPAQAGAKVSPRAGHSGAVLGDIWYIVGGGNNVKGCADLLAADLAALPTSNTLTWHVVTSVAIRDPLSSEGISLVMVQQPRVLVAFGGYNGKYQNAAKLGSMAELERELDKYRRAAREAAEKEAAAKKSSGLCTHAPPLLLPPPPLPPPLPLPPPLPPPLPVCSDHVFIIDEYKTSKTCYNCGCQEMAIKRLGGLKEGQRPWSVKVCNDCLTTWNRDVSAANVIRVLLLLKLMGFERPTKLQRPPWPPAAAGPG

SEQ ID NO: 2060 - protein, 775 aa, Micromonas pusilla
MGSRLPYPNRFYAAVGFAASPPVGAKAVSNDTRLLLYALYQQVTAGPCVDAKPWGWNAIETAKWQAWTTLKDMSKPDAMRHYVQTLEEENANWFQLVTDGEDPARVAEVTTAAQKAAEAMMDVTGRYTNVDADDNARAGEEIASTSERSRLNKAIDADADDSPTTTFAPTKPKSSPAPSPSKRAIPTANTSLGRFLGKISGAVANGAWSVVSERVSGDVPRGRYDHAAVVVGDELYAIGGTSGGRRAGDVHALHVPTLTWRKAAVRGTGTAAGEDEPSPSFGRRSGHAAVVVGAKIVVVGGFEGRDPREADDATCDVWILDTASAAPWRWRTLALRGGDDAPRARGGHTATVVARRGAATSIVVFGGEDLRGRLLGDVHVLRIDDDVEKGGAEKGGGAFTGSWSTPGAVFAPASFTPRSHHVAAYFHGEVFVFGGVAKGGAGRETDALFALDVDLMAWREVTPRGDPPSARIGAAAVVTDGWWFIAGGGGAGGAAADTAALRVSRSDGVFEWVRTGNLKPGHAVASEGLTVSSAHDGAALIAFGGYDGERYGADVSVLWKPTESETVAARAAEIEAAATKAAAAEEDEDEEEESGERARLFTNDVVAASSNPMGGIFDPIALAAARSPRARSPRASAGAAEATSKSSPAPATPRSPRGVTARGGGDAGGGDDDDDVASLRARLAMSERDAAATKLALSDEQAKTLRLELEVAQLRKKIGEYEEAEAAAATRSARARAAREAEDELAGGGGGGGGGKRRGLWGFIAGDAPEYEENA

SEQ ID NO: 2061 - protein, 655 aa, Arabidopsis lyrata
MAHMVRASSGLAYPERFYAAASYVGLDGSQSSVKQLSSKFSNDTSLLLYALHQQATLGPCNIPKPSAWNPVEQSKWKSWQGLGTMLSIEAMRLFVKILEKEDPGWYPRASNSVLEPAVDVQINSTKAEPSFESGASFGETKTISTEDERLTVTQDKDVVLEDPNTVSVYNKWTAPRTPGQPPKARYEHGAAVIQDKMYVYGGNHNGRYLGDLHVLDLKNWTWSRVETKVVTESQETSSPAKLTHCAGHSLIPWESKLLSVGGHTKDPSEFMIVKEFDLLSCSWSILKTHGKPPISRGGQSATLVGKSLVIFGGQDGKKSLLNDLHILHLDTMTWDEMDVVGSPPTPRSDHAAAVHAERYLLIFGGGSHTTCFDDLHVLDLQTMEWSRHTQQGEAPTPRAGHAGVTIGENWYIVGGGDNKTGASKTVVLNMSTLAWSVVTSVQGHVPLASEGLSLVVSSYNGEDIVVAFGGYNGHYNNKVNVLKPSHKSSLKSKIMGASAVPDSFSAVNNATTRDIESEIEVEGKAERIITTLESEKEEVGASLNKEKIQTLQLKEELAEIDTRNTELYKELQSVRNQLAVEQSRCLNLDGETFLSNVEVAELRQKLQTMETLQKELELLQRQRAVASEQVAAMNAKRQSSGGVWGWLAGTPPPKT

SEQ ID NO: 2062 - protein, 669 aa, Oryza sativa; identical to SEQ ID NO: 987

SEQ ID NO: 2063 - protein, 430 aa, Oryza sativa; identical to SEQ ID NO: 2012

SEQ ID NO: 2064 - protein, 433 aa, Oryza sativa; identical to SEQ ID NO: 2013

SEQ ID NO: 2065 - protein, 655 aa, Arabidopsis lyrata; identical to SEQ ID NO: 2061

SEQ ID NO: 2066 - protein, 704 aa, Debaryomyces hansenii; identical to SEQ ID NO: 2033

SEQ ID NO: 2067 - protein, 3816 aa, Streptomyces antibioticus
MTNDEKIVEYLKRATVDLRKARHRIWELEDEPIAITSMACHFPGGIESPEQLWELLSAGGEVLSEFPDDRGWDLDEIYHPDPEHSGTSYVRHGGFLDHATQFDTDFFGISPREALAMDPQQRLLLETSWQLFERAGVDPHTLKGSRTGVFVGAAHMGYADRVDTPPAEAEGYLLTGNASAVVSGRISYTFGLEGPAVTVDTACSSSLVALHLAVQALRRGECSLAVVGGVAVMSDPKVFVEFSRQRGLARDGRSKAFAASADGFGFAEGVSLLLLERLSDARRLGHRVLAVVRGSAVNQDGASNGLAAPNGPSQQRVIRAALADAGLAPADVDVVEAHGTGTRLGDPIEAQALLATYGQGRTSGRPVWLGSVKSNIGHTQAAAGVAGVMKMVLALERGVVPKTLHVDEPSPHVDWSTGAVELLTEERPWEPEAERLRRAGISAFGVSGTNAHVIVEEAPAEPEPEPEPGTRVVAAGDLVVPWVVSGRDAGALRAQAARLAAHVSSTGAGVVDVGWSLVATRSVFEHRAVMVGTDLDSMAGSLAGFAAGGVVPGVVSGVAPAEGRRVVFVFPGQGSQWVGMAAGLLDACPVFAEAVAECAAVLDPLTGWSLVEVLRGGEAVLGRVDVVQPALWAVMVSLARTWRYYGVEPAAVVGHSQGEIAAACVAGGLSLADGARVVVLRSRAIARIAGGGGMVSVSLPAGRVRTMLDTYGGRLSVAAVNGPSSTVVSGDAQALDELLAGCEREGVRARRVPVDYASHSAQMDQLRDELLEALADITPQHSSVPFFSTVTADWLDTTALDAGYWFTNLRETVRFQEAVEGLVAQGMGAFVECSPHPVLVPGIEQTLDTVEADAVALGSLRRDEGGLGRFLTSLAEAFVQGVPVDWSRTFEGASPRTVDLPTYPFQRQRFWLEGSPALSSNGVEGEADVAFWDAVEREDSAVVAEELGIDAKALHMTLPALSSWRRRERQRRKVQRWRYRVEWKRLPNSRAQESLQGGWLLVVPQGRAGDVRVTQSVAEVAAKGGEATVLEVDALHPDRAAYAEALTRWPGVRGVVSFLAWEEQALAEHPVLSAGLAASLALAQALIDVGGSGESAPRLWLVTEAAVVIGAADTGAVIDPVHAQLWGFGRVLALEHPELWGGLIDLPAVAGEPGSITDHAHADLLATVLATMVQAAARGEDQVAVRTTGTYVPRLVRSGGSAHSGARRWQPRDTVLVTGGMGPLTAHIVRWLADNGADQVVLLGGQGADGEAEALRAEFDGHTTKIELADVDTEDSDALRSLLDRTTGEHPLRAVIHAPTVVEFASVAESDLVRFARTISSKIAGVEQLDEVLSGIDTAHDVVFFSSVAGVWGSAGQSAYAAGNAFLDAVAQHRRLRGLPGTSVAWTPWDDDRSLASLGDSYLDRRGLRALSIPGALASLQEVLDQDEVHAVVADVDWERFYAGFSAVRRTSFFDDVHDAHRPALSTAATNDGQARDEDGGTELVRRLRPLTETEQQRELVSLVQSEVAAVLGHSSTDAVQPQRAFREIGFDSLTAVQLRNRLTATTGMRLPTTLVFDYPTTNGLAEYLRSELFGVSGAPADLSVVRNADEEDDPVVIVGMACRFPGGIDTPEAFWKLLEAGGDVISELPANRGWDMERLLNPDPEAKGTSATRYGGFLYDAGEFDAAFFGISPREALAMDPQQRLLLETVWELIESAGVAPDSLHRSRTGTFIGSNGQFYAPLLWNSGGDLEGYQGVGNAGSVMSGRVAYSLGLEGPAVTVDTACSSSLVALHLAVQALRRGECSLAIAGGVTVMSTPDSFVEFSRQQGLSEDGRCKAFASTADGFGLAEGVSALLVERLSDARRLGHRVLAVVRGSAVNQDGASNGLTAPNGPSQQRVIRAALADAGLAPADVDVVEAHGTGTRLGDPIEAQALLATYGQGRAGGRPVVLGSVKSNIGHTQAAAGVAGVMKMVLALERGVVPKTLHVDEPSPHVDWSAGEVELAVEAVPWSRGGRVRRAGVSSFGISGTNAHVIVEEAPAEPEPEPGTRVVAAGDLVVPWVVSGRDAGALREQAARLAAHVSSTGAGVVDVGWSLVATRSVFEHRAVMVGSELDSMAESLAGFAAGGVVPGVVSGVAPAEGRRVVFVFPGQGSQWVGMAAGLLDACPVFAEAVAECAAVLDPVTGWSLVEVLRGGGEAVLGRVDVVQPALWAVMVSLARTWRYYGVEPAAVVGHSQGEIAAACVAGGLSLADGARVVVLRSRAIARIAGGGGMVSVGLSAERVRTMLDTYGGRVSVAAVNGPSSTVVSGDVQALDELLAGCEREGVRARRVPVDYASHSAQMDQLRDELLEALADITPQHSSVPFFSTVTADWLDTTALDAGYWFTNLRETVRFQEAVEGLVAQGMGAFVECSPHPVLVPGIEQTLDALDQNAAVLGSLRRDEGGLDRLLTSLAEAFVQGVPVDWTHAFEGMTPRTVDLPTYPFQRQHYWPKPAPAPGANLGDVASVGLTAAGHPLLGAVVEMPDSDGLVLTGQISLRTHPWLADHEVLGSVLLPGTAFVELAVQAADRAGYDVLDELTLEAPLVLPDRGGIQVRLALGPSEADGRRSLQLHSRPEEAAGFHRWTRHASGFVVPGGTGAARPTEPAGVWPPAGAEPVALASDRYARLVERGYTYGPSFQGLHTAWRHGDDVYAEVALPEGTPADGYALHPALLDAAVQAVGLGSFVEDPGQVYLPFLWSDVTLHATGATSLRVRVSPAGPDTVALALADPAGAPVATVGALRLRTTSAAQLARARGSAEHAMFRVEWVEEGSAADRCRGGAGGTTYEGERAAEAGAAAGTWAVLGPRVPAAVRTMGVDVVTALDTPDHPADPQSLADLAALGDTVPDVVVVTSLLSLASGADSPLGNRPRPTAAEQDTAATVAGVHSALHAALDLVQAWLADERHTASRLVLVTRHAMTVAESDPEPDLLLAPVWGLVRSAQAENPGRFVLADIDGDEASWDALPRAVASAASEVAIRAGAVYVPRLARATDEGLVVADEAAGPWRLDVTEAGTLANLALVPCPDASRPLGPDEVRIAVRAAGVNFRDVLLALGMYPDEGLMGAEAAGVVTEVGGGVTTLAPGDRVMGLVTGGFGPVAVTHHRMLVRMPRGWSFAEAASVPVAFLTAYYALHDLAGLRGGESVLVHSAAGGVGMAAVQLARHWDAEVFGTASKGKWDVLAAQGLDEEHIGSSRTTEFEQRFRATSGGRGIDVVLNALSGDFVDASARLLREGGRFVEMGKTDIRTDLGVVGADGVPDIRYVAFDLAEAGAERIGQMLDEIMALFDAGVLRLPPLRAWPVRRAHEALRFVSQARHVGKVVLTVPAALDAEGTVLITGAGTLGALVARHLVTEHDVRRLLLVSRSGVAPDLAAELGALGAEVTVAACDVANRKALKALLEDIPPEHPVTGIVHTAGVLDDGVVSGLTPERVDTVLKPKVDAALTLESVIGELDLDPALFVIFSSAASMLGGPGQGSYAAANQFLDTLARHRARRGLTSVSLGWGLWHEASGLTGGLADIDRDRMSRAGIAPMPTDEALHLFDRATELGDPVLLPMRLNEAALEDRAADGTLPPLLSGLVRVRHRPSARAGTATAAPATGPEAFARELAAAPDPRRALRDLVRGHVALVLGHSGPEAIDAEQAFRDIGFDSLTAVELRNRLNAETGLRLPGTLVFDYPNPSALADHLLELLAPATQPTAAPLLAELERVEQLLSAAASPGGPASAVDEETRTLIATRLATLASQWTHLPVGSPGNADNRSGPGESGQAQESGATGEHTAAWTSDDDLFAFLDKRLET

SEQ ID NO: 2068 - protein, 648 aa, Arabidopsis thaliana; identical to SEQ ID NO: 1101

SEQ ID NO: 2069 - protein, 648 aa, Arabidopsis thaliana; identical to SEQ ID NO: 1101

SEQ ID NO: 2070 - protein, 669 aa, Oryza sativa; identical to SEQ ID NO: 987

SEQ ID NO: 2071 - protein, 430 aa, Oryza sativa; identical to SEQ ID NO: 2012

SEQ ID NO: 2072 - protein, 433 aa, Oryza sativa; identical to SEQ ID NO: 2013

SEQ ID NO: 2073 - protein, 631 aa, Physcomitrella patens
MAQLPYPDRFYAAASFAGFSSSSTSTKLLPENLPNETQLLLFALYKQATLGPCTLKKPWGWQVVEHAKWTSWNHLGNMNSLEAMRLFVRSVEEIDPNWCAKEQSQMMNPIVTNGKHDQVEDLSFSEKVDFNQSETPRMPEMERPVAEGIDAITTYLEWVPVIVTGRKPLARYQHAAAVVEGKLYVIGGNHNGRYLNDVQVLDLKKLSWSKVDTKVPESPLSSHRDLQPWFPQCAGHRLIRWGELLLVVGGHAKPGADTVTVHAFDTHSLSWTKLEVYGQAPVSRGGHSVTLIGSQLYMFGGEDPKRRLLNDLNILDLETMTWEAVTASGACPSPRADHVATAYRDKCIFVFGGGSHSDCYNDLHALDLETMEWASVPTKGISPRPRAGHAGATHGDNWFIVGGGDNTGAISETLVLDMITQSWSIQGVIQGNSAVASEGLSVEVSGNALLAFGGYNGYFNHEVHAYVLESPQSQETGNRMLPADAGEDSPATSRRGTPRNDEFEQHFQMTSGSRNDGLEQLRMAARAAQAEVEKLKVENAAALSSLADVEQELLSVRSQLQGEQSRSFRLEVEIAELKQKLSSMDALQKELDLLQRQIPTSHKVASEAAQKESKSGVWGWLAGAPPAPRYD

SEQ ID NO: 2074 - protein, 613 aa, Chlamydomonas reinhardtii; identical to SEQ ID NO: 2059

SEQ ID NO: 2075 - protein, 775 aa, Micromonas pusilla; identical to SEQ ID NO: 2060

SEQ ID NO: 2076 - protein, 470 aa, Escherichia coli
MSLSRRQFIQASGIALCAGAVPLKASAAGQQQPLPVPPLLESRRGQPLFMTVQRAHWSFTPGTRASVWGINGRYLGPTIRVWKGDDVKLIYSNRLTENVSMTVAGLQVPGPLMGGPARMMSPNADWAPVLPIRQNAATLWYHANTPNRTAQQVYNGLAGMWLVEDEVSKSLPIPNHYGVDDFPVIIQDKRLDNFGTPEYNEPGSGGFVGDTLLVNGVQSPYVEVSRGWVRLRLLNASNSRRYQLQMNDGRPLHVISGDQGFLPAPVSVKQLSLAPGERREILVDMSNGDEVSITCGEAASIVDRIRGFFEPSSILVSTLVLTLRPTGLLPLVTDSLPMRLLPTEIMAGSPIRSRDISLGDDPGINGQLWDVNRIDVTAQQGTWERWTVRADEPQAFHIEGVMFQIRNVNGAMPFPEDRGWKDTVWVDGQVELLVYFGQPSWAHFPFYFNSQTLEMADRGSIGQLLVNPVP

SEQ ID NO: 2077 - protein, 660 aa, Pongo abelii; identical to SEQ ID NO: 372

SEQ ID NO: 2078 - protein, 667 aa, Pongo abelii; identical to SEQ ID NO: 551

SEQ ID NO: 2079 - protein, 631 aa, Physcomitrella patens; identical to SEQ ID NO: 2073

SEQ ID NO: 2080 - protein, 580 aa, Serratia sp.; identical to SEQ ID NO: 1755

SEQ ID NO: 2081 - protein, 445 aa, Homo sapiens
MPSETHAMLATLARVAALRRTCLFSGRGGGRGLWTGRPQSDMNNIKPLEGVKILDLTRVLAGPFATMNLGDLGAEVIKVERPGAGDDTRTWGPPFVGTESTYYLSVNRNKKSIAVNIKDPKGVKIIKELAAVCDVFVENYVPGKLSAMGLGYEDIDEIAPHIIYCSITGYGQTGPISQRAGYDAVASAVSGLMHITGPENGDPVRPGVAMTDLATGLYAYGAIMAGLIQKYKTGKGLFIDCNLLSSQVACLSHIAANYLIGQKEAKRWGTAHGSIVPYQAFKTKDGYIVVGAGNNQQFATVCKILDLPELIDNSKYKTNHLRVHNRKELIKILSERFEEELTSKWLYLFEGSGVPYGPINNMKNVFAEPQVLHNGLVMEMEHPTVGKISVPGPAVRYSKFKMSEARPPPLLGQHTTHILKEVLRYDDRAIGELLSAGVVDQHETH

SEQ ID NO: 2082 - protein, 409 aa, Caenorhabditis elegans
MLTRGFTSIGKIASRGLSSTFYQDAFQLSDQLTEDERSLMLSAREYCQERLLPRVTEAYRTEKFDPSLIPEMGSMGLLGAPYQGYGCAGTSTVGYGLIAREVERVDSGYRSTMSVQTSLVIGPIYNYGSEDQKQKYIPDLASGKKIGCFGLTEPNHGSNPGGMETKATWDETTKTYKLNGSKTWISNSPVSDVMVVWARSARHNNKIKGFILERGMKGLTTPKIEGKLSLRASITGQIAMDDVPVPEENLLPNAEGLQGPFGCLNNARLGIAWGALGAAEECFHLARQYTLDRQQFGRPLAQNQLMQLKMADMLTEISLGLQGCLRVSRLKDEGKVQSEQISIIKRNSCGKALEVARKARDMLGGNGIVDEYHIMRHMVNLETVNTYEGTHDVHALILGRAITGLNGFC

SEQ ID NO: 2083 - protein, 566 aa, Serratia plymuthica
MNAEHLLTVDMLERQLTPAGCDGYAAWANAVLAADAACALWAEGEARLDEAGFNRCLIPQAMGGQWRGLDVLMDLFRVLYRKDPCLGLGYAGSSFIACCNIWAVGSPTQQRTVAQALHRNEKVACSYYEPEHGNDLSAVEFSADRQDGRWVLEGEKQVTSNIARSSVFVAFARTSPQPGSRSHTQILIVKSQLPDGSLQELPRHSSVGMRGVQLGGVRFDRTRLPAAADDELLLGTEGKALETTLRSFQVTRTLLPGMFVGVLDSGLRLATRFSLQRQLYGRCLADFPSARQVLSLALLDLLLADAFSRLGARALHVHPEFCCLYAPSIKIVVPKLLIGAMNRLADHLGASFYLTESEFGLFQKLLRDIKPAGFAHVGRPACQLTLLPLLFMLARKNAATPEAARLSPMLASDAPIDEPIDFNRLQVAPTGRDPLLDSLLHTAPLLGAALATQVLAARERLLDKLQTLDPRDISATAPAGHYQLSTLYAGLLAIAACLQWHQTAAEKLPLALTQLMVKRQLVHLQIAPDEGLDESEADYVCQRLFDDYRRRVSFDLMHYPLQGWEE

SEQ ID NO: 2084 - protein, 542 aa, Serratia plymuthica
MVWTTHTVFNQPKPLGNSNLFLSDTPLHEAVQREQAGWDTDVLASLGQQLGTQESLELGRLANANPPELLRYDATGQRLDDVRFHPAWHILMQGLIANRVHNLPWQEDARIGVFVARAARFVLHAQVEAGTLCPVTMTFGAIPLLQRLLPSEFQSWLSPLLSDRYDAHLSPGGQKRGLLIGMGMTEKQGGSDVLSNTTTATPLTARGSGEAYRLVGHKWFFSVPQSDAHLVLAQAEGGLSCFFLPRILPDGTRNAIRLERLKDKLGNRSNASSEVEFQDATAWLLGEEGDGVRHILKMGGLTRFDCALGSHGLMRRALSVALYHTLQRQAFGKTLIEHPMMRQVLGRMALRLEGQTAALMRLARAYDSADDPLEQALCRVLTPAAKFEVCRQGIPFVGEAMEALGGLGYCEESELPRLYREMPVNSIWEGSGNIMCLDVMRAWGRLPAVQEALDREFGEVKGQNRHFDLQWRQLSQLMRKPREEQGRAVASSLFNLFAAAQLLRYSSPPLAEAWCQMTLDARGERVLPDRLCDMLFARAMGG

SEQ ID NO: 2085 - protein, 566 aa, Serratia plymuthica; identical to SEQ ID NO: 2083

SEQ ID NO: 2086 - protein, 542 aa, Serratia plymuthica; identical to SEQ ID NO: 2084

SEQ ID NO: 2087 - protein, 566 aa, Serratia sp.; identical to SEQ ID NO: 2083

SEQ ID NO: 2088 - protein, 542 aa, Serratia sp.; identical to SEQ ID NO: 2084

SEQ ID NO: 2089 - protein, 405 aa, Desulfobacterium autotrophicum
MRVSLEFKQCKQKKVRNTMDFRLSKEMTMLQKAVREFVKKKITPNADAWDEANYFPYKEAVLPMGELGFYGTVIPEEYGGEDMGWMAAMIVTEEIAKGSSSLRVQVNMQVLGCAYGIFKYGTEAAKKRYVEKLCTAEYLGGFGITEADAGSDVMAMATTAEDKGDHYLLNGSKTWISNAAIADVLICYAYTDKSIGTKGLSAFVIEPKNFPGISTSALEKLGSHSSPTGEVFLDNVKVPKENLLGKSGDGAKILFGSLNHTRLSAAAGGVGLAQACLDEAIKYCNTRKQFGKPIGLFQMNQDMIAQMAAEIDAARFMVYRAAFEKDQGNINNGLDVAKAKYLAGEVATKASNFAMRILGAYGYSTEYPVARFYRDAPTYSMVEGSANICKMIIALDQLGIKRANR

SEQ ID NO: 2090 - protein, 661 aa, Caenorhabditis elegans
MANRSIRDGDNPELLEERRMATFDTDKMAAVIYGSEEFARRRREITDAVSKIPELADIKPYPFLTREEKVTEGTRKISILTKYLNQLIDRDNEEESLHLHREVIGYEGHPFALHDALFIPTLQSQASDEQQEKWLERARRREIIGCYAQTELGHGSNLRNLETTAVYDIASQEFVLHTPTTTALKWWPGALGKSCNYALVVAELIIKRNNYGPHFFMVQLRDEKTHIPLKGVTVGDIGPKMNFNAADNGYLGLNNLRVPRTNLLMRHCKVEADGTYVKPPHAKIGYSGMVKIRSQMAMEQGLFLAHALTIAARYSAVRRQGHLDDKQVEVKVLDYQTQQHRLFPSLARAYAFIFTGFETIHLYSQLLKDVDMGNTSGMADLHALTSGLKSVVAHETGEGIEQARMACGGHGYSMASYISVVYGIAIGGCTYEGENMVMLLQLARYLVKSVELIKAGKAKKLGPVASYLADKSDETDLTSLNGYVKMFENMARRQAWKATEKFLKLMESGESREVAWNKSAVELTRASRLHTRLFIIEAFMRRVSRIEDIPVKEVLTDLLHLHVNYELLDVATYALEFMSFTQLDYVRDQLYLYLEKIRPNAVSLVDSFQISDMQLRSVLGRRDGHVYENLFKWAKSSPLNNADVLPSVEKYLKPMMEKAKL

SEQ ID NO: 2091 - protein, 674 aa, Caenorhabditis elegans
MVHLNKTIQEGDNPDLTAERLTATFDTHAMAAQIYGGEMRARRRREITAKLAEIPELHDSMPLPYMTREEKIMESARKLTVLTQRMSEIIDPTDAGELYHLNNEVLGIEGNPMALHGVMFIPALNAQASDEQQAKWLIRALRREIIGTYAQTEMGHGTNLQNLETTATYDIGTQEFVLHTPKITALKWWPGNLGKSSNYAVVVAHMYIKGKNFGPHTFMVPLRDEKTHKPLPGITIGDIGPKMAYNIVDNGFLGFNNYRIPRTNLLMRHTKVEADGTYIKPPHAKINYSAMVHVRSYMLTGQAIMLSYALNIATRYSAVRRQGQIDKNEPEVKVLEYQTQQHRLFPFIARAYAFQFAGAETVKLYERVLKEMKSGNVSLMADLHALTSGLKSVVTHQTGEGIEQARMACGGHGYSMASYISEIYGVAIGGCTYEGENMVMLLQLARYLVKSAALVKSGKASQLGPLVAYLGARSEPTSLIDRVPNGGITEYIKTFQHIAKRQTLKAANKFFGLMENGEKREIAWNKSSVELNRASRLHTRLFIVEAFARRVNEIGDITIKEALSDLLHLHVNYELLDVATYALEDGFMSSTQLDYVRDQLYFYLQKIRPNAVSLLDSWEFSDRELRSVLGRRDGHVYENLFKWAKESPLNKTDVLPSVDTYLKPMMEKARQSKL

SEQ ID NO: 2092 - protein, 662 aa, Caenorhabditis elegans
MHLNTSICEVDNPDLTEEREKGTFDTDKMAAVIYGSEKLARRRREISEAVSKIPELADTQPFPFMDRLEKITEGSRKLEVLNNNIRDIIDYDDNGERLHIYQEVTGMEGHPLALHEVMFIPALVSQASKEQQEKWLGRARRREIIGCYAQTEMGHGTNLRKLETTATYFPDTQEFVLNTPTTTALKWWPGALGKSSNYAVVVVDMIIKGKSYGPHPFMVQLRDEKTHIPLKGIVVGDIGPKMSFNGGDNGFLGFDKFRVPRTNLLMRHVRVEADGTYVKPPHAKVNHSAMVHVRSHMATGQGALLAQALIIAVRYSAVRRQGFLENKTQEVKVLDYQTQQHRLFPSLARAYAFIFTGFETIHLYSQLLKDVDMGNTSGMADLHALTSGLKSVVTHQTGEGIEQARMACGGHGYSMASYISEIYGIAIGGCTYEGENMVMLLQLARYLVKSVELIKSGEAKKLGPMVSYLAAKGGHPDLSSLNGYVTAFEHMARRQAWKATEKFLKLMESGESREIAWNKSTVELTRASRLHTRLFIIEAFMRRVSRIEDIPVKEVLTDLLHLHVNYELLDVATYALEFMSSTQLDYIRDQLYLYLEKIRPSAVSLVDSFQISDMQLRSVLGRRDGNVYENLFKWAKSSPLNKSDVLPSVDKYLMPMMEKAKL

SEQ ID NO: 2093 - protein, 660 aa, Caenorhabditis elegans
MSSICKGDNSDLTEERKNATFDTDKMAAVIYGREEIASRRRQLTESISRIHELAESKPLVFMTREEKIAESCRKLEVLSRHWNQTPFNRDNEEDALHIYREVLGMEGHPLALHDTMFIPTLVAQASQEQQEKWLGRARRKEIIGCYAQTEMGHGTNLRKLETTATYSPDTQEFILNTPTITALKWWPGALGKSSNNAIVVANLLIKDQNYGPHPFMVQLRDEKTHIPLKGIVVGDIGPKMAFNGADNGYLGFNNHRIPRTNLLMRHTKVEANGTYIKPSHAKIGYSSMVKVRSRMAMDQGLFLASALVIAVRYSAVRRQGFLEDKTQKVKVLDYQTQQHRLFPSLARAYAFIFTGFETIHLYSQLLKDVDMGNTSGMADLHALTSGLKSVVTHQTGEGIEQARMACGEHGYSMASYISEIYGVAIGGCTYEGENMVMLLQLARYLVKSVELIKSGEEKKLGPMVSYLAAKGGHPDLSSLNGYVTAFEHMARRQAWKATEKFLKLMETGESREVAWNKSAVELTRASRLHTRLFIIEAFMRRVSRIEDIPVKEVLTDLLHLHVNYELLDVATYALEFMSSTQLDYIRDQLYLYLEKIRPSAVSLVDSFQISDMQLRSVLGRRDGNVYENLFKWAKSSPLNKSDVLPSVDKYLKPMMEKAKL

SEQ ID NO: 2094 - protein, 405 aa, Desulfobacterium autotrophicum; identical to SEQ ID NO: 2089

SEQ ID NO: 2095 - protein, 540 aa, Enterobacter asburiae
MNWQTHTVFNQPVPLSNSNLFLSDCALREAVNREGAEWDMELLASIGQQLGTAESLELGRLANVNPPELLRYDATGERLDDVRFHPAWHLLMQGLCANRVHNLAWEEDARKGSFVARAARFILHAQVEAGTLCPVTMTFAATPLLQQALPKIFRDWLTPLHSDRYDPHLAPGGQKRGVLIGMGMTEKQGGSDVLSNTTKAEKSSDGSYRLVGHKWFFSVPQSDAHLVLAQAKGGLSCFFVPRFLPDGQRNAVRLERLKDKLGNRSNASSEVELLDAVGWLLGEEGEGIRQILRMGGMTRFDCALGSHGLMRRALSVALYHAHQRQTFGKNLIDQPLMRDVLSRMALVLEGQTALLFRLARAWDSREDVQEAAWARLFTPAAKYGVCKAGIPFVAEAMEVLGGIGYCEESELPRLYREMPVNSIWEGSGNIMCLDVLRVLTKQPGILELLTDDFVQVKGQDRHFDRSWRQLQQKLRKPQEAQSREITQQLFLLGAGSQMLRHASPPVAQAWCRMMLDTRGGSLLSEQVQNDLLLRATGRVG

SEQ ID NO: 2096 - protein, 485 aa, Desulfatibacillum alkenivorans
MKIKTASDYMESLRKLSPVIYYKGERIEDVTASPATAPHVRAAAMTYALANTKEHGHLATATSHLTGRTISRFTHVHQNVEDLIKKVKLLRVLGQKTGTCFQRCVGFDGINAMYSVAYEIDQKYDMGYFERFKKWLIRIQDENLMVVGAMTDPKGDRSKGPAEQPDPDQYLHVLKRTNDGIVIRGAKLHMTGAVNSHEILIMPTTAMDESSKDYAVACALPVDAPGVTMIFGRQANDSRRDLEETIDVGKPSFGIVGGEAVIVFDDVFVPWENVFMDGQTEFTSSLVYRFAAHHRANYGACKTGLMDVLTGAVTYLAQLQGSAKGSHVRDKVTEMIHLSETLYSSSIACSAEGSPTPSGAFMVDTMLANVCKHNVTRFHFEVARLAVDLAGGFIATLPSEYDFRNEEVGHLIKKYFSCADGLPVEDRVKIGRLIEAMTGGTAMVESMHGAGSPQAQRIMIFREGKLKEKIQFAKALAGIPSRANK

SEQ ID NO: 2097 - protein, 564 aa, Desulfitobacterium dehalogenans
MDGILDQSLKVCREVVAPTNDDGDQMGAVLRDGQVSVPPSFHKAFRYVEENGWGSSNKDVDAEGTLPSMLYGAVHEFMIGANPAFTPYVGLAGGIASVIKAFGSPEQIKLYTPKMFAGEWGGTMCLTEPGGGSDVGDMLSKAYPTDDPLIYKVKGTKCFITGGDHDLTENIIHLVLARVDGAAPGTRGLSLFIVPKYWVNPDGSLGERNDVSTVSIEHKMGLKGSSTAVLGFGEEEQCRGVLLGSPPDERGVGQGMAQMFKMINGARVDTGHSALAVATVAYNNSVQYAKERIQGRPIADPKAGRKPIIQHEDVRRMLLTQKSTLEGMRAMIFKAYYYFDMIAFGEDSAEVNDAKGKLEVITPLIKAYCSDQAWLMITEAIQVYGGYGYTEEYPVARQARDSKIYSIWEGTNFIQSLDLVGRKWRLDNGKVFRDWLTELGTFIQKNRENQHFASEFAILGKALHAYQGLLGTVMAYFTQDIRKIALFSTRILRLTAELYAGCLLMQQALIAQAKLDEGNADPYYAGKVAGSRFYIHNSVPDVITAVKVIDDGDTSALEIPEEAF

SEQ ID NO: 2098 - protein, 566 aa, Serratia sp.; identical to SEQ ID NO: 2083

SEQ ID NO: 2099 - protein, 542 aa, Serratia sp.; identical to SEQ ID NO: 2084

SEQ ID NO: 2100 - protein, 566 aa, Serratia sp.; identical to SEQ ID NO: 2083

SEQ ID NO: 2101 - protein, 542 aa, Serratia sp.; identical to SEQ ID NO: 2084

SEQ ID NO: 2102 - protein, 564 aa, Desulfitobacterium dehalogenans; identical to SEQ ID NO: 2097

SEQ ID NO: 2103 - protein, 675 aa, Ricinus communis
MAMARASSGLAYPERFYAAATYAGFDGSPDSASSTVSSKFQSDTALLLYALYQQATIGPCSAPKPSTWKAVELSKWKSWQGLGNMASTEAMRLFVKILEEEDPGWYSRASNSVPEPVVDMQLNHNPKVESIVENGNSYPETKTISSENGNVIETQDKDVVSEGLGSVAVYDQWITPPISGQRPKARYEHGAAVVQDKMYIYGGNHNGRYLNDLHVLDLRSWSWSKVDAKVEAESNESKSSPTLTPCAGHSLISWENKLLSIAGHTKDPSEYMQVKVFDLQTRTWSTLKTYGKPPVSRGGQSVTLVGTSLVIFGGQDAKRSLLNDLHILDLESMTWDEIDAVGVPPSPRSDHAAAVHAERYILIFGGGSHATCFNDLHVLDSKNMEWTRPTQQGKLPSPRAGHAGVTVGENWFIAGGGDNKSGVSETIVLNMSTLVWSVVTSVEGRVPLASEGLSLMVSSYNGEDILVSFGGYNGRYSNDVNVLKPSHKSTLQSKIIETPVPDSVSAVHNATNATRDLESESEAGQEGKIREIVMDNVDPEPMKSKGEVSSEHLLATLKAEKEELESSLSKEKFQTLQLKQELAEAETRNTDLYKELQSVRSQLAAEQSRCFKLEVDVAELRQKLQTMETLQKELELLQRQKAASEQAALNARQRQGSSGVWGWLAGTPGQKEDEA

SEQ ID NO: 2104 - protein, 659 aa, Caenorhabditis elegans [sequence omitted]

SEQ ID NO: 2105 - protein, 540 aa, Enterobacter asburiae; identical to SEQ ID NO: 2095

SEQ ID NO: 2106 - protein, 403 aa, Mycobacterium smegmatis
GPGSMTNSAVAQPRSQRRGADDLIGINAVLSAEEREIRDTVRSVVQRRIKPHIASWYEDGELPARELAVELGELGLLGMHLKGYGCAGMSAVAYGLACLELEAGDSGIRSLVSVQGSLAMYAIHAFGSDEQKDQWLPDMASGHRIGCFGLTEPDHGSDPAGMRTRATRSGDDWILTGTKMWITNGSVADVAVVWARTDEGIRGFVVPTDTPGFTANTIKSKMSLRASVTSELVLDGVRLPDSARLPGATSLGAPLRCLNEARFGIVFGALGAARDCLETALAYACSREQFDRPIGGFQLTQQKLADMTLEYGKGFLLALHLGRQKDAGELAPEQVSLGKLNNVREAIEIARTARTVLGASGITGEYPVMRHANNLESVLTYEGTSEMHTLIIGQALTGVGAFR

SEQ ID NO: 2107 - protein, 540 aa, Salmonella enterica
MSWQTHTVFNQPAPLNNSNLFLSDGALCEAVSREGAGWDSDLLASIGQQLGTAESLELGRLANAHPPELLRYDPQGQRLDDVRFHPAWHLLMQGLCANRVHNLAWEEEARAGSFVARAARFVLHAQVEAGTLCPVTMTFAATPLLLQMLPATFHDWLAPLRSDRYDSHLLPGGQKRGLLIGMGMTEKQGGSDVLSNTTHAERLADDSYRLVGHKWFFSVPQSDAHLVLAQAKGGLSCFFVPRFLPDGQRNSVRLERLKDKLGNRSNASAEVEFQDAVGWRLGEEGEGIRHILKMGGMTRLDCALGSHGLMRRAFSVAIYHAHQRQAFGKPLIEQPLMRQTLSRMALCLEGQTALLFRLARAWEQRREAKEALWARLFTPAAKFAICKQGIPFVAEAMEVLGGMGYCEESELPRLYREMPVNSIWEGSGNIMCLDVLRVLTKQHGVYDVLNEAFAEVKGQDRHYDRAVRQLQQRLRKPDEAMGREITQQLFLLGCGAEMLRHASPPLAQAWCQMMLDTRGEMPLSAQVQNDLLLRATGGLR

SEQ ID NO: 2108 - protein, 686 aa, Micromonas pusilla
MDLPFPDKFYLVCAFCDHPPEGANGITEDTRLLLYALHEQATRGPCVVPRPTAYFYDGDDAIDWEAWRSLGDMSSLEAMRLHCAAVERDNPNWWALLTSGLDDQSVRAIVETARSCTREYHDAVRAGTLVPPRLPATRERIDPAAAAAAAPTRAVAASSSSDASSSSSSSSLKWMDAYGLETLRASLDAVNAAVTYPFEQLSAALATPVGLGASATASSTAATTTRSLLSNLRLTRSGSMPSLLGTPTATRRSNSMMSDVIETETMNDLDEAEAHGVNPPVYTPLDEIVPLAVWRAPKTNGTGPRARYQHCAWRRGAEMWISHGSANGRKLNGDAHVLDVETLTWGVREEKAGGGAFAAAAAVAAPDGTVALALGGVERQSDGGAPKTAIPIIAHRWLNLEDDSDDEDDALAATASASNANANATLAPLLAMRVREPIEWVDDVYPFTPSNGSTAAPKGPRPRAAHSANVVGREVLVYGGVALAPGGARLQGEEETLGDLWVYSIDDAEWRCPWRWGEDGEKEKEGARGPTPRSGHVACVAKDRYLLVFGGGAGNVLASNDLHAYDCETGAWIDVAARGEAPSPRSGHAACVVENSWYVCGGGDGERATPETYRLDFSDIDEKVVRWSAMDPGTDENAVRAAGKEGLSLVPFRGSTGDFILAFGGSDGTCSDALSAMRVSNVDRCR

SEQ ID NO: 2109 - protein, 675 aa, Arabidopsis thaliana; identical to SEQ ID NO: 103

SEQ ID NO: 2110 - protein, 675 aa, Ricinus communis; identical to SEQ ID NO: 2103

SEQ ID NO: 2111 - protein, 603 aa, Trichoplax adhaerens
MSESLQTERKNATFNIKELTDTLNGGPEETRKRKQIESLVFNTPAFHRQDRFQLSREEIYDYSIKVYGELIKLCKKENIEIRYDNPDYVRLVGCIPEEIPVGLHVGMFSSSISDQGTEEQQKKWIPLARNFKIFGTYAQTELAHGTFVRGLETTATYDESKQEFILNSPTITSTKWWPGFLGRTSNHAVIAAQLYTKSKCYGIHMFIVQLRDLKDHKPLPGVTIGDIGDKFGFDTVDNGFLRLDNVHIPRENMLMKYAKVTPEGKYLPPTNAKVAYSAMTLIRVVLVRGSAKALASASTIAIRYSAVRHQTETAPGKEPQVLDYVTQQYKLFPQLATALAFGFAGNYMIDTFNKIHSEISSGQLDALSELHGISSGLKAYTTDTATAGIEVCRRACGGHGYSNACGIQHIYANVLPCVTLEGENTVMYLQAASKVISTIKRLEQLRRSGMDQDEAWNTAGIELVQAAKAHCHYFIVKNYLRSLEKLNMTPSLRKVMNSIALLYGNYGIDENAGDFLESGFMTGEQLNLVKAKILQLLSEVRRNAVAVVDAFDFDDKYLRSILGAYDGDVYNRLYNWAKSSPLNKTEVHSSYTEYLQQLLKSKL

SEQ ID NO: 2112 - protein, 686 aa, Micromonas pusilla; identical to SEQ ID NO: 2108

SEQ ID NO: 2113 - protein, 752 aa, Escherichia coli
MRVDAIAKVTGRARYTDDYVMAGMCYAKYVRSPIAHGYAVSINDEQARSLPGVLAIFTWEDVPDIPFATAGHAWTLDENKRDTADRALLTRHVRHHGDAVAIVVARDELTAEKAAQLVSIEWQELPVITTPEAALAEDAAPIHNGGNLLKQSTMSTGNVQQTIDAADYQVQGHYQTPVIQHCHMESVTSLAWMEDDSRITIVSSTQIPHIVRRVVGQALDIPWSCVRVIKPFVGGGFGNKQDVLEEPMAAFLTSKLGGIPVKVSLSREECFLATRTRHAFTIDGQMGVNRDGTLKGYSLDVLSNTGAYASHGHSIASAGGNKVAYLYPRCAYAYSSKTCYTNLPSAGAMRGYGAPQVVFAVESMLDDAATALGIDPVEIRLRNAAREGDANPLTGKRIYSAGLPECLEKGRKIFEWEKRRAECQNQQGNLRRGVGVACFSYTSNTWPVGVEIAGARLLMNQDGTINVQSGATEIGQGADTVFSQMVAETVGVPVSDVRVISTQDTDVTPFDPGAFASRQSYVAAPALRSAALLLKEKIIAHAAVMLHQSAMNLTLIKGHIVLVERPEEPLMSLKDLAMDAFYHPERGGQLSAESSIKTTTNPPAFGCTFVDLTVDIALCKVTINRILNVHDSGHILNPLLAEGQVHGGMGMGIGWALFEEMIIDAKSGVVRNPNLLDYKMPTMPDLPQLESAFVEINEPQSAYGHKSLGEPPIIPVAAAIRNAVKMATGVAINTLPLTPKRLYEEFHLAGLI

SEQ ID NO: 2114 - protein, 732 aa, Escherichia coli
MKFDKPAGENPIDQLKVVGRPHDRIDGPLKTTGTARYAYEWHEEAPNAAYGYIVGSAIAKGRLTALDTDAAQKAPGVLAVITASNAGALGKGDKNTARLLGGPTIEHYHQAIALVVAETFEQARAAASLVQAHYRRNKGAYSLADEKQAVNQPPEDTPDKNVGDFDGAFTSAAVKIDATYTTPDQSHMAMEPHASMAVWDGNKLTLWTSNQMIDWCRTDLAKTLKVPVENVRIISPYIGGGFGGKLFLRSDALLAALAARAVKRPVKVMLPRPSIPNNTTHRPATLQHLRIGADQSGKITAISHESWSGNLPGGTPETAVQQSELLYAGANRHTGLRLATLDLPEGNAMRAPGEAPGLMALEIAIDELAEKAGIDPVEFRILNDTQVDPADPTRCFSRRQLIECLRTGADKFGWKQRNATPGQVRDGEWLVGHGVAAGFRNNLLEKSGARVHLEQNGTVTVETDMTDIGTGSYTILAQTAAEMLGVPLEQVAVHLGDSSFPVSAGSGGQWGANTSTSGVYAACMKLREMIASAVGFDPEQSQFADGKITNGTRSATLHEATAGGRLTAEESIEFGTLSKEYQQSTFAGHFVEVGVHSATGEVRVRRMLAVCAAGRILNPKTARSQVIGAMTMGMGAALMEELAVDDRLGYFVNHDMAGYEVPVHADIPKQEVIFLDDTDPISSPMKAKGVGELGLCGVSAAIANAVYNATGIRVRDYPITLDKLLDKLPDVV

SEQ ID NO: 2115 - protein, 422 aa, Escherichia coli
MYDFVIIGGGIIGMSTAMQLIDVYPDARIALLEKESAPACHQTGHNSGVIHAGVYYTPGSLKAQFCLAGNRATKAFCDQNGIRYDNCGKMLVATSDLEMERMRALWERTAANGIEREWLNADELREREPNITGLGGIFVPSSGIVSYRDVTAAMAKIFQSRGGEIIYNAEVSGLNEHKNGVVIRTRQGGEYEASTLISCSGLMADRLVKMLGLEPGFIICPFRGEYFRLAPEHNQIVNHLIYPIPDPAMPFLGVHLTRMIDGSVTVGPNAVLAFKREGYRKRDFSFSDTLEILGSSGIRRVLQNHLRSGLGEMKNSLCKSGYLRLVQKYCPRLSLSDLQPWPAGVRAQAVSPDGKLIDDFLFVTTPRTIHTCNAPSPAATSAIPIGAHIVSKVQTLLASQSNPGRTLRAARSVDALHAAFNQ

SEQ ID NO: 2116 - protein, 573 aa, Escherichia coli
MRALLPYLALYKRHKWMLSLGIVLAIVTLLASIGLLTLSGWFLSASAVAGVAGLYSFNYMLPAAGVRGAAITRTAGRYFERLVSHDATFRVLQHLRIYTFSKLLPLSPAGLARYRQGELLNRVVADVDTLDHLYLRVISPLVGAFVVIMVVTIGLSFLDFTLAFTLGGIMLLTLFLMPPLFYRAGKSTGQNLTHLRGQYRQQLTAWLQGQAELTIFGASDRYRTQLENTEIQWLEAQRRQSELTALSQAIMLLIGALAVILMLWMASGGVGGNAQPGALIALFVFCALAAFEALAPVTGAFQHLGQVIASAVRISDLTDQKPEVTFPDTQTRVADRVSLTLRDVQFTYPEQSQQALKGISLQVNAGEHIAILGRTGCGKSTLLQQLTRAWDPQQGEILLNDSPIASLNEAALRQTISVVPQRVHLFSATLRDNLLLASPGSSDEALSEILRRVGLEKLLEDAGLNSWLGEGGRQLSGGELRRLAIARALLHDAPLVLLDEPTEGLDATTESQILELLAEMMREKTVLMVTHRLRGLSRFQQIIVMDNGQIIEQGTHAELLARQGRYYQFKQGL

SEQ ID NO: 2117 - protein, 666 aa, Homo sapiens
CQLVVAMNPDLRRERDSASFNPELLTHILDGSPEKTRRRREIENMILNDPDFQHEDLNFLTRSQRYEVAVRKSAIMVKKMREFGIADPDDIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEMKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 2118 - protein, 603 aa, Trichoplax adhaerens; identical to SEQ ID NO: 2111

SEQ ID NO: 2119 - protein, 700 aa, Homo sapiens [sequence omitted]

SEQ ID NO: 2120 - protein, 748 aa, Saccharomyces cerevisiae; identical to SEQ ID NO: 59

SEQ ID NO: 2121 - protein, 815 aa, Shewanella baltica; identical to SEQ ID NO: 1499

SEQ ID NO: 2122 - protein, 759 aa, Shewanella baltica; identical to SEQ ID NO: 1857

SEQ ID NO: 2123 - protein, 818 aa, Serratia sp.; identical to SEQ ID NO: 1837

SEQ ID NO: 2124 - protein, 542 aa, Serratia sp.; identical to SEQ ID NO: 2084

SEQ ID NO: 2125 - protein, 815 aa, Shewanella baltica; identical to SEQ ID NO: 1498

SEQ ID NO: 2126 - protein, 759 aa, Shewanella baltica; identical to SEQ ID NO: 1855

SEQ ID NO: 2127 - protein, 547 aa, Homo sapiens
MRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHSRRQFGPKTKEEVKIIEHQTQTLRLMPHLATALALTFVSRYAGALLDEDVFQGKELVNSRSLQALVAGLKAYSTWENIRCLQDCRECTGGMGYMMENRISGLKCDTDVFATFEGDDVVMLQVVGRELLAQYTKQYEEKPLFGLLQNWAESVGDKLRTSFLAFNMDTVDDLAFLLKAVKFRERVLQRGLVARIYYKVKTKKEDFFHAWNSCLHHVASLSLAHTHRVTLEQFSLAVKSCPDQEDQTLLMKFCLLYGTKLVFQERAWYLEHKYLTPMASTRIRNQERC

SEQ ID NO: 2128 - protein, 632 aa, Mus musculus
MTGWSGLFIEVPLYRLASKVCCHLRGPQGFLQRACQGVCCLPRDSRAAGIMEEKRKSFISQILILGEVLCMVDVSMSIKCGILFLLFGGAISNLGSPEHVTKWFWPLKEQKYTGMFAMTERGHGSNVRGIQTEATFDLDNQEFVIDMPCENAHKMYIGNAMHGNYAAVFAQLIIEGKSQGPHCFIVPIRDENGNLYPGVTAIDMMHKEGMNGVDNGILIFDKVRIPRENLLDKFGSVTPDGQYHSPIQSKNARFNAILATLTPSRLAVTFQALGAMKLGLMIAIRYSHSRRQFGPKDKEEVKIIEHQMQALRLMSHLATALAVTFTSRHADDILDEDIFQGRALTNSRSLQALMAGLKAYSTWETVSCLQDCRECTGGMGYMMETRISDLKCDTDVFVTFEGDNVVMLQVVARELLAQYSKQHKKNLLLGVIQNWTATAGDKLRTSFLAFNTDTVGCLAFLLKAVNFRERVLQRSLVSRIYYKVVTKKGDFFSAWNSCMHHVTSLSLAHIHRVALEQFTTAVRQCPNREDQALLMKFCLLYGTKLVFQERGWYLEHKYLTPKASMLIRAQLLNLCESVKDDALKVISAFNIPHITIRAPKTGIPNPGAAEAAYPAPMQPLVRDAARAQLAKL

SEQ ID NO: 2129 - protein, 412 aa, Agrobacterium sp.
MSNPKIQTATTDNCSVPSRDDILARARDIAAAAAKDAARRERQRELPFEIFGLIKEAKIGTLRIPEAKGGPGGSIADYIEVLMILGEADSNIPHALRSHFNFTENLALTPIELEDRPHLENVLTGKLFAGASTEQGTKRPGEITTRLSADGDRYRLNGRKWYATGTAFADFGTFSAVGDDEQPIGVLIPLDRPGITILDDWDSMGQRMTASGGVLLENVEVLPHELTTRKLGSQIGRHSSAMRQLHLAASASGAVQGALNDGIDYVLRQARTTLHSSAETANQDPFVQKMLGEISAGAFAVKTLIREAARTLDRTAAAFSSGDEEAIEAALLEGSLATARTQIIASQLSLTVATNLYELGGGSATSSERNFDRHWRNIRTVYNHNPLAHKARVIGDYYLNGTTTHLREGRVF

SEQ ID NO: 2130 - protein, 408 aa, Acidiphilium cryptum
MNEMKRVVETGAHKPAGKGSFTPFEWDDALHLDTQLTEDERAIRDAAHEYCQNKLFPRVLKGFREETFDRSIMSEMGEMGFLGATLSTHGCADVSYVAYGLIAREVERVDSGYRSAFSVQSSLVMYPIYAFGSEAQKDKYLPKLRAGEWVGCFGLTEPDAGSDPGSMRTRAKKVDGGYILNGSKTWISNSPIADVCLVWAKDDEGVIRGFLVDRGSKGLETPKIEGKFSLRASVTGMIMLSDVFVPEDHMLPGVKGLRGPFSCLNNARYGIAWGALGAAEFCWHAARQYTLDRKMFGRPLAATQLVQKKLADMQTEITLGLQGALRLGRLLDAGEAAPEMISLMKRNNCGKSLDIARLARDMHGGNGIVDEYHVIRHMVNLETVNTYEGAHDVHALILGRAQTGLSAF

SEQ ID NO: 2131 - protein, 700 aa, Yarrowia lipolytica; identical to SEQ ID NO: 364

SEQ ID NO: 2132 - protein, 677 aa, Yarrowia lipolytica
MAKERGKTQFTVRDVTNFLNGGEEETQIVEKIMSSIERDPVLSVTADYDCNLQQARKQTMERVAALSPYLVTDTEKLSLWRAQLHGMVDMSTRTRLSIHNNLFIGSIRGSGTPEQFKYWVKKGAVAVKQFYGCFAMTELGHGSNLKGLETTATYDQDSDQFIINTPHIGATKWWIGGAAHTSTHCVCFAKLIVHGKDYGTRNFVVPLRNVHDHSLKVGVSIGDIGKKMGRDGVDNGWIQFTNVRIPRQNMLMRYAKVSDTGVVTKPALDQLTYGALIRGRVSMIADSFHVSKRFLTIALRYACVRRQFGTSGDTKETKIIDYPYHQRRLLPLLAYCYAMKMGADEAQKTWIETTDRILALNPNDPAQKNDLEKAVTDTKELFAASAGMKAFTTWGCAKIIDECRQACGGHGYSGYNGFGQGYADWVVQCTWEGDNNVLCLSMGRGLVQSALQILAGKHVGASIQYVGDKSKISQNGQGTPREQLLSPEFLVEAFRTASRNNILRTTDKYQELVKTLNPDQAFEELSQQRFQCARIHTRQHLISSFYARIATAKDDIKPHLLKLANLFALWSIEEDTGIFLRENILTPGDIDLINSLVDELCVAVRDQVIGLTDAFGLSDFFINAPIGSYDGNVYEKYFAKVNQQNPATNPRPPYYESTLKPFLFREEEDDEICDLDE

SEQ ID NO: 2133 - protein, 701 aa, Yarrowia lipolytica; identical to SEQ ID NO: 995

SEQ ID NO: 2134 - protein, 689 aa, Yarrowia lipolytica
MLSQQSLNTFTEPPVEMARERNQTSFNPRLLTYFLDGGEKNTLLMDRLMQEYERDPVFRNEGDYDITDVAQSRELAFKRIAKLIEYVHTDDEETYLYRCMLLGQIDMGAFARYAIHHGVWGGAIRGAGTPEQYEFWVKKGSLSVKKFYGSFSMTELGHGSNLVGLETTATLDKNADEFVINTPNVAATKWWIGGAADTATHTAVFARLIVDGEDHGVKTFVVQLRDVETHNLMPGIAIGDCGKKMGRQGTDNGWIQFTHVRIPRQNMLMRYCHVDSDGNVTEPMMAQMAYGALLAGRVGMAMDSYFTSRKFLTIALRYATIRRAFAAGGGQETKLIDYPYHQRRLLPLMAQTYAIKCTADKVRDQFVKVTDMLLNLDVSDQEAVPKAIAEAKELFSVSAGVKATTTWACAHTIDQCRQACGGHGYSAYNGFGRAYSDWVIQCTWEGDNNILCLSAGRALVQSNRAVRAGKPIGGPTAYLAAPAGSPKLAGRNLYDPKVMIGAWETVSRALINRTTDEFEVLAKKGLSTAQAYEELSQQRFLCTRIHTRLYMVKNFYERIAEEGTEFTKEPLTRLANLYAFWSVEEEAGIFLREGYITPQELKYISAEIRKQLLEVRKDVIGYTDAFNVPDFFLNSAIGRADGDVYKNYFKVVNTQNPPQDPRPPYYESVIRPFLFRKDEDEEICSLEDE

SEQ ID NO: 2135 - protein, 700 aa, Yarrowia lipolytica; identical to SEQ ID NO: 361

SEQ ID NO: 2136 - protein, 699 aa, Yarrowia lipolytica; identical to SEQ ID NO: 994

SEQ ID NO: 2137 - protein, 409 aa, Agrobacterium sp.
MNDMSHAPQPAQTNPHVRLVGRVAGVADLFRSSARQTEEARRVPASHIAALRGIGYFDVVKPRAFGGQGGEFAELVEANIELSAACASTGWVAGLLSAHQWLLAMFPEEAQADVWGENPDALLCGSYAPVKMAEAADGGYRLSGKWAFASGCENAQWSLCAAILPPQGEGRPVPAFLLVPASQYSIEDTWHVVGLAGTGSKTLVLDDVFVPKHRVLTFPDATSGHTPGGRLYAQEGLFNMPLLTGIPSCLASAGVGAAKGALAAYVDHVGGRVTRGAVAGGNNRMAEFPTIQLRVAEAAASVDAACEILLRDVARAQALSQARLEGWAEFSMDDRLLSRRGQSFSVSLALRAVQALNDSTGGVGLDLSNPVQRAWRDANAVGRHISMNWDAVGTMIGQSMLGLEPKGQY

SEQ ID NO: 2138 - protein, 708 aa, Chlorella variabilis
MPRPVDARDKQLIEAPCREVLLGAISPMDDAARERARSTFDSNELAAFLHDGEDKLQRREELVKLLSSQPWGDKTHRYFLTREQEYVGGLKAMVGMWQQMRQGRLSLEDGIAMRSLAYFPGGLELHIGMFIPTLLSQGTPEQQAKWLPMSNRLQIIGTYAQTELGHGTFVRGLQTVAVYDEASREFVVHTPSLEAHKWWPGGLGKTATHVILMARLFAQGRDYGPHAFVVQIRDMATHLPLPGITVGDIGPKMGFNSVDNGYLAFDHVRIPRDAMLMRFSQVTEEGRYVPPPPDNQKASYATMVYVRATIVRDSGDFLSRAVTIATRYTAVRRQTASKLGEPELQARQLPPLLLPACWPVLDYDNVQQTLLPLLARAYSLVFMGRSMMDMYNSFDAARSRGDFGVLPELHALSSGLKALCTDITAAGIEACRRQCGGHGYMLASGLPTLFNSYVQNCTWEGDNSVMYLQAARYLVKNVLAAQAGKPITGSAKYLSSAAQQADAKCGVSTADDWRSPAHQLAALTRVAAQLAAQATQVLARAGGGRVAFDGEPWNNSTVDLIRAARAHVALYLHQNFVDCVEAAASQRALGAAASGVLRELMQLHGVVLLLEASSDLLEGGYCSGRQAGMLREQQRALVRSLRPNAISLADSFAYPDYQLNSALGRKDGNVYQALLDSARISPLNATHEGPAWKEVLEPLLSPAVRSRL

SEQ ID NO: 2139 - protein, 675 aa, Chlorella variabilis
MSAQRVAVLQRQLQATIPAGEASSSALQPQPTSAIALRQLPRFDVTLMEHFLDNQLALKAEVYELFRQHPELLVAEEEGMTKEEHRELVRKCLRVILAAGFSPMSFFARDHAKYFNLAELLSLVDLSLTVKLGVQYSLWGGSVINLGTERHRRKYFDDIDRFRLPGCFAMTELKHGSNVAGLQTEAILDVHTDEWIVNTPDDGAIKWWIGNAAEDGKMATVPSPDGSGALDDHGVHAFIVPLRDDGGALWPGVEIHDCGYKVGLNGIDNGAIRFTSVRVPRENLLDRFATVDRSGRYSSPMTSATKRFAATLGELTGGRVGLTCASVGVLKGALTIAVRYSAQRQQFGPPDAPEVAVLDYPSQQMKLMPMLATCYALYFAKNKLVEKYCEMKRTKDEVLVADVHTLSAGLKAYTTSYTNTAIGICRECCGGHGYAARPAASSLCTSSADIFQTFEGDNTVLLQQVAALLLKEYRDSFRGSPLAATWSYLKVWAQDSLPANPLVTHETDVSHLRDPAFLVRALRYRSARLLHTLAARLRKHSRRVGEFTAWNKCLLHVLALSRAHIESVMLVEMLAAVNACVDPDCRRSLKALADLFALDRIYTDITFRNDDYIAPEKAKAIYRLIEALCGEVRGVAVPLVDAFAIPDHILRSPIGLSTTSVDPYSEYLAAAGFDS

SEQ ID NO: 2140 - protein, 667 aa, Caenorhabditis elegans
MSAPLIDKYRKMATFDWKKLKAAVEGEEHVRLKSEVVAKMKSEPVFHRDYRVLSREEQREVVHQRWKKIVEWGLFKDPYSDLENFHALTETLEAYDQGTSARLFLHGNVFGAAVKSMGTDRHKDLIQKTENNEIVGAFCLTEVGHGSNTAEIQTTATFDNGELVFNTPSVSAIKCWAGNLAHSATHVVVYAQLHVEGKNEGFHGFVIQVRCPRTFQTLPGITIGDMGSKPGCWQGVENGWMEFKNHRAPLSALLNKGCDITPDGKYVTSFKSASEKQSVSLGTLSVGRLGIIAKGMMACTFASTIAIRYSVARRQFGPVKGAENEIPVLEYPLQQYRLFPYLSAAICIRIFQKKFVGHFTEYMMRVIMGEKSDELSEFSKEVHALSSGAKPVATWLGVESLGEARKACGGHGYLQMSRLNTLRDDNDPSQTFEGENFMILQQTSNILLGKAQSIGSIETPMSTMSFLNQKPSKFSSWSSNPVNDVLSAYRYLTYHLLQTTSAEAYRLKASGKNSFEVRNEIQIHRAVNLSVAYTEHTMIHWVQQFLKEIEDQSVKPVLQKVLNLFSLFLLERHLATLYITGYASGGKFGEDLREKLRLAVAELKPEAIALVDSIAPDDFILHSALGASDGKAYEHIMEEFRKYTNEQPRWVCDLAQFLQKRSQGSKL

SEQ ID NO: 2141 - protein, 645 aa, Mycobacterium sp.; identical to SEQ ID NO: 2032

SEQ ID NO: 2142 - protein, 484 aa, Desulfatibacillum alkenivorans
MAMMTGEQYEASLRKLNLQVYQFGKKVENVVDDPIIRPSMNAVKLTYELAHQPEYEDLMTATSHISGKKINRFTHIHQSTDDLVKKTKMGRLLGSLTGCCFQRCVGMDAMNALSIVTYDIDQKLGTEYNKRFLKYLAYVQENDLTCDGAMTDPKGDRSLPPHKQPDPDMFLHVVEEKEDGIVVRGAKAHQTGAVNSHEIIVMPTISMREGDADYAVSFALPADADGITYIMGRQSCDTRKLEAGTIDRGNQLFGGHEALVVFDNVFVPWERVFMYKEFEFAGQLVENFASYHRQSYACKAGVGDVLIGAAQTIAEYNGAARASHVKDKIIEMNHLNETLFCGSVACACEGGKQPSGTYLVSTLLANVCKQNVTRFPYEISRLAQDIAGGLMVTLPSEDDFKSPEVGEWLTKYYKTCEGISTENRNRILRLIENITLGTAAVGYLTESMHGAGSPQAQRIMISRQVNMAQKQKVAKQLCGIKEED

SEQ ID NO: 2143 - protein, 645 aa, Mycobacterium sp.; identical to SEQ ID NO: 2032

SEQ ID NO: 2144 - protein, 667 aa, Caenorhabditis elegans
MSRWIQPGDNVDITNERKKATFDTERMSAWIHGGTEVMKRRREILDFVKSVDDFKDPVPTEFMSREERILNNARKVVAMTNNTDQIDGSDFFGEGMYYQALTMGRDLHAMSLHYVMFIPTLQGQTDDDQLDEWLTKTISRAVVGTYAQTELGHGTNLSKLETTATYDPATEEFVMNSPTITAAKWWPGGLGKSSNYAVVVAQLYTKGECKGPHPFIVQLRDEDTHYPLKGIRLGDIGPKLGINGNDNGFLLFDKVRIPRKALLMRYAKVNPDGTYIAPAHSKLGYGTMVFVRSIMIKDQSTQLAAAATIATRYAAVRRQGEITPGKGEVQIIDYQTQQFRVFPQLARAFAFMAAATEIRDLYMTVTEQLTHGNTELLAELHVLSSGLKSLVSWDTAQGIEQCRLACGGHGYSQASGFPEIYGYAVGGCTYEGENIVMLLQVARFLMKAAEGVRKGTANLADIGAYIGKPGRKTSRLTTHHHYTDADIVEDLEHVARKQVFRAYDRLKKAQEHLRPEDAWNSVSVELAKASRWHVRLYLVKNLLHKVSIAPQDLKIVLFDVARLYAYDIITSSIGAFLEDGYMSSNQMNEVKEGIYKCLSNMRPNAVGLVDCWDYDDKELKSVLGRRDGNVYPALLQWAQNSQLNRSEVLPAYEKYLGPMMKDARSKL

SEQ ID NO: 2145 - protein, 412 aa, Agrobacterium sp.; identical to SEQ ID NO: 2129

SEQ ID NO: 2146 - protein, 409 aa, Agrobacterium sp.; identical to SEQ ID NO: 2137

SEQ ID NO: 2147 - protein, 708 aa, Arabidopsis thaliana
MFSFSKRRMRLGRVKKVQLSDSVQGYKSPLRVTKRADSSSNEAAVAATSYSDELDFQPSSGNSENWMVLSVNGEKPAPRFNHAAATIGNKMIVVGGESGSGLLDDVQVLNFDSCTWSTASSKVYLSPSSLPLMIPAWKGHCLVSWGKKVLLVGGKTDPSSDRVSVWAFDTDSECWSLMDAKGDLPVSRSGHTVVRASSVLILFGGEDSKKRKLNDLHMFDLKSSTWLPLNCTGTRPCARSHHVATLFDDKILFVFGGSGKNKTLNDLYSLDFETMVWSRIKIRGFHPSPRAGSCGVLCGTKWYITGGGSRKKRHAETLVFDILKVEWSVASISSQSSVTSNKGFSLVLLQHKDKDFLVAFGGTKKDPSNQVDAFTIDKNKSESPTHPQTTSKKNPGRLLFGKRSSSSAVLTSDESVKASSQRLIDSVARQKLASAIEEHGGSGRRSLSEIAFGDHRNPPSGNVSLRKQFSTEEEYRAVIEPAKCSEEDISVPPPTTDDNTGGAKITAEKTLSMVSDREILSLQKQCSETYPLENVDGALIFQEMDNINFAGSASSSSVYQFHEAKMTALIRRNGILEGQLEAALAGREAAERNVSVALRSKQETDKKLSDAMRDVELLKEKLTGLELAQEEANSLSNMVHSDNVRLEHDVAFLKAVLDDTQKELHSTRGVLAGERARAFQLQVEVFHLKQRLQSLENRAATPRKPFHV

SEQ ID NO: 2148 - protein, 708 aa, Arabidopsis thaliana; identical to SEQ ID NO: 2147

SEQ ID NO: 2149 - protein, 514 aa, Arabidopsis thaliana
MEEIRKEIDVGDWHSNLAHDEWTPLPVSGSRASARYKHAAVVVDEKLYIVGGSRNGRYLSDVQVFDLRSLTWSSLKLKTESSSADNIQEDDGSSLREAFPAISDHRMIKWGNKLLLIGGHSKKSSDNMLVRFIDLETHSCGVIDVFGNVPASRGGHSITLVGSRVLVFGGEDKNRRLLNDLHVLHLETMTWDVVETKQTRPVPRFDHTAATHSDRYLLIFGGCSHSIFYSDLHILDLQTMEWSQPHVQGDVVTPRAGHAGITIDENWYIVGGGDNSTGCLETLVLNMSKLVWSTSTHVEARHPLASEGLSVCSASVFGENILVAFGGYNGKYNNDIFVMRLKPGESSHPKIFKSPAAAAAAASVTAAYAIAKSDKSDYPPPANPTLNGNGNSLPERDIRNRIDTIKEEKRALESSIAETQVENAKLREKIDEVNSSHTELSQELQSVEGQLISERSRCFKLEAQIAELQKALESGQSIEAEVEMLRRQRSASDEEEDGTVQRQGSAGVWGLFGR

SEQ ID NO: 2150 - protein, 514 aa, Arabidopsis thaliana; identical to SEQ ID NO: 2149

SEQ ID NO: 2151 - protein, 514 aa, Arabidopsis thaliana; identical to SEQ ID NO: 2149

SEQ ID NO: 2152 - protein, 408 aa, Acidiphilium cryptum; identical to SEQ ID NO: 2130

SEQ ID NO: 2153 - protein, 711 aa, Candida parapsilosis
MSVPFTTKTVSLSKGPDPKTSIQTERNAQKIDPQAMHYFLEGSKERAELLKSLTQQMERDPILFTDGSYYDLTKEQQRELTVLKINRVSRYLENETIDVFNKRLSLIGVIDPQVGTRMGVNLGLFLSCIRGNGTNEQLKYWALDKHTAQLRGIYGCFGMTELGHGSNVAGIETTATFDKENDEFIINTPHIGATKWWIGGAAHSSTHCSVYARLIVDGKDYGVKTFVVPLRDANHDLMPGVSVGDIGAKMGREGIDNGWIQFSSVRIPRFFMLQKFCKVSRDGEVVLPPLEQLSYSALLGGRVMMVLDSYRMLARMSTIALRYAIGRRQFKGDNVDPNDENALETQLLDYPLHQKRLFPYLAAAYVISAGALKVERTIEDTLVELDNAVEKGDNASIMKSIEAMKSLFVDSGSLKATSTWLAAQGIDECRQSCGGHGYSGYNGFGRAYNDWVVQCTWEGDNNVLGMTTGKPFVKHVMSLEDTGKPVKGSSDFLNQLKEYTGSGASKVILNDANDILDLKKFIKSLEVAIIRLSSETAKIVRKENFDFVGAELVNISKLNAHRYVLTEYVRRVDAHDNASLKPYLYDLGRVYAATVVLDKFSGVYLTFNVASTNAITDLIKIVIPKLCKQIRPNVVGLTDSFQMSDMMINAAIGKYDGDIYENYFDLVKTLNPPRNHKAPYSAALEAMLNRPSREERERFEKSAETAEILSK

SEQ ID NO: 2154 - protein, 724 aa, Candida parapsilosis
MAMASLPDFVQTNKEKKEPETEPRIVKDIISSRPAPDPAADIAKERANTNWDLKEVHEFLEGNEAKSTEILRLYQSIERDPVLQTRPEHFDITQKGERELVAERINKMARYIEIEPYAKFRRRLQLMTVIDPSMGIRILVNLGLFLNCIRGNGTQKQYDFWAKKKENGIIKQMYGCFGMTELGHGSNVAGCETTATFDPETDEFIIDTPHIGATKWWIGGAAHSATHTVCYARLIIKDVDYGVKTFVVPLRDSQHNLLPGIAVGDIGAKMGRQGVDNGWIQFTEVRIPRFFMLQRWCKVDRKGNVTLPPLEQLSYISLLEGRVGMAADSYRIGARFTTIALRYAVGRRQFDKSGGPQETQLIDYTLHQRRLFPYLALTYAAAVGTDRLEVEHNELLENLDKGLKTNDKLLLKNTIAATKSMFVDSGSLKSTLTWEASNLIDECRQACGGHGYSAYNAFGKTYNDWAVQCTWEGDNNVLAMSAGKSIIKTVQQILNGKKVKNSTLEFLNDAPELAKAKKAVIRVKEHVDDPQRVLKAIASLISKTSMDLIPQSYQSWDAIGAQRVILSKLRCHYYLLETFIDRLENQIKANSPARPHLETTLKLYYVTNILGPFIGEFLRYGVISPNVAKYITNVYPQGLCWKLRPYIIGLTDSFQQPDNFIHSLIGKYNGDIYTNYLSAVKTVNDPRNTKAPYSEALEAMLNRGTLDERQRGERSKEVAAILSK

SEQ ID NO: 2155 - protein, 686 aa, Aspergillus oryzae
MDLMQQARASSTFNPMKLTVIIYDNEATVSARRAAFHRVEDALGLLDNMKLPHVYSGLDREGLYLEGVRRARVITNDMITHGHSHFKWLNERYQICNSSPFGMNFLMFRRTIELQGTAEQRRYWLQEIDQMRINGAYAQTELGHGTFVRGIETTATFDVDTDTFTIHCPTPTSVKYWPGGLGFSCSHAIVAARLITHGKDHGVHMFIVQIRSLEDFAPVRGVELGDLGMKMAYNGTCNGYARFNYLRVPRSSLLAAHAQVSRDGTYSQAQAKAGTLPLSKRVYSTMLDTRRNIVRCVAFGLAQAATITARYSIVREQGRLMFSDAAEEETAIITFKSQHYRLLTLIAQSYAILFAAKDFDFRYDQLVREQENDDHARLPFMHALSTGLKAWATTIASAGATEARKMCGGHGYVALSGLPEIEGSVSATATFEGENYVMWQQLVVYLFKQVRASCAGQDVDAEVKDYIGGVRSYLGNGGSPSRIQSCDKKTLFDGSTLVLIYKKRSQRVLAAAYSSYRDMCNRCSAAEAWNACMMTSLAAGQAFVEYIVLESFVKRTSPSATRDAPVSQALSHLFSLFALTTITSPTPSFAAGSFLEHGLLTPDELNEIRVHINELLASLLPNIAALTDAWDFTDSSLCSALGCKDGNVYERLLSWTRQLPANSGRAVEKAWEASEGIEEFFKASRL

SEQ ID NO: 2156 - protein, 981 aa, Aspergillus oryzae
MNNHDAKSTTRPWTVSRLSNMSDFTDHLRPSQPNGPEILARKRAQTHIPVDELAHHLLAQDGYLERQARILRIVEQEPLFDKKRQANLSREDLFKLALARAKLLRRLVDKHGWDIDDYKMAETLVDDVSPYYLHLHMFITTIREQASDAQQAYWLPLIESFKIIGAYAQTELGHGSNVQGLELQARWDPGSKEFILHSPTLTASKWWNGSLGRTANHAIVVAQLLVPSSGGEYQSHGPHPFIVQVRDMQTHQPRKGVVIGDIGPKFGYATIDNAYMLFHHFRRVLLTTSTARIPHSALLSRYAKLDPDSGQFSKPAVPAVVYGTMTYVRSLIVLQSRMALARAVTIAVRYTTVRRQFRDRDDLKGPEVAVLEYPTVQIRILPLLATTYVLHYAGQAMQRTYREAREQIQAGDFSGLAHMHSLSSGLKSFCTDLVADGIETCRRALGGHGYGGASGFIRLSPDYLSRVTVEGDNWMITQQVAAYLIKRMHAAVANIDSATGNETEDLYKEFLRANRSYKVFDDDFNIVRSFHRRTIALLYDIYVERVTKKRRWTTMLKSSTIPCKTIDHCPHRRRTRCVICIIYSLSFIWKRMPMTVGNAHDTLSWSTNSPIVFRSGAVPQRDLDELPNRVRHLMARIEPHAVALVDAWKIPDYLLDSALGRFDGKVYEDLFHRAHRLNPLNEITFNPNYWEDELVKGDGVDQQSILCVYWMVKAGHSLYSYIISQLFIFSTKMALRLVKLSDKFSCYARGENEARFIYHEIFEDHEYDKVELPEAPFMVDVGANIGLFSLYMKEKYPLAKIIAFEPAPENLEALERNLAFHMVSTVKAYPYALGASAGFAPFKYFPNMPGNSTLNVEEKEYQIQLFKENYDQTFADDMFKDAKQIMVPVHRLSLFLCLPHSNVEVIDLLKIDVEGTELEVLRGIDDRDWNKVRNIVMEVSNVKGGLDKVKQLLETKGFTVTYVAVRGIPELFKLFIVTACR

SEQ ID NO: 2157 - protein, 694 aa, Aspergillus oryzae; identical to SEQ ID NO: 753

SEQ ID NO: 2158 - protein, 514 aa, Arabidopsis thaliana; identical to SEQ ID NO: 2149

SEQ ID NO: 2159 - protein, 514 aa, Arabidopsis thaliana; identical to SEQ ID NO: 2149

SEQ ID NO: 2160 - protein, 708 aa, Arabidopsis thaliana; identical to SEQ ID NO: 2147

SEQ ID NO: 2161 - protein, 708 aa, Arabidopsis thaliana; identical to SEQ ID NO: 2147

SEQ ID NO: 2162 - protein, 514 aa, Arabidopsis thaliana; identical to SEQ ID NO: 2149

SEQ ID NO: 2163 - protein, 633 aa, Dictyostelium purpureum
MDIKYTINAEEIFKARNSSLYKYGKDFAEIQDVIKKIGSKPVIDMVSDEHKALTDRDAKEIAKLGLISVELIRDDPKKFLAYLNSLVVIDLSVLAKLVIHYQLFGGTILELGTEQHHKKYFPDIKHMKIVGGFGMTEMGHGSNVRNIETIAEYDHQSKEFVINSPTPSSTKFWIGNLAKYGTHCVLFCKLIYKGEDKGVHGIVTPIRDVDTKQVFPGIEIGDCGPKIGWNGIDNAWIRFRNYRVPKENLLNKFANIDDKGEYTCKLPTPGKLFQNTISQLVFGRMLYICGPVRVLNINLKTVINYALSRRQFGEKGKSEELIMNYPSHYQVLLPMLGHLVAFEIARDSVIERLFDKNEEKLDETNSIISGVKALVNEYNMTCTNKLRTFCGGNGISSYNLFGYFRNEMDIFQTAEGDGAVLYQQLSKFLLSEYKKWYKKEGVTGYIIKEVQTFLATSNPIYTHSRSIPYILSNEFHHHAFSYRFEKMRSIVIEKLSHSKSKKMTFMQSWNDTLLYIIELSKAYTHLYILEQAHLSIKRCTDPPTRQLLNDLIKLYALSSIENDFGFYRNYNCISAGQALKISEAIKELCIAIKPYALDIINTDNSTSFDIPLAKDGNYIQHMASRVGIPFSKL

SEQ ID NO: 2164 - protein, 748 aa, Saccharomyces cerevisiae; identical to SEQ ID NO: 59

SEQ ID NO: 2165 - protein, 633 aa, Dictyostelium purpureum; identical to SEQ ID NO: 2163

SEQ ID NO: 2166 - protein, 571 aa, Aspergillus niger; identical to SEQ ID NO: 280

SEQ ID NO: 2167 - protein, 686 aa, Populus trichocarpa
MAMARASSGPAYPERFYAAAAYAGFDGSHNSTSTVSSKFQNDTALLLYALYQQATVGPCNVPKPSSWKAVEQSKWKSWQGLGNMASTEAMRLFVKILEEDDPSWYYRASNSISEISESVVDTHVNHYSKDEPIIKNGNSFPETKTISTENGTLVETQDKDVVSEDVGTVAVYDQWIAPSITGQSPKARYEHGAAIVQDKMYVYGGNHNGRYLNDLHVLDLRSWAWSKVNFKVENESQEGQSPAKLTPCAGHSLIPWENKLLSVAGHTKDPSETIQIKVFHLQSCTWSTLKTYGKGPVSRGGQSVTLVGTSLVIFGGQDAKRSLLNDLHILDLETMTWDEIDAVGVPPSPRSDHAAAVHAERYLLIFGGGSHATCFNDLHVLDLQTMEWTRPTQQGEIPTPRAGHAGVTVGENWFIVGGGDNKSGVSETAVLNMSTLVWSVVTSVQGRVPLASEGLSLVLSSYNGEDVLVSFGGYNGHYSNEVNVLKPSHKSTLQSKITETPVPDSVSAVHNVTNPTRDVDSELEVGQEGKIREIVMDNIDRESWVWKISKRVPSGQNIGEGTSLIATLKAEREELDSSLSKEKLQTLHLKQELADAETRNTDLYKELQSVRGQLAAEQSRCFKLEVDVAELRQKLQTMETLQKELELLQRQKAASEQALDANHRQGSGGVWGWLAGTPGGQKGDDA

SEQ ID NO: 2168 - protein, 681 aa, Mus musculus
MGNPGDRVSLGETWSREVHPDIDSERHSPSFSVERLTNILDGGIPNTELRRRVESLIQRDPVFNLKHLYFMTRDELYEDAVQKRFHLEKLAWSLGWSEDGPERIYADRVLAGYINLNLHGIAMNAIRSLGSDEQIAKWGQLGKNSQIITTYAQTELGHGTYLQGLETEATYDATTQEFVIHSPTMTSIKWWPGDLGRTVTHAEVLAHLICLGARHGMHAFIVPIRSLEDHTPLPGITVGDIGPKMGFENIDNGFLRLNHVRVPRENMLSRFAEVLPDGTYQRLGTPQSNYLGMLVTRVQLLYKGFLPTLQKACTIAVRYAVIRHQSRLRPSDPEAKILEYQTQQQKLLPQLAVSYALHFMTTSLLQFFHSSYSDILKRDFSLLPELHALSTGMKAMSSDFCAQGTEICRRACGGHGYSKLSGLPSLVTQAIASCTYEGENTVLYLQVARFLMKSYLQAQVSPGSIPQKPLPQSVMYLATPRPARCPAQTAADFRCPEVYTTAWAYVSARLIRDATQHTQTLMRSGVDQYDAWNQTSVIHLQAAKAHCYFLTVRNFKEAVEKLDNEPEIQRVLQNLCDLYALNGILTNSGDFLHDGFLSGAQVDMARTAFLDLLPLIRKDAILLTDAFDFSDHCLNSALGCYDGHVYQRLFEWAQKSPANTQENPAYKKYIRPLMQSWKPKL

SEQ ID NO: 2169 - protein, 673 aa, Mus musculus
MGSLPEEKDSALWSDTPKGPLSAYRARASFNSGELLLFWDGQDVIHFKKTIFSTLENDPLFARSYGADLPLEKLRELNFLRCKRVFEYGFFKVEELLKNPLKILVLINCLGMYDWSLANKCVLHMLVFGTTVFVSGSEKHFKYLEKIYSLEIFGCFALTELSHGSNTKAMRTTAHYDPDTQEFILHSPDFEAAKFWVGNLGKTATHAVVFAQLYMPDGQCHGLHSFLVQIRDTKTLLPMTGVMVGDIGKKLGQNGLDNGFAMFNKVRIPRQNLLDRTGNITSEGTYNSPFKDVRQRLGASLGSLSSGRISIISMSVVNLKLAVSIAIRFSATRCQFGPTDKEEIPVLEYPLQQWRILPYLAAAYALDHFSKTIFMDLIEVQSARLRGDHSDQQAELGREIHALASAGKPLASWTAQRGIQECREACGGHGYLAMNRFGDLRNDNDPNCTYEGDNNVLLQQTSNYLLSLLEPPLQDGAHFTSPLKTVDFLEAYPGILGQKFLGSSKADWMDSAAPLAAYRWLVCYLLQESHRRYCQEKKSRGSDFEARNNSQVYGCRPLALAFMELTVMQRFHEHIHSSGLSPSLRTVLGRLSTLYGLWCLSQHMALLYRGGYISGEQTGRAMEDAILTLCEQLKDDAVALVDVIAPSDFVLNSPIAKADGEVLSTQEKLEKRK

SEQ ID NO: 2170 - protein, 661 aa, Mus musculus; identical to SEQ ID NO: 72

SEQ ID NO: 2171 - protein, 697 aa, Mus musculus
MGSLPEEKDSALWSDTPKGPLSAYRARASFNSGELLLFWDGQDVIHFKKTIFSTLENDPLFARSYGADLPLEKLRELNFLRCKRVFEYGFFKVEELLKNPLKILVLINCLGMYDWSLANKCVLHMLVFGTTVFVSGSEKHFKYLEKIYSLEIFGCFALTELSHGSNTKAMRTTAHYDPDTQEFILHSPDFEAAKFWVGNLGKTATHAVVFAQLYMPDGQCHGLHSFLVQIRDTKTLLPMTGVMVGDIGKKLGQNGLDNGFAMFNKVRIPRQNLLDRTGNITSEGTYNSPFKDVRQRLGASLGSLSSGRISIISMSVVNLKLAVSIAIRFSATRCQFGPTDKEEIPVLEYPLQQWRILPYLAAAYALDHFSKTIFMDLIEVQSARLRGDHSDQQAELGREIHALASAGKPLASWTAQRGIQECREACGGHGYLAMNRFGDLRNDNDPNCTYEGDNNVLLQQTSNYLLSLLEPPLQDGAHFTSPLKTVDFLEAYPGILGQKFLGSSKADWMDSAAPLAAYRWLVCYLLQESHRRYCQEKKSRGSDFEARNNSQVYGCRPLALAFMELTVMQRFHEHIHSSGLSPSLRTVLGRLSTLYGLWCLSQHMALLYRGGYISGEQTGRAMEDAILTLCEQLKDDAVALVDVIAPSDFVLNSPIAKADGEVDFSGICRQDLLGRTTTCRACCLQKELSTCSLVKNC

SEQ ID NO: 2172 - protein, 1175 aa, Ogataea angusta
MAQVEDYSSLHRLRKNSEILSNANKILVANRGEIPIRIFRSAHELSMQTVAIYSHEDRLSMHRLKADEAYVIGARGQYSPVQAYLQIDEIINIALEHNVSMIHPGYGFLSENSEFARKVEDSGMIWIGPPHNVIDAVGDKVSARNLAGKCNVPVVPGTDGPIDSVEQAQEFVDKYGYPVIIKAAFGGGGRGMRVVREGESIADAFQRATSEAKTAFGNGTCFIERFLDKPKHIEVQLLADNYGNVIHLFERDCSVQRRHQKVVEIAPAKTLPVEVRDAILTDAVKLAKAANYRNAGTAEFLVDNQNRHYFIEINPRIQVEHTITEEVTGVDIVAAQIQIAAGASLQQLGLLQDKITTRGFAIQCRITTEDPAKNFQPDTGKIEVYRSSGGNGVRLDGGNGFAGAIISPHYDSMLVKCSTSGSNYEIARRKMIRALVEFRIRGVKTNIPFLLALLTHPTFVSGDCWTTFIDDTPSLFEMVQSKNRAQKLLSYLADLCVNGSSIKGQIGLPKLTRDADIPVIHDINGWDIDIKNTPPPESFRQYLLDYGPEQFANQIRAFDGCLIMDTTWRDAHQSLLATRVRTIDLLNIAPATAHAFRYAFALECWGGATFDVAMRFLHEDPWDRLRKLRKAVPNIPFQMLLRGANGVAYSSLPDNAIDHFVKQAKDAGVDIFRVFDALNDLEQLKVGVDAVKKAGGVVEATVCYSGDMLKPGKKYNLKYYLETVDKIMEMGTHLLGIKDMAGTLKPAAAKLLISSIRKKYPSVPIHVHTHDSAGTGVITYVACALAGADVVDCAVNSMSGLTSQPSMSAFIAALDNEINTGITEQNAREIDAYWSEMRLLYSCFEADLKGPDPEVYNHEIPGGQLTNLLFQAQQVGLGEKWLETKKAYEEANMLLGDIVKVTPTSKVVGDLAQFMVSNKLSPKDVERLASELDFPDSVLDFFEGLMGTPYGGFPEPLRTNILAGKRRKLTRRPGLELEPFDLKKIKEELQSRFGNSITECDVASYNMYPKVFESFKKIQEKYGDLSVLPTRFFLAPPKLNEEISVEIEQGKTFVIKVMAIGDLSPQTGTREVYFEFNGEMRKVTVEDKLAAVETVTRPKADAHNPNEVGAPMAGVVIEVRVHPGVEVKKGDPLCVLSAMKMEMVISSPVSGRVGEVIVHENDSVDAGDLICKITK

SEQ ID NO: 2173 - protein, 686 aa, Populus trichocarpa; identical to SEQ ID NO: 2167

SEQ ID NO: 2174 - protein, 644 aa, Populus trichocarpa
MARSSSGLAYPERFYAAASYAGFDGSHNSTTTVSSKFQNDTALLLYALYQQATIGPCNVPKPSSWKAVEQSKWKSWQGLENMASTEAMRLFVKILEEDDPSWYSRASNSISESVTDTQVNHYSDEHVIENGNSFPDTKTISTENGTLVETQDKDVVSEDVGSVAVYDQWITPPITGQLPKARYEHGAAIVQDKMYIYGGNHNGRYLNDLHVLDLRSWSWYKVNFKAENEPQEGQSPAKLTPCAGHSLIPWENKLLSIAGHTKDPSETIQVKVFDLQSCTWSTLKTYGKAPISRGGQSVTLVGTSLVIFGGQDAKRSLLNDLHILDLETMTWDEIDAIGVSPSPRSDHAAAVHAERYLLIFGGGSHATCFNDLHVLDLQTMEWTRPAQQGEIPTPRAGHAGVTVGENWFIVGGGDNKTGVSETAVLNMSTLGWSVVTSVQGRVPLASEGLSLVLSSYNGEDILVSFGGYNGHYSNEVNVLKPSHKSTLESKIAETPVPDSVSAIHNITNPTRDVDSEFEGGHEGKIREIHLLATLKADREELNSSLSKEKLQTLHLKQELTDAETRNTDLYKELQSVRGQLATDQSRCFKLEVDVAELRQKLQNMEALQKELELLQRQKAASEHALNANHRQGSGGVWGWLAGTP

SEQ ID NO: 2175 - protein, 664 aa, Arabidopsis thaliana; identical to SEQ ID NO: 146

SEQ ID NO: 2176 - protein, 664 aa, Arabidopsis thaliana; identical to SEQ ID NO: 146

SEQ ID NO: 2177 - protein, 743 aa, Caenorhabditis briggsae
MNQSIKPGDNPDLTDERLSGTFDTNAMAAVIYGSDKLAQRRREISEAVSRIPELKDSKPYPFMTREEKILEGSRKSAVLNRLLPGLIDLESFEETVFIHQEVIGIEGYPLALHESLFIPPIATQGTDEQQEKWLMRAQRREIIGCYAQTELGHGSNLRALETTATFDISTREFILNSPTITSLKWWPGALGKSANWSIVIANLIIKEHNYGPHPFMVQLRDEKSHEPLPGITVGDIGPKMAFNGADNGFLGFKNYRIPRENMLMRHSKVTSDGSYIKPPHAKIGYSSMVKVRSRMAAEQGLFLAHALTIAVRYSAVRRQGFLKDKSREVKVLDYQTQLHRLFPSIARAYAFIFCGFETIRLYDQLLIDVQNGNTSGMADLHALTSGLKSVVTYQTGEGIEQARMACGGHGYSMASYISEIYGVAIGGCTYEGENMVMLLQLARYLVKSIEMIQNGKSRELGPMVAYLAEKESEIDLNLGPNEYLKVFEYAARNQTWRATEKFQKLRNSGMSNEKAWNQASVELTRASRLHTRLYIMSTFINHVGSIVDQKVKGVLIDLLNVHVTYEVMDIGIYVQGLLSSNQMDLIRNQLYVSLETIRPNAVSLVDSFQISDMQLRSQVICAFLAAWDDFQTKHCIMVQRTRFKTYILQQISFNKIKFEESYELRYLAILVAVSLRVPYVNDLCMDPRKFKTRQMLYHFVLGRRDGNVYENLFKWAKSSPLNQTDVLPSVTQYLKPMMDKSKL

SEQ ID NO: 2178 - protein, 644 aa, Populus trichocarpa; identical to SEQ ID NO: 2174

SEQ ID NO: 2179 - protein, 660 aa, Trichoplax adhaerens
MAKNTTTVLDLRQERSNPPFSINDMTEFYDGGSEATKKRKLISSLILNNPAFKWLERHYWTRDEAYSSNVQCLAEVAKILRKHKLNVDDFMHYYWLVSTIGEIVSFEMHLTTWKSALQDQGTPEQRKKWLPLVENFEIVATYCQTELGHGTFIRGFETTATYDPKTREFILNTPTLTATKWWIGEVAKTATHALVMAQLWTQNKCYGPHLFILQVRSLEDHTPLPGITLGEMGDKFGYNSIDDGFMQLSNVRIPRDQMLMRHSKVTLDGSFIPPKNPRLTYVAITLYRCQLLMLCSNYLARASTIAVRYSAIRRQTETKPGYEPKVLDYVTQQNKLFPHIAGAYALACTGHYMIDFGKRATERIKLEDLSVLAEFHGISSGLKAFCTEMSVSGIEECRRACGGHGYSSACGIGHIYNNWLASCTYEGENTVMYLQSAKYLLRCVKNPKSAPLGVSAVLHNPPCKHWDIKNMQDLEKTNTVLEAYRARAYKKVAIADKYLRELQSGGDTSYDAWNKSGIKLVDCAKAFTHYFVIKTFFNMIEKSRLGQSCHLQLHRLSILLALHGIDQNTGDFMLDNFIDFEQIKLIRVKILELFSEIRPVAVCLVDAFDIPDQTLLSVLGRYDGDVYNKLFEWAKEAPLNKTQVRYLLVVVIDCVFVYLA

SEQ ID NO: 2180 - protein, 527 aa, Oryza sativa
MASAKVSHPVKSASEESKVLVVENGKMVDVQDKEITMEGLCSISSYDQWARIPVSGPLPKPRYKHAAAVVQEKMYVFGGNHNGRYLGDMQVLDFKCLSWSKLEAKIQSEEPSDLTGTASLPPCAGHALVPWGNKILCLAGHTREPTESLSVKEFDPQTCTWSTLRTYGRSPSSCGGQSVTLVGGTLVVFGGEGDGRSLLNDLHVLDLETMTWDEFETTGTPPSPRSEHAAACYADRYLLIFGGGSHSTCFSDLHLLDMQTMEWSRPEHQGITPEPRAGHAGVTVGENWFITGGGNNKKGVPETLVLNMSTFVWSVVTGLEGRAPPTSEGSSLVLHKVNGEDFLVSFGGYSGRYSNEIYALKSSRKSGVPSGQLNEPETNGLASVAENSSRGVIFEIEELQDEKTIKRADTSKTLLQAVKGEKSHIEEKLNQEELQSSRLKQELANVETKNVELTKELDLVRNQLSAEEARASQLENEISDLQQRLQKMETLEKESESLRLEKDAESDDSSSGSNQRPADKGFWRWNG

SEQ ID NO: 2181 - protein, 700 aa, Yarrowia lipolytica; identical to SEQ ID NO: 364

SEQ ID NO: 2182 - protein, 677 aa, Yarrowia lipolytica; identical to SEQ ID NO: 2132

SEQ ID NO: 2183 - protein, 701 aa, Yarrowia lipolytica; identical to SEQ ID NO: 995

SEQ ID NO: 2184 - protein, 689 aa, Yarrowia lipolytica; identical to SEQ ID NO: 2134

SEQ ID NO: 2185 - protein, 700 aa, Yarrowia lipolytica; identical to SEQ ID NO: 361

SEQ ID NO: 2186 - protein, 699 aa, Yarrowia lipolytica; identical to SEQ ID NO: 994

SEQ ID NO: 2187 - protein, 660 aa, Trichoplax adhaerens; identical to SEQ ID NO: 2179

SEQ ID NO: 2188 - protein, 622 aa, Homo sapiens [sequence omitted]

SEQ ID NO: 2189 - protein, 702 aa, Cryptococcus neoformans; identical to SEQ ID NO: 870

SEQ ID NO: 2190 - protein, 660 aa, Homo sapiens [sequence omitted]

SEQ ID NO: 2191 - protein, 660 aa, Homo sapiens [sequence omitted]

SEQ ID NO: 2192 - protein, 702 aa, Cryptococcus neoformans; identical to SEQ ID NO: 870

SEQ ID NO: 2193 - protein, 664 aa, Unknown; identical to SEQ ID NO: 146
  Description of Unknown: Acyl-CoA polypeptide

SEQ ID NO: 2194 - protein, 669 aa, Unknown; identical to SEQ ID NO: 987
  Description of Unknown: Acyl-coenzyme A polypeptide

SEQ ID NO: 2195 - protein, 566 aa, Serratia sp.; identical to SEQ ID NO: 2083

SEQ ID NO: 2196 - protein, 442 aa, Corynebacterium resistens
MWRVCHELVPLYLSTPDSTTIKLSVFHSTKQATVIPVTITLCLAKLAYMPPHQSTDNSALDLAGFDSLLTNSEVSTRQAIRDFGTRQLRPHIEQWFDSGEPPTKDLMAHFGQLDVLGMHLEGYGCPGGSAVEYGLACMEIEAVDSGLRSMVSVQGSLAMFAIRHWGSEEQKEKYLPRLATGELVGCFGLTEPGAGSDVASMQMHAKREGNEWVLNGSKMWITNSPIADVLVVWTRTEDGHAGFIVERGTPDLNTPEIRRKLSLRASITGEIVLDDCHISDAQRLPKVNSLRGPLTCLNEARYGIIWGALGAARDSLQTTLEYTAERPVFGRPLSSFQLTQAKLADMAVELNKSMLLALQLGRLKDRGELRPHHISAGKLNSTRVALDIARECRTLLGAAGITTEYSPMRHANNLESVLTYEGTAEMHQLIIGQAITGEAAFR

SEQ ID NO: 2197 - protein, 1175 aa, Ogataea angusta; identical to SEQ ID NO: 2172

SEQ ID NO: 2198 - protein, 703 aa, Arthrobacter sp.
MTTTATAPKSSLDTVETVPSFVRDAWWTPDAGATASAVPVLDASTGELLAKVSTEGLDLADVVDYGRTTGQKELGTLTFHQRALKLKELAQYLNARREHFYELSAQTGATKIDSMVDIDGGIGVLFTFGSKGRRELPNSQVVVDGPMEVLSRDGSFAGEHIYTRIPGVAVQINAFNFPVWGMLEKFAPAFIAGVPTIVKPATPTGYVAAAVVKAMIESNILPKGSLQLISGSARTILDNLDYRDLVSFTGSASTANSLKSHPNVVKGGVRFTSETDSLNAAILGPDAVKGTPEFDAFIKSVVTEMTVKAGQKCTSIRRTIVPQSMVSDVVAAVGARIEERVVLGDPRAEGVTMGALASLEQLADVRAAVQSMLDAGGELAYGTLDSPRVTKADGGVDVVEDGAFMSPVLLSWADAEAEEVHSLEAFGPVSSVIGYTDLADAVRLAARGGGSLVASVCTNDPEVARELVTGIAAHHGRVLMLNREDARSSTGHGSPVPHLVHGGPGRAGGGEELGGIRSVMHHMQRTAIQGSPNMLTAVTGIWHTGADRNFTLETEGQHPFRKHLSTLHIGDAIRSELREVSLDEITKFANSTGDTFYAHTNQEAAEANPFFPGIVAHGYLLLAWGAGLFVEPAPGPVLANYGLESLRFITPVAAGDSIRVTLTAKKITPRETDEYGEVAWDAVLTNQNDEIVATYDVLTLVEK

SEQ ID NO: 2199 - protein, 678 aa, Mycobacterium abscessus
MTAVLQSYITGKWTTPEGDADPLVNAATGDEVARYAVGSVDLAAVVAYGREVGGPALRALTFHQRAAALKALAKQLMAAKNDFYPLSAATGATARDSAVDIDGGFGTLFSYASKGVRELPNDTIYLDGASESLGRAGTFVGQHIYTSRPGVAVQINAFNFPVWGMLEKLAPAFLAGVPSIVKPAHQTAYLTELVFRAIIDSGLLPEGSVQLLCVRSHELLDHLDGQDTVLFTGSAATAAKLRSHRNVVAGGVRLNAEADSLNCSILGPDATPGTPEFDLYIKQLVAEMTTKAGQKCTAIRRALVPEALVDAAVTATSERLSKVVVGNPELDSVRMGALASIDQRDEVLRSLKLLQDSATLVFGDPASFTVEGADAAQGAFLPPLLLRAEDPTAAAVHEVEAFGPVSTVIGYRDLDDAVELAARGQGSLVGSLVTHDPEVARKVTIGIAAHHGRILVLDRDDAKESTGHGSPLPTLVHGGPGRAGGGEELGGIRGVLHFMQRTAIQASPDMLTAITGRWTTGSARTATEVHPFRKHLEELQIGDTIVGGPRVVSLEDIDHFAEFTGDTFYAHTDPDAAARNPLFGGIVAHGYLVVSLAAGLFVEPNPGPVLANFGVDGLRFLTPVKPGDALTVTLTAKQLTPRLSADYGEVRWDAVVTNQNDDPVATYDVLTLVAKKES

SEQ ID NO: 2200 - protein, 661 aa, Actinoplanes missouriensis; identical to SEQ ID NO: 758

SEQ ID NO: 2201 - protein, 683 aa, Shewanella woodyi
MKIKSYVCGGWVSGTGRCVTSKNAFTGETVATTSSMESGFDNALAYGRLIAGNKLRQFTLHERAEMLKSLATHLMRKKEDFYQLSYLTGATRSDSWIDVEGGISTLFSYSGMVRRELVNEKFIVEGKVEPLSVNGSFIGQHILMPKMGVSVHINAFNFPVWGMLEKIAPSLLAGMPVIVKPATATCYVAEAVVKEIVASKILPEGCVQLICGGVGDLLDHLTEQDVVTFTGSAKTGKMLRSHDNILSKNIPFNMEADSLNACILAPDVQQDMPEFDAFIKEVHREMITKAGQKCTAIRRVLVPSAMMDCVGDALSKRIQSTLVGDPTNDGVKMGALVNQAQCADVQSAVDQLLFSCDVIHGGWDSMNTIGIDYDKGSFFPPTLLRCDTPLTSQQVHDIEAFGPVSTLMPYDSIEQAIEIVGKGKGSLVSSVFSYDNDNIRTLVYGMACYNGRILVNNRDCMKESTGHGSPLASMVHGGPGRAGGGEELGGIRAVKHYMQRTAIQGSPNTLQAVTNEYVPGADTTTSLQHPFKKYFEELNIGESLTTHRRTVTEADIVNFGCLSGDHFYAHFDETAAADSLFGKRVAHGYFLISAAAGMFVEPAPGPVLANYGLDSLRFIQPVGIGDTIEVSLTVKRKIYKKTKPDDAHPAGVVVWDVKVVNQDNEVVALYDILTLVAYKNAAQ

SEQ ID NO: 2202 - protein, 675 aa, Actinosynnema mirum
MPVLRSYVSGRWHTPTTEGAPLHDAVTGEEIARISSDGVDMGAALRHGREVGGPALRELTFHQRGALLKALASHLREHRDELYELSARTGATRTDSMVDVDGGIGVLFTYSSKARRELPNDRVLVDGAVEPLGRGGTFAGVHIATPLRGVAVQINAFNFPVWGPLEKFAPAFVAGVPTLIKPASPTAYLTERLVELVLGSGLLPEGSLQLVCGSAGDLLDHLTEQDLVGFTGSAATAARLRTHPAVVRSSVRFTAEADSLNCSVLGPDAEPGTPEFDLFVKQLVSEMTVKAGQKCTAIRRALVPEPLLDAVAEAASARLGRVVVGNPASSGVRMGALANLEQREEVRRALKSLVSAGRIVHGSPDRVDVVDADPERGAFLSPVLLTADPDRAQPHEVEAFGPVSTLLPYRDAAHAVELAARGAGSLVGSVVSHDADFVREVVLGVAPWHGRLLVLDRDDAGESTGHGSPLPTLVHGGPGRAGGGEELGGVRGVLHHLQRTAVQGSPDVLTAVTGRWTTGAKRTAGDEHPFRKSLARLAIGDSITAGPRAVSQADVEHFAEFTGDTFYAHTDDAAAAANPFFGARVAHGYLVVSLAAGLFVSPEPGPVLANYGLENLRFLTPVFFGDELTVTLTAKQITPREDQEYGEVRWDADVVNQKGESVAKYDVLTLVAKEG

SEQ ID NO: 2203 - protein, 402 aa, Corynebacterium aurimucosum
MPPILGPQHPSGKHLEKIKYPHADIFAVADRLVPEEQARLAEIHEFLQTEIRPVVGEYWDREELPFDLLPRMAEMGLGEIELTNTSRLYRGLVYAEVTRADVSLSALVGIHNELVLGLIDKLGSPEQKDTWLAGLRQFTKVGCFALTEPDHGSDIAGGLATTAERTAEGWVINGAKRWIGAGTFADFAITFARDTADDEIKAFIVELDRDGVTRSKISRKMGLRIMQNADLNFDNVLIPHENLIPGAESFANVNDFLCYSRAWVGWQGAGLQLGIFDKAREYAVKREQFGRPIAKFQLVQEQLSRILGNATASLAMMAQLAEVQEQGKLEMPFAALAKATTTRLARESAAAGRNIGGGNGILTEYDLSKMMDDAEILFTYEGTYDINSLIVGRAVTGVSAFV

SEQ ID NO: 2204 - protein, 702 aa, Arthrobacter chlorophenolicus
MTTTATAPHATLDTVETVPSFIMDSWWTPETGSAAATPVRDASTGELLAKVSTEGLDLAAAVEFGRTTGQAELGKLTFHQRALKLKELAQYLNARREHFYGFSYQTGATKIDSMVDIDGGIGVLFTFGSKGRRELPNSQVVVDGPMEVLSKDGSFAGEHIYTRIPGVAVQINAFNFPVWGMLEKFAPAFIAGVPTIVKPATPTGYVAAAVVKAIVESNILPKGSLQLVSGSVRGLLDVLDYRDLVSFTGSAATAKSLKAHPNVVEGGVRFTSETDSLNAAILGPDAVEGTPEFEAFVKSVVTEMTVKAGQKCTAIRRAIVPQELVPAVSAAIGKRIQERVVVGDPRAEGVTMGALASVEQLEDVRAAVQSMLDAGGELAYGTLDSPSVTSADGTTGVVDAGAFMAPVVLNWGNPEAEALHSLEAFGPVSSVVGYADLADAVRLAARGGGSLVASVCTNDPDVARELVTGIAAHHGRVLMLNREDARTSTGHGSPVPHLVHGGPGRAGGGEELGGIRSVLHHMQRTAIQGSPNMLTAVTGVWHTGADRNFTVDTEGTHPFRKHLETLRIGDAVRSDLRQVTLEDITAFANTTGDTFYAHTNQEAAEANPFFPGIVAHGYLLLAWGAGLFVEPAPGPVLANYGLENLRFITPVAAGDSIRVTLTAKKITPRETDEYGEVAWDAVLTNQDDEIVATYDVLTLVEK

SEQ ID NO: 2205 - protein, 698 aa, Trichoplax adhaerens
MIGRFVLLYSYNNTSTNPLDRYRHQASFNWQKLQEYFFGGKDIVQFRAAVSKMLEADPIFHRPIKELSRDEEQRRAMIQCMRFSEYNFLSEEETESNICKRRVLTELLNMVNRNAAAKRYLHETLFSKGVTLLGTRRHVHYVKQCLQYQLYGCFALTELSHGSNVRSMRTTATFDPNTQEFVLNTPNFEATKWWIGNLGKTATHALLFAQLYTADGRCHGLHSFVVPIRDPVSLIPYPGVIVGDIGKKIGQNGIDSGFVAFNEFRIPRENLLNRTGDVTSQGKYVSSCKDPNQRLAITLPILSIGRILITDAAVINMKAAIIPAIRYSAARRQFGPKSSGEVAIIEYQLQQWRLFPYLAAIYALNAFMVSFFEDYAYMEKLAATESQYDLQAQLNQEIHVLSAASKPLSTWLARDAIQECREACGGHGFHEAARFGDLRNDNDPSCTYEGDNNILLQQTSNYLLTLLFLKSTRGIEIRSPLGSVNFLNNAEPILRKKFKPRTVADCRDMKVILRTYQWLVAYLAKRSVERVQSSLGVNKDMFSARNGNQVFHCRPLALAFIENRVLEKFYEHINNAPDNGNIKSVLVRLFLLYGWWSLDKHLALLLQGSYITNDECVDLIHDTIVRLCDELKRDAVRLVDIIAPSDFLLDSVIGSYNGQIYKDIYQRTMTTPGSLSRPDWYDVFLNKPKIRSKPLAKL

SEQ ID NO: 2206 - protein, 678 aa, Dinoroseobacter shibae
MSLLDVQSFAAGHWIAPDADARMIAHAVTGAPLARAGNGALDVQAMLDYARDTGGPALRALTFHDRARMLKALALHLGAHKQALYDLSFATGATQADHLIDIDGGIGTVFVFASKGRREMPDAHVYLDGEVEQLSRTGTFLGQHIATPLQGVAVHINAFNFPVWGMLEKLAPTLLAGMPAIVKPATASCYVTEKAVRIILDSGILPAGALQLVTGGLGDMLDRLTCQDVVSFTGSADTALRLRAAPHLLRNAVRFVAEQDSLNASILGPDAVPGTPEFDLFIREVAREMTAKAGQKCTAIRRILAPQAQVDGVIAALGARLAKTVIGDPRDTATTMGALVSNGQKRDVLAKARVIATEAERVFGDPEAFTVHGADARTGAFLPPMLLHCADPDAAQRLHDTEAFGPVSTVMGYRDLDHAVALVNRGAGSLVASLITHDPEVARQVALGAGAFHGRLYINDRDSMGEATGHGAPLPHMIHGGPGRAGGGEELGGVRGVMHYMQRTAIQGSPDMLTAIGGKWVPGATETPAPAHPFTRGFDALRIGETLHTPARQVTLADIEHFAAFTGDTFYAHMDDAAAARNPFFPGRVAHGYLLLSFAAGLFVDPDEGPVLANTGLDSLRFLKPVAPGDSLKARLTVKHKTPRNDAYGEVRWHVSLTNQEDDLVAEYELLTMIAYAA

SEQ ID NO: 2207 - protein, 675 aa, Sphingomonas wittichii
MTKTLNNYAADQWVASTTEKLPVLSAIDGSPVAQAGSAGLDFAGMLRHARDVGGPALRAMTFHARARMLKALAQAIMARKEELYALSASTGATRVDSWIDIEGGAGTLFTMSSRGRRELPDDVVLIDGDLEPIGKNGTFVGQHVYTSLQGVAVHINAFNFPVWGMLEKLGPTLLAGVPAIVKPGTATCHVTEHAVRIMIEAGVLPAGALQLIVGGVGDLLDHLTCQDVVSFTGSAATAMKLQSHPVIARESVRFVAERDSLNASILGPDAAPGTPEFDLFVKEVAREMTVKTGQKCTAIRRAFVPAQWLDAAEEALKARLGKVVVGDPAQEGVTMGPLAGITQLNDVRAKARELATEAKLVFGDIDTVQVQGAEAAKGAFVSPLLFRRDDPWTAKLVHDVEAFGPVSTLMPYKDFDDAIALANRGLGSLAVSLFTYDPQVARQFVIGAAAYHGRIVILDRDSAKESTGHGSPLPMLIHGGPGRAGGGEEMGGVRGVKHYMQRSALQGHPRSLSVVAGRYLAGAPQPEGEVHPFRQRFGELQIGYTLRTAPRTITLDDIEHFAHFTGDTFYAHMDEEAAAANPFFPGRVAHGYLILSFAAGLFVDPAPGPVLANYGLEGLRFVKPVSPGEAIKVALTVKSKTQRNDEYGEVRWAVTVTDSADELVATYDLLTMNAI

SEQ ID NO: 2208 - protein, 447 aa, Salinibacter ruber
MPNDLATADIDRDVLARLSEKADVDQLLGALSDLDEDELDRLADGARPQKPQRPSPTPPVNADVYEVFEGLTDAQEATRETVRSFMQAEVEPVANDMWEDGTFPKDLIPKAGALFDEVVGRDAYTFPSDDPIRTNLISFEMSRVEPSFCTFWGVHTLLSMGSVALFGSEAQKERFLEPMAAFDMIGSWALTEPDHGSDVSQGLATTARREGDTWVLDGAKKWAGNATFADVTVVWARDEADGCIKGFLVEQERPGYHVEQIGGKIAKRGVENGLIELDGVELPEANRLPGVSHFGDVSAQLATCRASVAWEAAGLATGAYEKALAYCNERTQFGKPTSSFQMVQDKLVTMLGKVTALQTFVMQLGRLEAGAGAIGNERSSLAKVWACDTMREVVSIARGIMGGNGILLDHDVARLFADAEGVYSYEGSREMNALIVGRAITGQSAFV

SEQ ID NO: 2209 - protein, 736 aa, Kluyveromyces lactis; identical to SEQ ID NO: 63

SEQ ID NO: 2210 - protein, 676 aa, Ruegeria sp.
MCPKDVASFAAGEWIAPDHSAREIASAITGEVIARAGNATLDVQAMLDHARDTGGPALRAMTFHDRARMLKALAQHLDAHKQELYDQSFDTGATQKDHLIDVDGGIGTVFVFASKGRREMPDSTVYTDGAVEQLSRHGSFMGQHICTSLPGVAVHINAFNFPVWGMLEKLAPTLLAGVPAIVKPATATCYVTEAAVRLMLDSGLLPEGALQLVSGGLGDMLDRLTCQDVVSFTGSAATALKLRQTPAIVENSVRFVAEQDSLNASILGPDAAPGSAEFDLFLKEVQREMTTKAGQKCTAIRRIIVPDAQVNAVIDGLSAALAKITIGDPRADSTRMGALVSAAQKRDVLEQADKIATEATRVFGDPDNFTVEGADKDKGAFVPPMLFHCADPDAARHVHDTEAFGPVSTVMGYRDLSHASELANRGQGSLVASLITADPVVAREVTLNIAAFHGRVYINNATSMKESTGHGSPLPHMVHGGPGRAGGGEELGGVRAVKHYMQRTAVQGSPEILSAITGKWVPGGPETTGPAHPFTRRFGALTIGETLHTAPRVVTSDDVAHFAQFTGDTFYAHMDDAAAERNPFFPGRVAHGYLLLSFAAGMFVEPNEGPVLANTGLDNLRFMKPVVPGDSIKVRLTVKAKTPRNEEYGEVRWHVTLTNQDDELVAEYDLLTMVAF

SEQ ID NO: 2211 - protein, 786 aa, Salinibacter ruber; identical to SEQ ID NO: 762

SEQ ID NO: 2212 - protein, 426 aa, Brachybacterium squillarum
MTSTDTRDTVATARAVVTPPSAPAATPAELLPPEADHYALFQQVAGEDLEAWRTARSIAEEVLPEINDWWDRGEYPLHLLGRLGELDLFTDGLRLPGHRQLSPLATGLVNMELSRLDGSVGTMVGVQGGLALRSIVLLGSEEQKQRWVEPIAAGTEYAAFALTEPDHGSDSVSLETTARREGDGWVLTGEKRWIGNGVNGHVTVVWARVDDPEDLDGSGLHGQVSGFLVEQDLPGYTAEVIRGKVALRAIHQAQITLDGVRLRVEARLPRARSFKDTARVLFATRAGVAWGALGHATACYESALEHARTRIQFGRPLAKAQHVQVRLADMLQTLTAMQLTCVRIAQLEAEGTITPEQASLAKVHNTRGARSIAADARDLLGGSGILLENRVARHKADIEALHTYEGTDTMQSLIVGRKVTGVSAFA

SEQ ID NO: 2213 - protein, 683 aa, Nakamurella multipartita
MTVAVTSYVAGRWQDPAGDRVALLDAVTSAPVAEIGTAPIDLAPVIDHARSVGGPALRELTFHERALALKHLALHLNGRRDAFYALSAWTGATRRDSLIDVDGGIGVLFTYASKGRRELPNTGVLVDGPAEKLGRGGQFVGQHIYTPRRGIALQINAFNFPVWGMLEKLGPAFLAGVPTVVKPASQTSYLTQAVVAEIIASGLLPEGSLQLVAGGSRGLLDLLDEQDTVAFTGSAATAAALRTHPRVLAGVRFSSEADSLNFSVLGADIAAGSVEFDLYVRQLVTEMTAKAGQKCTAIRRALVPEPLVPAVIDAVQARIRDKVRVGNPAAPEVTMGALVGLAQRDEVRKSLNALAGAARMVVGDPDRFDLVDADPRRGAFLPPILLHAADSARSEPHEVEVFGPVSTVIGYRDTAHAVELAARGRGSLVGSLVSADPDVVRELVLGVAPWHGRLLVLDQESAPESTGHGSPLPTLVHGGPGRAGDGEELGGIRGMKHYLQRTAIQGSPRAVSAITGTWVTGAPRTTGGVHPFRKSLAELRIGDAVVAGPRVITLDDIEAFAELSGDTFYAHMDQAAAAANPFFDGRVAHGYFVVSLAAGLFVSPEPGPVLANVGLNNLVFTTPVYPGDALTVALTAKAISPRVDSDWGDVTWDAVITNQNEAVVATYDVLTSVAKTWPVAPAE

SEQ ID NO: 2214 - protein, 856 aa, Toxoplasma gondii
MHECCGMLDASLATKFTVQFNLFGGTLLRLGSKENHVQREILNKIDTLEEIGCFALTELGYGNNAVCLETTATYEPARDEFVISSPTTLSQKYWITNGALHASWAIVFAQMIIRGASQGVHAFLVRIRQPSSNLGSSSELRVCPGVTIEDMGHRIGCNGVDNAKITFHNVRIPRSHLLDGITKVEADGRVFSIVDGPDSLSVDLETLLKKREEKTSDRSGNGGGKSAVSNVAEEKGVNSQRPSQKRRTTLANSAQWTRAEVNRGGQSWTGDALSSSQNEGQPNAVQVVSPVEKPEAEPPSASIARNRFLLQTEQLLSGRLCIACMMIGGIKVVLNNTLRYSSTRLSTGPSGLSDTPILSFAVQKQTLMPLLAQALILMAWTNEVKALYERFTRVLSRTASVRQAFLRERIALCAAVRKQRQFENAEKSTANRGERSREETTSPLTEEARGGKDGNPTLFNVHTQRNKKTGKLEDPVLIGSLPVRSLLEAHAAAHCEVLLHCCALKPTVAWCAERLATEGRERCGGGGFLSANLFGEFIGSAHAGLTAEGDNRVLYAKVSKEVFALSCQHNSPVWLKALAEFPETSIRDEFAAFSRTLSTSGNDAPSRSQSPSFPPLFSVNLDPHLPVPPPPQEPSFPPPLECGPGATSSSEISSYPPPMYGPEGELLKLIHILLRLRMSRKIQRLRQLLQKKQTEQRVSNRDPRGPLHSQKRESEKSLHDHHQRLGGMTQVVHEQGKNMENTIRMQKKQMVYDLWMADVDTHDFIYSSAPASIAKCFADLAGFEMAEKLIKPEEVHALHQAKNDSVDRVAAISMQLISCFGIPEKLLFAPIARDWEAFNDPSRPTNGELTRYHDSG

SEQ ID NO: 2215 - protein, 685 aa, Methylobacterium nodulans
MTRILNSYALDRWFVPEEGLVDIPSAIDGRIVARSSTRGLDMAAMVHHARTVGGPALRALTFHERADRLRALATHLTAHKDALAELAADTGATKRDNAFDIDGGIGTLFAYASRGRRELPAQRFVVDGGPEPLSRGGSFLGMHVMTPLRGVAVHVNAFNFPCWGMLEKLAPSILAGVPVITKPATATAYVAEAVVRLIVEADVLPKGALQLLCGSAGDLLDHLAGQDVLSFTGSAATSQVLRDHPAVSRQAVRFIAERDSLNAAVLGPDAAEGTPEFNLFVKEVVREMTVKAGQKCTAIRRVIVPRALEPAVIGALKAQLAAVPVGDPRREDVRMGPLASLSQRAATREAVAEIAREAEIVFGDPETVTAIGADPEAGAFMAPVLLRCPDPLRAVAPHAVEAFGPVATVMAYDDLDDAVALVAKGEGSLVASVVTADPEVAESLVFGIAAHHGRVHVLDRDCAKESTGHGSPLPGLVHGGPGRAGGGEELGGLRGVFHYLQRTAVQGSPARLSALTRTWLSGAPAPVTAEHPFRRDYDALAVGDTVETPSRVITLDDIEHFASFTGDTFYAHMNEEAAKANPFFPGRVAHGYLILSFAAGLFVDPAPGPLLANYGLDNLRFLKPVSPGDAIRVRLTVKQKQPARKPEYGEVRWDVEVFNQDGETVARYELLTMSARNTAGGRAAA

SEQ ID NO: 2216 - protein, 704 aa, Kocuria rhizophila
MSTQNQAIDTPQPQILPSFVKGAWWRPEDPQRVADVCNATTGELVARVSTDGIDTAGAVEYARTVGQASLGQLRIHDRALILKQLAQYLGEHKEELYEISYATGATAKDHLIDIDGGIGTLFTFSSKGRRELPNANVIVDGAVEQLSRDGSFLGEHIYTRLPGVAVQINAFNFPVWGMLEKFAPAFIAGVPTIVKPATPTGYVTEACVRLMLDSGLLPEGSLQLISGSARDLLDHLDARDHVAFTGSAATARSLRAHSHVQEKGVRFTAETDSLNAAIMAPDVTEDSPEFEAFVKSVVLEITAKAGQKCTAVRRVIVPQEIKPAVVAALKERVAQRGVVGDPRDPATTVGPLASEDQASEVLRSVRTLIDAGATVELGGPEELSSVPQDGAFFPVTLLSFDDARTPAVHEVEAFGPVTSVLGYSGDVADAVEIAALGGGSLVATVCTHSPELAAQFASGIGAHHGRVLFLDRDDAKTSTGHGSPVPHLVHGGPGRAGGGEELGGVRAVKHYMQRTAVQGSPDLLTGITGQWHWGATANTVTREDVENGTGEHPFRKSLETLRIGDQFVSDLRTVKLDDILEFADKTGDTFYAHTDEEAATANPFFPRRVAHGYLLVSWAAGLFVEPAPGPVLANYGLENLRFITPVTYDDAIRVTLTAKKITPRVTDEYGEVAWDARLTNQKDEIVATYDVLTLVAKQWPVREA

SEQ ID NO: 2217 - protein, 680 aa, Saccharopolyspora erythraea
MAALRSFVNGDWHVPSEDGAPLHDAVTGEEVARISSAGIDIAGALEYGRARGGPVLGELTFHQRAALLKVLASHLLEHREELYALSARTGATLGDSKFDIDGGIGVLFGYSGKGRREMPNAKVYVDGAVEPLGKGGTFVGQHICTPLRGVAVQINAFNFPVWGPLEKFAPAFLAGVPTLVKPASQTAYLTHRLVELIVESGVLPEGSLQLVCGGVGDLLDHLTDQDLVSFTGSAATGQRLRAHPNVAARSVRFNVEADSLNCSVLGPDAAPGTDEFDLFVKQLVTEMTVKAGQKCTAIRRALVPAGRVDDVVQAASERLSKVVVGNPASPEVRMGALASLEQREEVRRSLKALLAAGTLVHGDPERVEVAGADAERGAFLPPMLVRCDDPDRAEPHEVEAFGPVSTIMPYDSAAHAVELARRGLGSLAGSVVSADADFAREVVLGAASRHGRLLVLNRHNARESTGHGSPLPALVHGGPGRAGGGEEMGGVRGVLHHMQRTAVQADPDTLTAVTGQWVPGSGRSVTDVHPFRKHLEDLRVGDTVMAGPRAVTLEDVEHFAEFTGDTFYAHTDEEAAKANPFFEGRVAHGYLVVSFAAGLFVEPSPGPVLANYGLENLRFLTPTYPGDELTVTLTAKQITPRVNAEHGEVRWDADVTNQVGESVAKYDVLTLVAKRPEEKA

SEQ ID NO: 2218 - protein, 700 aa, Bos taurus; identical to SEQ ID NO: 501

SEQ ID NO: 2219 - protein, 706 aa, Debaryomyces hansenii; identical to SEQ ID NO: 61

SEQ ID NO: 2220 - protein, 706 aa, Debaryomyces hansenii
MFSSNTVNSSAPPNPSKSIQDERSQNQFEPTLMHEFLEGSRENSQQILRLYHQMERDPILCSSYKDYELNRLEERTKSALRINSLSRYIEEDSPSDFHRRLNLLAVYDPSTGIRLSINLGLFVNCIKGNGTAEQYKYWCVDKETTKIKNAYGCFGMTELGHGSNVAGCETTATFDEENDQFIIDTPHIGATKWWIGGALHVATHCVVYARLIVKGKDYGVTTFVVPLRDSNHDVMPGITIGDIGGKMGREGVDNAWIQFSNVRIPRFFMLQRFCKVSSSGKVELPPLQQLVYISLLGGRVMMAVDSYRISARFITIAVRYAVGRRQFKKNGGDGNGDGLECKLLDYPLHQRRLMPYLALTYAMAVGTKKLENDHAACLKEFDYAVNSNDKVALKKALETTKSLFVDSASLKSTCTWLAGECITECRQACGGHGYSAYSGFGKTYGDWTIQCTYEGDNSVLGMSAGKAIIANTAQVIKKNKKITGSISFLSNAKNYINDELVLKSEDDLQDLSLVFKALEVLICRLANQSIDVLESSGDNNWDLVSYQRVVLSKLRCHHYLLQNFMSRIDSADESTKPMLKDVAKTYAYTSILENFSAELLSLNVTSPKFINRLKSSVIPTYLKKLRNQAITLTDSFQQPDMVLNSAIGNYNGDIYEDYFKVVKQANPPTQTKAPYSAAIESMLNRPSKEERERFEKSAETAKILSK

SEQ ID NO: 2221 - protein, 442 aa, Citricoccus sp.
MTANTATDNTPSTPATASTADAATASVATSTGRSASGDLSASFLGPVDLTGMDGLFSDQEKDLALEVRSLVDEVIRPNIADWYEAAVFPREIVPELGKLGVLGMHLDGYGCAGRSAVQYGLAAQELEAGDSGLRTFVSVQGSLAMSAIHKHGSEDQKNQWLPAMAAGEAIGCFGLTEPGAGSDPASMRTTARQEPGGDWVLTGTKRWIGLATLADVAIIWAQTGEHGDGRGVRGFVVPTNTPGFSAEAIGSKLSMRASVQCEIHLDGVRLPAEAILPAESAVGLKGPFQCLNEARYGIIWGVMGAARDSFNAVLDYTLGREQFGAPLASYQLTQAKLADMAVAINKGYLLAHQIGRVKDTDPKALTPAMISTGKLDNCRVAIGIAREAREMLGGNGITLEHSPLRHANNLESVRTYEGTDEVHQLTIGRTLTGIGAFTRTQA

SEQ ID NO: 2222 - protein, 401 aa, Citricoccus sp.
MSAGRPVAVGTVIPSDLYGFAERLTEAERRVLTDLREQLQSTVYPLLNDAWDKAELPTELLEAVRGLDLMDPPALREAGEPVRDLLTGFRNFELARCDINVGTLYNAQAGLFRTVCTLGGSPEQSRDLDARIRTYELTGVFGLTEPDHGSDVAGGLATTATRDAATGEWVINGAKRWIGGATVSDVVATFARDTADGQVKCFLVPRDAEGVTMTIIPNKASLRIMQNAHIEYRDVRVTEADRLHGINSFKDVARCLRNMRSDVAWMAVGAQAGAYEAALRYVRGREQFGRPIAGFQLVQEKLAIMLGNLTASLGMVVQLTEQQAAGVFKDENSALAKMYTSLRLRETVALAREVCGGNGITLDTDVARFHADAEAIYSYEGTHEINALIVGRAVTGVGAFV

SEQ ID NO: 2223 - protein, 421 aa, Citricoccus sp.
MNTAINTAPTGRSASGDLSASFLGPVDLTGMDGLFSDQEKQLALEVRSLVDEVIRPNIADWYEAAVFPREIVPELGKLGVLGMHLEGYGCAGRSAVQYGLAAQELEAGDSGLRTFVSVQGSLAMSAIHKHGSEDQKTQWLPAMAKGEAIGCFGLTEPGAGSDPASMRTTARQEPGGDWVLTGTKRWIGLATLADVAIIWAQTGEHGDGRGVRGFVVPTNTPGFSAEAIGSKLSMRASVQCEIHLDGVRLPAEAILPAESAVGLKGPFQCLNEARYGIIWGVMGAARDSFNAVLDYTLGREQFGAPLASYQLTQAKLADMAVAINKGYLLAHQIGRTKDTDPKALTPAMISTGKLDNCRVAIGIARDAREMLGGNGITLEHSPLRHANNLESVRTYEGTDEVHQLTIGRTLTGIGAFTRTEQ

SEQ ID NO: 2224 - protein, 414 aa, Citricoccus sp.
MTTQSDVSAPTDRPQLPTAEPDYEVSAALDTDAYAVFADLPDEELALWRRARQFVTPQVLQQMHRAWDLAQYPLDLVEQMGRMDLLRDGVAVEGLPEVSRVAAGLATMELSRGDGSLATVVAVQGGLAMRSIELCGSEEQKQRYLTPLARGELLGSFALTEPTHGSDAVGLETTATPTAGGWLLNGHKKWIGNGASGGITVVWARSTEDEKVRGFIVPQESEGYRAGVIEGKIALRAIHQADITLDGVFVPEDHVMPDATSFRDTSRVLFSTRVGVAWSAVGQALGCFEGALQYVQQRRQFGRPLAASQIVQERLARMLSQLTQVQLLVLRAAQLEDRGTLTGPQASLAKYSATRAARSIAQDARDLLGGNGILIRHEVGRHFADIEALHTYEGTETVQALIIGRDLTGVSAFA

SEQ ID NO: 2225 - protein, 704 aa, Millerozyma farinosa
MSTKGVVSYSAAPNPAALLQKERENPSVDPVKMNYFLEGSKERSELIRSIVQQMERDPVLATNASYYHMTKDQERELTALKIGRLASYVETDNLDDFQRRLSIIGLFDPQVGTRLGINLGLFLSCIRGNGTAEQLQYWAFHKETVYIKGIYGCFGMTEMAHGSNVMGLETTATFDKENDEFIINTPHIGATKWWIGGAAHSSTHCTVYARLIVDGEDYGVKTFVVPLRDADHNLMPGVTVGDIGPKMGRDGIDNGWIQFSDVRIPRFFMLQKFCKVSRDGDVTLPPLEQLAYSALLGGRVMMVLDSYRMSARFVTVALRYAVGRRQFKPSDGSEESLETQLIDYPLHQRRLLPYLAQSYVISAAALKLETTIENTLNDLDAAVETDDLDGIMKSIDDMKSLFIDSSSLKATCTWLTAELIDQCRQTCGGHGYSSYSGFGKAYNDWVVQCTWEGDNTVLCISIGKPLVKHVMAVINDGKVVKGSSSFLTDVKDYLNDKPVITSVSDLSDLRKVLRAIEVLLMRLCYQASTVVKVNKGNFDYVGGEMLVIGKLKAHHYMLKEFIERVESIEDKSLVPHLLNLGRLYGASHVLDKFSGDFLAYSVLTTNVVSEMSGYFIPDMCKAIRPHCIMLSDSFQQSDMLINSSIGNYDGNIYENYFNTVKTNNPPSNMKAPYSAKFEALLNRASKEIRDRGEKSEEAAEILSK

SEQ ID NO: 2226 - protein, 704 aa, Millerozyma farinosa; identical to SEQ ID NO: 2225

SEQ ID NO: 2227 - protein, 829 aa, Flavobacteriaceae bacterium
MKLKNYIYGQWSEGSGEEIPLYNAVNGELVAISDTGGIDYQQALDYGRTVGYKNLSSMTFYDRGEMLKKVALYLLERKKKYYELSYKTGATHADSWVDIEGGFGTFFTYSGLAKRMLPNTPFWVDGDTQKISANGTFIGTHILTPSEGISVQINAYNFPVWGMMEKLSTSLLAGVPSIVKPATPGSYLTNAVFTDMIESGILPEGAIQLVCGEPGNMLDYVQDGDSVLFTGSARTGKKLKSLPSVSTNAVRFNMEADSLNCSILGLDAKPGTPEFDLFIKEVRNEITTKAGQKCTAIRRIMVPENLVDEVQNALGKALDQTKIGNPLNRETRMGSLVGKQQYEEVLKNVNLLKAETELIYDGQHELLDASYESGSFMSPKIFYNDKPFEKNISHDVEAFGPVSTLMPYRDAEEAAALAKRGKGSLVGSIVSNDEKFVAETSWKMASQHGRIFVLNRDSAKESTGHGSPLPTLMHGGPGRAGGGEEMGGLNGLHFFLQKTAIQGSPDMLSAITKVYQQGATQNFSDRHPFRKFFEKVEIGDSLETAGRTVTEADIVNFSNVSWDHFYAHTDSTSLNGTIFDKTVAHGYFILSAAAGLFVSGKKGPVIANYGLENASFFKPVYAGDTITVYLTAKEKINKGVKGRNIPSGVVKWLVEVVNQRDEIVCVATILTLVAKQSPFMELNAKEIQKRLNGLTDSTERKFGEMTPQMMVEHLEEVMRNGFSKLDPSDFPEIPAEKMDLLQDWIYTEQKIRPGAKYPMLAEGEMPTLRFKNLAQAKEKLMQTLKEYLIYYRENPDAEHFHPRFGTLNKEMMELFHRKHFTHHFEQFGL

SEQ ID NO: 2228 - protein, 707 aa, Arthrobacter aurescens
MPWKDPSTMTTTAVAPETTAVATVPSYVQDAWWTPAPDAKKVPVRDASTGEVLANVSTDGLDLAAVVNHGRTTGQTELGKLTFHQRALKLKELAMYLNGRREELYESSSQSGATKIDNMIDIDGGIGVLFTFGSKGRRELPNSQVVVDGPMETLSKDGSFVAEHIYTRIPGVAVQINAFNFPVWGMLEKFAPAFLAGVPTIVKPATPTGYVAAAAVKAIVESGILPAGSIQLISGSARTILDELDYRDLVSFTGSASTANSLKGHKNVVQGGVRFTSETDSLNAAILGPDAVPGTPEFDAFIKAVVTEMTVKAGQKCTAIRRVIVPQELTSDVAAAIGARISERVVVGDPRAEGVTMGALASLEQLADVRAAVQSMLDAGGELAYGSLDSPSVTSVGGTVGVVEDGAFMSPVLLSWADAEAEEVHSLEAFGPVSSVIGYSSLTDAIRLAARGSGSLVASVCTNDPAVARELVLGIAAHHGRVHMLNREDARSSTGHGSPVPHLVHGGPGRAGGGEELGGIRSVMHHMQRTAIQGSPNMLTAVTGLWHTGADRNFTVETEGEHPFRKHLSTLRIGDAVRSDLREVTLEDITAFANSTGDTFYAHTNQEAAEANPFFPGIVAHGYLLLSWAAGLFVEPAPGPVLANYGLENLRFITPVAAGDSIRVTLTAKKITPRETDEYGEVAWDAVLTNQNDEIVATYDVLTLVEK

SEQ ID NO: 2229 - protein, 681 aa, Nocardia farcinica
MSELLQSYVGGRWVTPPDEGTPLLSAVDGSVVARLSSTGVDRAHMVDHARTVGGPALAALTFHERAARLKALGKYLLEHKAELYAISAHTGATERDSAVDIDGGAGTLLSYASKATRELPNDTVYLDGGVERLGRKGTFAGQHIYTARRGVAVQINAFNFPVWGFLEKLAPAFIAGVPSLVKPAGQTAYLTEAAFRLIIESGLLPEGSVQLLCGSAGDLLDHLGGQDSVAFTGSAETAALLRAHPVVVREAVRFTAEADSLNASILGADVTPGSPEFELFVGQLVTEMTVKAGQKCTAIRRALVPEPMVDAVVDAVRERLARVVVGAPGADGVTMGALAGIDQREEVRKAVRALTKSAQIVFGDPESVTVVGADAATGAFLSPILLRCDDREAVEPHEVEAFGPVSTVLGYRDTADAIALAARGKGSLVASVVTGDTAVAREIALGLAPYHGRVLVLDTVDARESTGHGSPLPTLVHGGPGRAGGGEELGGIRGVLHHMQRTAVQGSPAVLTAVGRRWVTGADQVRGDVHPFRKDLGQLKLGDTIVAGPRRVTLDDIGHFAEFTGDTFYAHTDPEAAAANPLFGGIVAHGYLVVSLAAGLFVDPAPGPVLANFGVDNLRFLTPVKAEDELTVTLTAKQITPRTSAAYGEVRWDATVTNQNDEAVATYDVLTLVAKPEGETK

SEQ ID NO: 2230 - protein, 606 aa, Kitasatospora setae; identical to SEQ ID NO: 777

SEQ ID NO: 2231 - protein, 476 aa, Desulfatibacillum alkenivorans
MGLMTAQEYLESLHDGRIVYYLGEKIENVAQDPNLGVCARTMALDYEIAEDPKYKDLATVYDEELGETISRYYHKPQNGEELIKAHDLIVTSTNLGDGIIPFSHDIGSDALNAYSITAQAIGNPEYIQRVENYRTYLKQKDLATCAAVTDVKGDRMLRPSHPGQAHPDQYLRVVEKNDKGIIVRGAKMHITGAAYSNEILVLPCRAMTEKDVDYAVAFAIPANTPGLTQICRPFKSKVSSLEFPNTRQHFIHTDSLIVFDDVLVPWERVFMCGEWEHAATMVYNFALLHRRTGVAYRIPMSEQLAGVAMAMAEYNGVSQAPHVREKLTDLLVYLETLRSLSRSACLDFVMRGGMAVPNPVVTNIAKYHFASKYHDMVKIIQDLAGGALVTSPTYKDFQVPEIKSYIEKYMIPKNGISGEQRMRMMDLIRRILPAENETICLHGEGSPMAERMTIFLEGRRTLAQCMKLVETQAQVG

SEQ ID NO: 2232 - protein, 479 aa, Desulfatibacillum alkenivorans
MAIITGEQFRESLKEVSPEIYIRGERVEDVASHPLLKQTVHHLAAGCDLLFDPELKDRLVVRSPISGEDIPRLGMHIQQEKEDLFIKAELTREISSRRICSACGSNMLSVTWAMIHDVDAAHGTDYLSRYRDFIIRIHKTGLPFAWCMMDPKGDRSLPPSRQPEPTDLRIVERKPGGVVVNGVKLHTTMGPCTRFVVAVPCRALGKKDKDFAVSFALPIETKGIKMIARPSPGPSRETSMESPLSSRFMGVEAMTIFDNVFVPEENLFMCGEWEQAGNLSMYFASLHRQSKCACSAGHCDMFAGAAALAADVNGVSGRASHIQEKITSMIMDGEAGYGCALGAAVNARRHPSGVWMPDPLIANSGLGAIRSKVGRHMEHLHDIAGGLIATMPTEADWNNPELRKYMDKALRGNPKYTTEERLRAMHLIQDLAASRAAGTIMAFTINAAGSPATNQVVVRRAYDLDKQIRYAKELASIKT

SEQ ID NO: 2233 - protein, 447 aa, Salinibacter ruber; identical to SEQ ID NO: 2208

SEQ ID NO: 2234 - protein, 401 aa, Cupriavidus basilensis
MTASAKPNHPLPAPDSDFYLIHELLSDTEQAQLKQVRAFMENRVAPVINKFWADDAFPFELIPGIRDLNIVGVGFEGYGCPGGSTLLDGFIAMELARVDSSIATFYGVHSGLAMGSIYLGGSEEQKQKWLPPMARLEKVGCFGLTEPLVGSGAGGGLLTTAKREGDTWVINGQKRWIGNSPWCDLSIIWARDVDDNQVKGFIVENKTTAGFSVEKIENKIALRVVQNGVITLDHCRVPEENRLQGDLSFRDTARVLRLTRQYVAWESVGCSMGAYEHALRYAQTREQFGKPIASFQMVQDLLAKMLGNITASQCMVARLAQLQDQGKLLDEHASLAKAFCTVRMRETVASAREILGGNGIVLDYNVARFFADSEALYSYEGTREMNSLIVGKAISGFSAFV

SEQ ID NO: 2235 - protein, 402 aa, Corynebacterium aurimucosum; identical to SEQ ID NO: 2203

SEQ ID NO: 2236 - protein, 699 aa, Rhodopseudomonas palustris
MHGATGLLRRLRLLAMTNRQESNLMKLESFVGGQWTAPGRDRIELLGAVTGEVVAEATSGGLDMRALLAFARDKSGPALRRLTFHQRAELLKKLAQYLAERKDQLYQLSFLAGCTRTDSLIDVDGGIGTLIAYAGKGRRELPNATFLLDGGVEPLSKGGSFVGRHIVTSLHGVAVHINAFNFPCWGLLEKLAPALLAGVPVVSKPATVTSYVAHALVRMIVESNILPDGALQFIVGSTDDLFDHLTCQDVVSFTGSAATSEKLQRHPVIAREAVRFIAERDSLNAAILAPDAAPGTPEFDLFVKEVAKEMTVKAGQKCTAIRRALVPAAQLDAAIAALRERLSKVTVGNPELETVRMGPLVGLDQRRDVLEQLARLRAEANLVAGDPDHFAVEGADSSRGAFVPPLLLHCADPIRANAVHEVEAFGPVATIMPYRDLNEAIVLANRGGGSLVASVYTHDHTTAADLTFGISTFHGRLVIIDRDCGKEQTGHGSPMPQMVHGGPGRAGGGEELGGLRSLAHYMQRSAVQGSPAMLSAITGSWSKGAPIIEARHPFRYTFDDLAIGQTFQSKERTVTLDDIEHFAHFTGDTFYAHMDEEATKGHPFFPGRVAHGYLLLSFAAGLFVDPDPGPVLANYGLDSLRFLKPVQPGEAIKVRLTAKEKSPRNRQYGEVRWDVEITTGTGETAATYELLTMNAMRPD

SEQ ID NO: 2237 - protein, 679 aa, Rhodococcus jostii
MSKLLESYAAGRWYTAPDEGTPLLSAVDGSEVARISATGLDLGEMVTYAREVGGAALGKLTFHERAAVLKALALTLMAGKEEFYALSTSTGATKRDSGVDIDGGFGTLLSYAGKARRELPNDTVYLDGAFEQLGKKGTFLGQHVYTSRRGVAVQINAFNFPVWGFLEKLAPAFIAGVPSIVKPASQSAYLTELVFRRIIESGLLPEGSVQLLSGSARVLLDHLGGQDSVAFTGSADTAATLRAHPNVVGEGVHFNAEADSLNASILGSDVEPGSEEFDLYVKQLVTEMTVKAGQKCTAIRRAFVPSALMDDVIAAAEARLSRVVVGAPDAEGVTMGALASLEQRDEVLKSLRGLTKSAQIVVGDPENFDVVGADKATGAFLPPILLRSDDKDATEPHDIEAFGPVSTVIGYDSTDEVIELAARGKGSLVASLVTRDSALARDIVLGLAPFHGRVLVLNRDDAKESTGHGSPLPVLVHGGPGRAGGGEELGGIRGILHHMQRTAVQATPDILTAVGNKWVTGSQRNDDGVHPFRKNLAQLRIGDTIVGGPRQVTLADIDHFAEFTGDTFYAHTDPEAAAANPLFGGIVAHGYLVVSLAAGLFVEPNPGPVLANFGVDNLRFLTPVKADDSLTVTLTAKLITPRSSADYGEVRWDAIVVNQDGDPVATYDVLTLVAKGENA

SEQ ID NO: 2238 - protein, 674 aa, Rhodopseudomonas palustris
MKLESFVQGQWRAGRDRIEIRSAVTGNVVAEATSGGLDLRQALAYGRDTGGAHLRRLSFHQRAELLKKLASYLGERKEQLYKLSFATGATRGDALIDVDGGIGTLLVYAGKGRRELPNATFLLDGAVEPLSKGGNFAGRHIVTPLRGVALHINAFNFPCWGLLEKLAPALLAGVPVISKPATVTAYVAHALARMIAESQILPEGALQFLVGSTDDLFEHLTCQDVVSFTGSAATSQALQRHPVIAREAVRFIAERDSLNAAILAPDAAPGTPEFDLFVKEVAKEMTVKAGQKCTAIRRALLPAAHLDAAIAALRTRLASVTIGNPELDNVRMGPLVGLDQRRDVLAHVATLRQEAELVAGDPDNFEIEGADARRDAFLPPLLLHCADPARATAVHEVEAFGPVCTLMPYGDLAEAITLTNRGGGSLVASVYTHDADTAAELVFGVGAFHGRLVLIDRDCGKEQTGHGSPMPQLLHGGPGRAGGGEELGGLRSLAHYMQRTALQGSPAMLSAITGSWSKGAPLVLERHPFRYHFEDLAIGQSFSSKERVVTLEDIEHFAHFTGDTFYAHMDEEATAGHPFFPGRVAHGYLLLSFAAGLFVDPDPGPVLANYGLDSLRFLKPVVPGEAIKVRLTAKEKSPRNAQYGEVRWDVEITTGAGDTAATYELLTMNAMRAD

SEQ ID NO: 2239 - protein, 673 aa, Ruegeria pomeroyi
MALQQISSFAAGQWVAPGAGARTIASAITGAPIASAGNDALDVLAMLDHARNTGGPALRKLGFHDRARMIKALGQALNARKAELYAASFDTGATQSDHLIDIDGGIGTMFVFASKGRREMPDGQIYLDGEVEQLSRNGTFLGQHVCTPLQGVAVHINAFNFPVWGMLEKLAPTLLAGVPSIVKPATNSCYVTELAVRIMLEAEILPAGALQLVSGGLGDMLDHLDCQDVVSFTGSADTALKLRSNPVILQNSVRFVAEQDSLNASILGPDAEPGTPEFDLFIKEVAREMTTKAGQKCTAIRRIIAPQPRVEAVIEALSARLSKTVIGDPRDEATRMGALVSGGQKADVLAKAAIIGQEAEQVFTMDPGLSGDLANGAFVPPMLFHCADPDRAQRVHDTEAFGPVSTVMGYRDVDHAVTLANRGGGSLVTSLITHDADVARDVVMGAGAFHGRIYINNRDSMKESTGHGSPLPHMVHGGPGRAGGGEEMGGVRGVKHYMQRTAVQGSPEMLARIGGKWVPGANEVAGPAHPFTRRYNELSIGETLNTAARTVTMDDIEHFAHFTGDTFYAHMDDAAAKRNPFFPGRVAHGYLLLSFAAGLFVEPNEGPVLANTGLDGLRFMKPVSAGDSIKVRLTVKKKTRRTEDYGEVRWHVTLTNQDDEMVAEYELLTMNAY

SEQ ID NO: 2240 - protein, 401 aa, Cupriavidus basilensis; identical to SEQ ID NO: 2234

SEQ ID NO: 2241 - protein, 452 aa, Mucilaginibacter paludis; identical to SEQ ID NO: 1256

SEQ ID NO: 2242 - protein, 452 aa, Elizabethkingia anophelis
MSNIFANIRQAITLFKSVDFEKLSKISQRVDIPKLMDNFSKLDDKQLKGLMKMMDQDRPKKELPPIDGDFYDIYHTLTPEQREVQLKVRAFMEKEVKPLVNNYWLHDEFPFELIPKFKELNICGVTYEGYGCPGMPFLMEGVIAMEMARIDASIATFFGVQSGLAMGSIYICGSEEQKQKWLPQMQKFDKIGAFGLTEPEVGSGAAGGLTATCKRTVEGWVLNGEKKWIGNATFADLIIIWARDLDDGEVKGFIVEKDNPGFSVEKIKGKMALRIVQNGHITLKDCLVTEENRLQNANSFKDTAKVLRMTRAGVAWMATGCARGAYESALDYTRKRKQFGKPIASFQMIQGHLVEMLSNLTAMQTLVFRLSEMQDEGILKDEHASLAKVFCTMRTRDIVSRAREVMGGNGILLEYDVARFVADAEAIYSYEGTKEINSLIVGRSITGFSAFV

SEQ ID NO: 2243 - protein, 452 aa, Elizabethkingia anophelis; identical to SEQ ID NO: 2242

SEQ ID NO: 2244 - protein, 675 aa, Vitis vinifera
MSMAMARASSGLAYPDRFYAAASYAGFDGSPNSSSKGVSSKFSNDVALLLYALYQQATVGRCTIPKPRGWNPIEQSKWTSWHGLGNMAAAEAMRLFVKILEEEDPGWYSRASDFVAEPVVDVEMNHHPKVEPVTENGNSFPETKTISHENGSMLETQDKDVVLEGLGSIAVYDQWIAPSVSGQRPKPRYEHGAAVVQDKMYIFGGNHNGRYLNDLQVLDLRSWTWSKVEVKAGTESLESPSTVPLPSCAGHSLIQWENKLLSIAGHTKDPSETIQVKAFDLQTCTWSTLKTYGKAPASRGGQSVTLVGTSLVIFGGQDAKRSLLNDLHLLDLETMTWDEIDAVGVPPSPRSDHAAAVHAERYLLIFGGGSHATCFNDLHVLDLQAMEWSRPTQQGDIPTPRAGHAGVPVGENWFIVGGGDNKSGVSETVVLNMSTLVWSVVTTVQGRVPLASEGLSLVVGSYNGEDVLISFGGYNGRYSNEVNVLKPSHKSSLQTKIMEPVPESVSAVHNATNATRDVESEFEAGQEGKIREIVMDNIDSEPMKIKNEETGEGLIATLKSEKEELESSLNKEKTQSLQLKQELAEAETRNSDLYKELQSVRGQLAAEQSRCFKLEVDVAELRQKLQTMETLQKELELLQRQKAASEQALNAKQRQSSGGMWGWLAGTPNEKADDA

SEQ ID NO: 2245 - protein, 651 aa, Vitis vinifera
MSMAMARASSGLAYPDRFYAAASYAGFDGSPNSSSKGVSSKFSNDVALLLYALYQQATVGRCTIPKPRGWNPIEQSKWTSWHGLGNMAAAEAMRLFVKILEEEDPGWYSRASDFVAEPVVDVEMNHHPKVEPVTENGNSFPETKTISHENGSMLETQDKDVVLEGLGSIAVYDQWIAPSVSGQRPKPRYEHGAAVVQDKMYIFGGNHNGRYLNDLQVLDLRSWTWSKVEVKAGTESLESPSTVPLPSCAGHSLIQWENKLLSIAGHTKDPSETIQVKAFDLQTCTWSTLKTYGKAPASRGGQSVTLVGTSLVIFGGQDAKRSLLNDLHLLDLETMTWDEIDAVGVPPSPRSDHAAAVHAERYLLIFGGGSHATCFNDLHVLDLQAMEWSRPTQQGDIPTPRAGHAGVPVGENWFIVGGGDNKSGVSETVVLNMSTLVWSVVTTVQGRVPLASEGLSLVVGSYNGEDVLISFGGYNGRYSNEVNVLKPSHKSSLQTKIMEPVPESVSAVHNATNATRDVESEFEAETGEGLIATLKSEKEELESSLNKEKTQSLQLKQELAEAETRNSDLYKELQSVRGQLAAEQSRCFKLEVDVAELRQKLQTMETLQKELELLQRQKAASEQALNAKQRQSSGGMWGWLAGTPNEKADDA

SEQ ID NO: 2246 - protein, 664 aa, Jannaschia sp.
MQHVGSFAKGIWVPAGDGAREIADAATGQVIALAGSDSLDVQGMIAYARDVGGPALRALDFHDRARMLKALALHLNAHKERLYELSYTTGATRKDHGFDVDGGIGTLFVFASKGRREMPEGHVLIDGGFEPLGRTGAFGGQHIYTPKLGVAFHINAFNFPVWGMLEKIAPAILAGVPSIVKPATATCHVTELCVRIMLEAGVLPDGALQLITGGVGDALGHLGPQDAVTFTGSAATAGIVRGALGSGVPFTAEQDSLNASILGPDAEPGTPEFDLFLKEVCREMTTKAGQKCTAIRRVLAPQPLLQPLIEGLSARLSRVVVGDPREEGTGMGPVVSASQRDDVLEKAAAIGAEAECVFEGNHAMDQGAFVAPRLFHCADPDAAQAVHATEAFGPVSTVMGYRDLDHAVALANRGEGSLVASLITHDTDVARQVVQGIGAWHGRVYINDRDSMGEATGHGAPMPHLTHGGPGRAGGGEELGGIRAVKHYMQRVAVQGSPTMLSAVTGRWVPGAARTPTDGHPFQVRFGDLAPGRTLRTDPRTITLDDIAQFAEFTGDTFYAHMDEAAAKRNPFFPGRVAHGYLILSFAAGLFVEPNEGPVLANTGLDNLRFLKPVSPGDSIAVDLTVMDRKSRNDDYGEVRWHAEVSNQDGDAVAEYELLTMVAK

SEQ ID NO: 2247 - protein, 2339 aa, Medicago truncatula
MDPERSIEEQFSKLHPSLPLNTRIGIVGAGPSGISAAYALSRLGYNNITVLEKHHAVGGMCESVEIEGKVYDLGGQVLAASSAPVIFHLAKETESALEELDSHKLAIIDTSSGKYQDIKVADDYVSVMSLTLKIQEKVKNSGRFGVHAVSEVAADLTPEFLEHHGLKSIPNSVAFGYTASGYGFIQDMPYAYIHEFTRTSMAGKIRRFKGGYTSLWQKIAESLPIKLHCNTEVLAIRRNFDSVNVNVKSSNETETMEFDKIIVSGNFPLKYGRTYRSAPSNCIDRYLMRLSNVADSEAEVMDASDIEKELFSKVEINDYYTTAFKIRGLDHMPVGFYYFNEYMDDPSTIGNPVAMQKFYADTDIFLFWSYGNSFDIKGPTITELAIKAIKSIGGEVESFILQRRFKYFPHVSSQDMKNGFYEKLESELQGSRNTYYVGGLMAFELTERNSSYAMALMCKNFASSSDLPVFPYTKSLFPLQTEFQRKEPKQLAELPGVQFPNLPTLNGYLKHWGTHPVTEDRTLYSWINEQGTVIGKRTYREQHLNASCIASKLLKSQKPGDKVLLVYVPGLDFIDAFFGCLRAKVIPVPVIPPDPMQRSGQALLKIENIAKSCGIVAILSTVAYHSAVRAGLVKNFITLKNGKSSARWPSLPWLHTDTWVNNSRSYALENLYDDQRESQSGDICFLQFTSGSTGDAKGVMITHGGLIHNVKLMQSRYKSTSRTVLVSWLPQYHDMGLIGGLFTALVSGGTALLFSPMTFIKKPLLWIETMSKYQATHSAGPNFAFELVVRRLESSDKDKLQNLDLSSMIFLMVAAEPVRQKTLKRFLELTGPYGLSQKAMAPGYGLAENCVFVSCAFGEGNPIFVDWQGRVCCGYIHPGNADVDIRIVDPDGIEELQEDGKEGEIWISSPSAGIGYWGKEELSQSTFQNQLPNHPGRFYTRTGDLGRIIDGKLFITGRIKDLIIVAGRNIYSSDVEKTVESSSELLRPGCCAVIGVPEETLSAKGISLPDGSDQVGLVVIAELRDGKPVSKDVVDDIQTRVAEEHGVNVASVKLIKPRTISKTTSGKIRRFECLKQFADGTLNLVPQPVLTKKKLVRSFTTGTCKEGRTPRAQLANSTPITSPRIGNKEIMEFLKRLISEQAGIPVSKISVTDNMSTYGMDSISVVKATQKLSDFLGVTVAAIDVFSASCIQELVNFSENLLLKSQPHLLSNPSYAPEAETESTEFIVDVSKSHQWSIHLLQLLALVFISILVVSPAYLSITTFQIFIASFGKSAYGIPLSNYIFSLALAPLSWILCIASTCICISFFGNSFLRPNYALTPEMSIYSIAFVKWWALYKSQEISSKVLATHLKGTVFLNYWFEILGARIGSSVLIDTVDITDPSLVSIGDEAVISEGVLVQSHEVKNGILSLHPIRIGRNSSIGPYAVIQKGSIIKEGAEIQPLQKVEGGQHVLKTAKLNNVKENAVLLVTMTKTESDAIYHFLGIYLVAFVSSLAAAITYFMYTWFFQKPASIQSFSFVCICGAFHWIPFTITAYATMFSEVQSNPIAFAISFTCAYLLHGLILTSLTCSLTRLLKSQKQTHFKTWLQNQMILSCHLKFAKLLSGTEAFCVYLRLIGAKIGKHCSIRAINPVSNPELMLIGDGVHLGDFSRIITGFNYSDGYTCGKIEVQDNSVVGSQSLILPGSLVEKNVILGALSVAPMNSILHEGSVYIGSQTRVTMRNSGNASFDERIEEMDIDYKKIVANLAANLAVTTMNAKARYFHRIGVSGKGHLKIYNKLEGIPMHKIFHPGKSYPIIVRHSNSLSADDDARIDARGAALRIFSDEPATDSSDSPPPTLIDLTLKTGNAFYARTLADFASWLVCGLAAREELVKSAPHVREAVWNSLRHADSYAEMHYYSNYCRLMRFEDGQQMYVKFKLRPHDTSISEDKGKVNPTGILPPETGAIARDENDSRPLLFLANDFQNRVSSSNGVSYVFQIQVRPVPDDTQGREVALDCTKPWDENEFPFTDVGEINLNENIPMEDSQKLEFNPYLKSNELDTITATSSTQSASIDHGRSLIYEICQHVRNRQPLPEAWRNLVQQSNVKVDLSCCPIASSAPLPEKEPLLKKKATPALTLTRTWYQTFSALFIQPLLQTILPHMVIGLAAFVPLNMVVYFKDVKKLPLHWLLPFFWILSGFIAALSCVIAKRVLVGKRKLGETIPIWSKKIVFDSTWQAIRTLVGDYFMDITNGSFLSVIWMKMMGAEIEMDGVYVDSNGAMLNPEMVKIERGGCIGREALLFGHIYEGEEGGMVKYGEIKIGEDGFVGSRAVVMPGVEVECEASLASLSLAMKGEIIRSR

SEQ ID NO: 2248 - protein, 2339 aa, Medicago truncatula; identical to SEQ ID NO: 2247

SEQ ID NO: 2249 - protein, 690 aa, Micromonas sp
MITAHQADPTEDLRRERSQASFPSRELAALMAGGEAQLKLRERIADAVRADPVFSKKGKYFMERADLYRTTLEKYLALPRLATAIDPNDPITVGKIIRELIDEPGGLDLHLGMFIPTIQGQGDEEQRKHWLPMCTKLQIIGTYAQTELGHGTYIRGLETTATYDAEKEQFIIHSPTLTATKWWPGGMGKTSTHAVVMARLITHGRDRGPHAFVVQIRRNEDHQTMPGVTAGDIGPKMGYNAVDNGFLRFDHVRVPRRAMLMRYSKVDPDGTFHPPPVAKASYGTMVFVRSDIVMNAALYMKKAVTIAMRYNLVRRQSNPGGEKASGGVGQKGLELQVIDYQHSQRSLFPILARAFAFHCTSDFMRRMYFRYEKVSTRKGDFSALPELHATSSGLKAYCSWATKDAIELCRLCCGGHGFMMLAGFGTTFGNYAPNATYEGDNNVLCLQTARYLLKVARAVAKAAARGGDVRDAEEGAQGTSAYILEGGGGLEPGCQLGKSVGLRDTEAALGAFAHAARRQILAAASRAGTLGADAAMSRDMVAWIKAAKAHCAYVVLLNFVDAVAESKPRVSSATAAVMDRLVSLHALATMDDNMGDFLEDGHVSADQAAAIRAEVAVLLAELRPDAAALVDSFALDDYFLNSALGSHDGDVYRRLYDEVQSAPFNASHVPPGYADLLHSRLIKGAGRSRL

SEQ ID NO: 2250 - protein, 2393 aa, Brachypodium distachyon
MDPKKSLDDKFSKLHPSLPVDTKIGIVGAGPSGLSAAYALAKLGYCNVTVFEKCQTVSGMCESIDIEEEVGAEFEEMDSHKLALIDSQTGNIRDLEVAEDYVSMISLTLKLQDEANKSGRLGIHALSGLASDPTLEFLRQHGINSVPKSVAYSYTASGYGFVQDMPYAFIQEFTRTSMAGKIRRFKHGYMSMWEKLSQSLPFEVLCGTEVLRVKRNSCGASVTIKKNNGDEQVMEVDKIIFSGALAFKNGSTYRSSSLTDGESEVAELNDLERELFSKVQTIDYYTTVVKINGFEHIPKGFYYFGEFMEDPTTIGHPVAMQKFFDDTDIFLFWSYGNSADIKGSSVAKCVTDIVSSMGGTAQNVLLQRRFKYFPHVSSEDMKDGFYERFESQLQGFQNTYYVGGLLAFELTERNASYSIATVCKHFAVDVEQTVTPYIKRLFPLSRNSNPSPPRDLGELEGVEFPDLPSLDGYLEYWGTHRVTKNNVIYTWINEEGKIMNQRTYQELHENASHIAHKLLTSTKPIIKPGDRVILIHLPGLEFIDAFFGCIRAGVIPVPVIPPDPMQRGGQSLLKVENVSKVCNAVAILSTNSYHAAVRAGYIKNIVTLAKSQKCSAQWPDIPWIHTESWIKNYRRSPDSLNSDNVLSMRTKSQPSDLCFLQFTSGSTGDAKGVMITHGALIHNVKMMKRRYKSTSKTVLISWLPQYHDMGLIGGIFTALVSGGTSILFSPMTFIRNPLLWLQTISDYHGTHSAGPNFAFELVIRRLEAEKNKVYDLSSMIFLMIAAEPVRQKTCRRFIELTQPLGLSEGVLAPGYGMAENCVYICCAFGECKPVFIDWQGRVCCGYVEKDDADIDIRIVDADTLIEHQDDGIEGEIWISSPSSGVGYWGHQEMSHTTFYNQLKTNPSKRFTRTGDLGRIIDGKLFITGRIKDLIIVAGRNIYSADVEKTVENSSEVLRPGCCAVVGVPEDVLTQKGITIPDSSDQVGLVVIAEVREGKAVSTEIIDNIKTRVAEEHGVAVASVKLIKPRTISKTTSGKIRRFECMKQFVDNNLSLADGNHLSKKKSLFRSLTTGTGMDRRRRPFLKQTVESTFHPRPKSEVKNSKEITEFLTQLVSDQSGIPMDKISPTGSLPSYGFDSIAVVRAAQKLSDFLGIPVGAIDIFAASCISELASFLETLLNKSQPQLAPHPKSKGKSSKEIVEFLTQIVSDQSGIPKDKISPTGSLPSYGFDSIAVVRAAQKLSDFLGTPVGAIDIFAASCISELASFLENLLPKSQPLLASDLSCSSEDESLVVPIDITADFSVLATGILQSIALIYVCFMLLLPAYLASSTYMHMLYSVSLVKSSLMRYLTSLVMAPIAWIFYVILTSLSLSILGKSFLQPNYALTPNVSIWSVDFVKWWALNKAQGLAAKMLAVHLKGTVFLNYWFKMQGARIGSSVVIDTVDITDPSLLVVADGAVIAEGALIQGHEVRDGVLSFRRVRIGREASIGPYAVLQKGTTVDDGAVVPPLQKIEPGKLTYQTKRTSADMKEETRNAGILLEHLVSIYAVAFIGSLSSATVYMLYTHFFGNEDSFQHFSFACIAGAFHWLPAVIAAYPVIVQETPTRALTFALSITFAYLSYGVILSLLSSIANTALATRTETKQKLMRTSLIQRHINIAVHLRFAKMLSGTEAFCMYLRLLGAKIGRHCSIRSIDAVGNPELISIGDGVHLGDFCHIVPGFYSGKAFTGAEIKVQENTIVGSGSLLLPGSVLQENVILGALSVAPENSLLQRGGIYVGAQSLTMVKNTLLMEDERIEVMDPMYKKIVGNLSANLAITTMNVKSRYFHRIGVSGRGVLKMYQDIPSLPKHKIFGAGKSFPVIVRHSNSLSADDDARFDARGAAVRILSDDGEVPLLDLTLKSGKAFYARTIADFATWLVCGLPAREEHVKRVPHIRDAVWGSLRDTNSYTVLHYYSNICRLLRFEGGKEMYAKFKLRPMDQDISEESGQVVPRGILPPETGAIPRDESDTRPLLFLADDFHRRVESPDGVGYVVQLQLREVPSDSATCDVALDCTRPWDEAEFPYIDIGEIIIDSNVPADETEKLEFNPFLRCREVDVIPATSCKQSASIDHGRSLVYEICQRLRNGEPLPASWAAFLEQSDTKINLSGCPVAAATHTRSNAGEATKPKVTLARAWYKALWATLCQPLLQTLVPYFVLGLVIFLPFRGLLAFATATGTPLYWLLPIFWTVSGIAAMATCAAAKWVLVGVRADGDAVHIWAPQVFLDTVWQAIRTATGEYFAELTCGSVLFAAWMRMMGSTVAVAEGVYVDSMGALLNPEMVHLERGASVGRDALLFGHVYEGEAGKVKFGKVHVGEDGFVGSRAVAMPGVVVEDGGYLGALGLAMKEEVVRHKL

SEQ ID NO: 2251 - protein, 700 aa, Homo sapiens; identical to SEQ ID NO: 563

SEQ ID NO: 2252 - protein, 700 aa, Homo sapiens; identical to SEQ ID NO: 563

SEQ ID NO: 2253 - protein, 700 aa, Homo sapiens; identical to SEQ ID NO: 563

SEQ ID NO: 2254 - protein, 681 aa, Saccharomonospora viridis
MERATPLLRSYIGGGWRTAEDEGTPLRDAVTGDQVARISSKGIDRAAALDYGRRVGGPALRELTFHQRAALLKALASHLREHRDELYALSARTGATQGDSKFDVDGGIGVLFSYASKGRRELPNDTVYLDGAVEPLGKGGTFVGQHVCTPLRGVAVQINAFNFPVWGPLEKFAPAFLAGVPSLIKPASQTAYLTEKLVELMIDSGLLPDGSLQLLCGDAGDLLDHVTSQDLVSFTGSAATAQRLRAHPTIVRNAVRFNAEADSLNCSILGPDATPGTPEFDLYVSQLVTEMTVKAGQKCTAIRRAFVPAELLDDVAQAVSERLAKVTVGNPADPEVRMGALASLEQREEVRRSLKALQDAGRIVFGDPDHVDVVDADPQRGAFLSPVLLRADDPERAEPHEVEAFGPVSTLLPYTSVEQVVELAARGQGSLAGSVVTGDADFAREVVLGAAPWHGRLLVLDTDNARESTGHGSPLPMLVHGGPGRAGGGEEMGGIRGVLHHMQRTAVQASPAVLTAVGGRWVAGAPRSEGVHPFRKSLAELRIGDSVVAGPRTVTADDVAHFAEFTGDTFYAHTDQVAAEANPLFGGIVAHGYLVVSFAAGLFVSPEPGPVLANYGLENLRFLTPVKPGDELTVTLTAKQITPRENADYGEVRWDTDVTNQRGESVAKYDVLTLVAKENPR

SEQ ID NO: 2255 - protein, 748 aa, Saccharomyces cerevisiae
MTRRTTINPDSVVLNPQKFIQKERADSKIKVDQVNTFLESSPERRTLTHALIDQIVNDPILKTDTDYYDATKLQEREITAKKIARLASYMEHDIKTVRKHFRDTDLMKELQANDPDKASPLTNKDLFIFDKRLSLVANIDPQLGTRVGVHLGLFGNCIKGNGTDEQIRYWLQERGATLMKGIYGCFAMTELGHGSNVAQLQTRAVYDKQNDTFIIDTPDLTATKWWIGGAAHSATHAAVYARLIVEGKDYGVKTFVVPLRDPSTFQLLAGVSIGDIGAKMGRDGIDNGWIQFRNVVIPREFMLSRFTKVVRSPDGSVTVKTEPQLDQISGYSALLSGRVNMVMDSFRFGSKFATIAVRYAVGRQQFAPRKGLSETQLIDYPLHQYRVLPQLCVPYLVSPVAFKLMDNYYSTLDELYNASSSADKAALVTVSKKLKNLFIDSASLKATNTWLIATLIDELRQTCGGHGYSQYNGFGKGYDDWVVQCTWEGDNNVLSLTSAKSILKKFIDSATKGRFDNTLDVDSFSYLKPQYIGSVVSGEIKSSLKELGDYTEIWSITLIKLLAHIGTLVEKSRSIDSVSKLLVLVSKFHALRCMLKTYYDKLNSRDSHISDEITKESMWNVYKLFSLYFIDKHSGEFQQFKIFTPDQISKVVQPQLLTLLPIVRKDCIGLTDSFELPDAMLNSPIGYFDGDIYHNYFNEVCRNNPVEADGAGKPSYHALLSSMLGRGFEFDQKLGGAANAEILSKINK

SEQ ID NO: 2256 - protein, 442 aa, Corynebacterium resistens; identical to SEQ ID NO: 2196

SEQ ID NO: 2257 - protein, 706 aa, Micrococcus luteus
MTVTAPSLPEILPSYVAGSWWTPSHPSKVTDVTDANTGARLTGVSTDGLDTAAAIEHARTVGQQALGELTIHERALKLKELALYLNSRVQELYDVSFATGATQRDHAFDVDGGIGTLFTFSGKGRRELPNSNVIIDGDVEPLSRDGSFIGEHIYQRIPGVAVQINAFNFPVWGMLEKFAPAFVAGVPTVVKPATPTGYVTQKCVELMLESGVLPEGSIQLISGSARDLLDHLDYRDHVAFTGSAATAATLKKHPNVQEGGVRFTAETDSLNAAILGPDADPESPEFEAFVKVVFQEMTVKAGQKCTAIRRVIVPQDRVEAVTAALTERLAAKVVLGDPRVEGTTMGALASKEQQGEVRGAVQRLVDAGGQVRLGGPEGSTGDADAESGAFFAPTVLTFEDARTPEVHSVEAFGPVTSVIGYTDVADAVALATLGSGSLVATVATNDGEIARAFAAGIGAHHGRVHVLNRQTAATTTGHGAPVPVLIHGGPGRAGGGEELGGVRAVKHYMQRTAIQGSPDMLTAITGVWHQGAAAHTVTREDVEAGTAVHPFYKSLAELTVGDQFASGLRTVTLEDITAFAEETGDRFYAHTDEEAAMANPFFPRRVAHGYLLVSWAAGLFVAPDPGPVLANYGLENLRFITPVTYDDAIRVTLTAKRITPRVSDEYGEVVWDCRIHNQKDELCAQYDVLTLVAKTWPMASSETSQG

SEQ ID NO: 2258 - protein, 679 aa, Rhodococcus opacus
MSKLLESYAAGRWYTAPDEGTPLLSAVDGSEVARISATGLDLGEMVTHAREVGGPALAKLTFHERAAALKALALALMAGKDEFYALSTSTGATKRDSGVDIDGGFGTLLSYASKARRELPNDTVYLDGAVEQLGKKGTFLGQHVYTSRRGVAVQINAFNFPVWGFLEKLAPAFIAGVPSIVKPASQSAYLTELVFRRIIESGLLPEGSVQLLSGSARGLLDHLGGQDSVAFTGSADTAATLRAHPNVVGEGVHFNAEADSLNASILGADVEPGSEEFDLYVKQLVTEMTVKAGQKCTAIRRAFVPTALMDDVIAAVETRLSRVVVGAPDAEGVTMGALASLEQRDEVLKSLRGLTKSAQIVVGDPDNFEVVGADKAKGAFLPPILLRSDDKDATEPHDIEAFGPVSTVIGYDGTDEVIALAARGKGSLVASLVTRDAALARDIVLGLAPFHGRVLVLNRDDAKESTGHGSPLPVLVHGGPGRAGGGEELGGIRGILHHMQRTAVQATPDILTAVGNKWVSGSQRHDDGVHPFRKNLAQLRIGDTIVGGPRQVTLKDIDHFAEFTGDTFYAHTDPEAAAANPLFGGIVAHGYLVVSLAAGLFVHPAPGPVLANFGVDSLRFLTPVKADDSLTVTLTAKLITPRSSADYGEVRWDAVVVNQDGDPVATYDVLTLVAKGDNA

SEQ ID NO: 2259 - protein, 680 aa, Rhodococcus erythropolis
MSRLLESYVAGRWYAAPDAGTPLPSAVDGSEVARISATGVDLAEMVTYAREVGGPALSAMTFHERAGALKALALTLMAGKAEFYTLSTATGATTRDSGVDIDGGFGTLLSYASKARRELPDSTVFLDGNVEALGKGGTFLGQHIYTSRRGVAVQINAFNFPVWGFLEKLAPAFIAGVPSIVKPASSTAYLTELVFRRIIESGLLPEGSVQLLSGSARGLLDHLGGQDSVAFTGSADTAATLRAHPNVVGKGVHFNAEADSLNASILGEDAVPGTPEFDLYVKQLVTEMTVKAGQKCTAIRRALVPVSLVDAVVDAASKRLNKVVVGHPDADGVTMGALASIEQRDEVLKSIRGLTKSATIVFGDPDNVDVIGADGQSGAFLSPVLLRAEENAHEVHELEAFGPVSTVIGYDGIDHAIELAARGEGSLVASVVTADTDIARRLVLGLAAFHGRVLVLNRDDAKESTGHGSPLPVLVHGGPGRAGGGEELGGIRGVLHHMQRTAVQGTPDVLTAVGERWFTGSARTTGSEHPFRKSLAELKIGDTVVGGPRQVTLADIDHFAEFTGDTFYAHTDPVAAAANPLFGGIVAHGYLVVSLAAGLFVDPAPGPVLANFGVDSLRFLTPVKAEDSLTVTLTAKTITPRSSADYGEVRWDAVVTNQDNDPVATYDVLTLVAKTRPEGN

SEQ ID NO: 2260 - protein, 684 aa, Gemmatimonas aurantiaca
MLTVQNYALGEWVTGTGPRTDLIDAVTGEKIGDASSHGLDFKAMLNYARTVGGPKLRDLTFHERSLRLKRIAQALMARKEEFYPLSFMTGATRTDSWVDIEGGIGTFFAYASRGRREFTNERFHVEGPTEPLSKGGTFVGRHILVPLEGAGVHINAFNFPVWGMLEKLAPALVAGVPCIVKPSTTGSHLTEAVFRAIIETGELPAGALQLICGDARDLLDHVEEQDVVAFTGSANTGHKLRQGKAIVANSTRFNMEADSLNCTILGPDATPGTEEFDLFVKEVVREMTTKAGQKCTAIRRTIVPSGLEEEVIKAISKRLATTTIGSPTAEGVRMGPLASASQVRSVGESAARIRAAAERVYGNDDFAVVGADREKGAFYSPELLYCADPLNRLEPHDIEAFGPVNTIMPYKTLDEAVQLARMGRGSLVGSLVTHDPKVAQKVVLGVAPYHGRVLVLDRTSAKESTGHGSPLPNLVHGGPGRAGGGEEMGGARGVTHYLQRVALQGSPSMLTAITREWTKGAEEVKDTVHPFRKTFDQLQVGDTIITKSREITLADVEKFAALSGDTFYAHMNDEHARSNGVFEGRVAHGYFIVSAAAGLFVDPDLGPVLANYGLEKLRFTKPVYPGDTIHVRLTVKQKTAKDVPEGTIPQGVVEWDVEVFNQENEAVAVYSILTLVARGDAKAA

SEQ ID NO: 2261 - protein, 403 aa, Streptomyces avermitilis
MTALLPEKTSVDERLAADFYDIESLLPPHERELLTHARAFMRTEVKPLVNEYWAKGEFPRELIGKFRDLGLAGVPYEGYGDPLPAGSNLLVGMLSMEYTRTDASSATFFGVHSGLAMYSIYRGGDQEQRDRWLPSMAALDTIGAFAMTEPLGGSDVAGGMRTTARRDGENWVLNGAKRWIGNATFADLVVVWARDEADGKVKGFVVEKGTPGFSPVKIENKIAFRIVENAEITLTDVKVPEANRLQRIDSFRDVAEILRATRSGVAWQALGVMLGAYELALGYAKERKQFGRPIARFQMVQDLLVKSLGNITACWGMLVQLARLQDAGVFRDEHSSLAKAFVTSRMREVVAWCREIFGGNGIVLDYDIARFFADAEAIYSFEGTREMNTLIVGKAVTGESAFV

SEQ ID NO: 2262 - protein, 413 aa, Streptomyces avermitilis
MRETAVSGTTTLPAPSGPYLDKGLLPADFFAYEELLSDGEREQLESVREFLRTQVAPIVDDYWARAEFPFQLVEGFGRLGLMDWADPDSPESRPSNLLAGFLALELAHVDASVATFAGVHTGLAMGTILTCGSDEQKRRWLPAMSRFEKIGAFGLTEPHGGSDVAGGLQTTARRDGDTWILDGAKRWIGNATFADLVVIWARDVETRHVLGFVVEKDTPGFTATKIENKMALRIVQNADIVLDGCRVPEANRLQNAHSFKDTAKILRQTRSGVAWQAVGVMFAAYEIALQYTKEREQFGRPIGGFQLVQDLLVKMLGNATASCGMMTRLAQLQDAGVFRDEQSALAKAYCTVRMRENVGWARELLAGNGILLDYKVGRFVADAEAIYSYEGTREIQTLIVGRAVTGGLSAFVR

SEQ ID NO: 2263 - protein, 402 aa, Corynebacterium aurimucosum; identical to SEQ ID NO: 2203

SEQ ID NO: 2264 - protein, 453 aa, Pedobacter sp.
MSNIFSSIKNAYALFKTIDFQKLEALSKKVDLPKMMDTVSNLDETQLQGMMKMMGSTKKKKELPPIEGDFYHLGDEALKDEDRALQLKVRAFLEKEVKPVVNKYWLKAEFPFELIPRIAELDICGLTYKGYGCPNKSNLMEGILAMELARVDTSMSTFFGVQSGLAMGSIYLLGSEAQKQQWLPGMQKMTTIGAFGLTEPEVGSGAAGGLTTTAKRQGSKWILNGQKKWIGNAPFSDVTIIWARDLDDQQVKGFLVRKGTKGFEVEKMMDKMALRIVQNGLITLTNCEVDEEDRLQNANSFKDTAKVLQMTRAGVAWQAVGCARGAYESALQYTRTRKQFGRPIASFQLIQNHLVEMLSNLTAMQTLCFRLSQLQDQNMLTDEHASLAKVFCSMKTRDVVSRAREVMGGNGILLEYDVARFVADAEAIYSYEGTKEINTLIVGRAITGFSAFV

SEQ ID NO: 2265 - protein, 692 aa, Danio rerio; identical to SEQ ID NO: 495

SEQ ID NO: 2266 - protein, 692 aa, Danio rerio; identical to SEQ ID NO: 495

SEQ ID NO: 2267 - protein, 692 aa, Danio rerio; identical to SEQ ID NO: 495

SEQ ID NO: 2268 - protein, 679 aa, Schizophyllum commune
MSMLKALDAAAQTALDMTAARNATAVDIPSLRDYLHGGADNWQRREEIVRVLSADPAFSKAGRDNMSRSQLFMRGQAMTRRLHELQNELGWSDDDLRRSLSILDETLPLTLHFQAFEPVFNLQAGPELAAEYGPLIATRGILGCYLQTELAHGTAVSALETTATYDPVTREFELHSPSLTAAKWWIGAAGRTATHGVVQAQLVLSGGKRMGPHLFFVQLRSLEDHRPMRGVVLGDQAGPKAMGGFAATDNGFVRFEHVRIPLKNMLSRFAQVTEAGEYVRPPHDKLAYGGMLYIRSGMVTGAGMMTAKAITIAIRYATVRRQGTPGSDGLEPQVISYPAVNGRLLPILARAYVFLRLGKSLSSLFADTAARLASGDTSLLAELHATTAGLKVFATTTSIADIETARRSAGGHGFSAASGMGRLYAEWVPSATYEGDNYVLDQQVVRAALKAYRALKPGAKGLPPSSAYLQRLSDGASPPSGFVISSLDGLTSEPSPLVVLLEWRAALVVRELHSAGEVTGMEAARAARAVTDAFVAARVADMAREVEKDGVRKEDAVVVRTLFALYLLASAEAALPDLLVYGLLRGTQEVAALRRAVATTCAALVPHAIGLTDAFGFSNWELDSALGVYDGRVYEALWDRAQREPLNEKEVTDAYGESIKWVLQNGQRRAAEAQRNAKL

SEQ ID NO: 2269 - protein, 674 aa, Vitis vinifera
MSMAMARASSGLAYPDRFYAAASYAGFDGSPNSSSKGVSSKFSNDVALLLYALYQQATVGRCTIPKPRGWNPIEQSKWTSWHGLGNMAAAEAMRLFVKILEEEDPGWYSRASDFVAEPVVDVEMNHHPKVEPVTENGNSFPETKTISHENGSMLETQDKDVVLEGLGSIAVYDQWIAPSVSGQRPKPRYEHGAAVVQDKMYIFGGNHNGRYLNDLQVLDLRSWTWSKVEVKAGTESLESPSTVPLPSCAGHSLIQWENKLLSIAGHTKDPSETIQVKAFDLQTCTWSTLKTYGKAPASRGGQSVTLVGTSLVIFGGQDAKRSLLNDLHLLDLETMTWDEIDAVGVPPSPRSDHAAAVHAERYLLIFGGGSHATCFNDLHVLDLQAMEWSRPTQQGDIPTPRAGHAGVPVGENWFIVGGGDNKSGVSETVVLNMSTLVWSVVTTVQGRVPLASEGLSLVVGSYNGEDVLISFGGYNGRYSNEVNVLKPSHKSSLQTKIMEPVPESVSAVHNATNATRDVESEFEAGQEGKIREIVMDNIDSEPMIKNEETGEGLIATLKSEKEELESSLNKEKTQSLQLKQELAEAETRNSDLYKELQSVRGQLAAEQSRCFKLEVDVAELRQKLQTMETLQKELELLQRQKAASEQALNAKQRQSSGGMWGWLAGTPNEKADDA

SEQ ID NO: 2270 - protein, 454 aa, Leeuwenhoekiella blandensis
MSLFGKVKNTIGLLKSVDLEALNKLSQKVDLSKVMSAVGNLDDRQLQGLMKMLNSQAKKGQHKLPPIDGDFYNLAQKLTPEEREIQMKMRNFMEDEVKPIANDFWNRAEFPHEIIPKFAELNLAGIAYKGYGCPGQSFLLEGILAMELARVDVSISTFFGVHSGLAMGSIYLCGSEEQKQEWLPKMQKFEKIGAFGLTEPEVGSGAAGGLGTSCKKVGDEWILNGEKKWIGNATFSDITIIWARDEDSGSVKGFIVRKENPGFHAEKMKDKMALRTVQNALITLTDCRVPESDRLQNANSFKDTAKVLQMTRASVAWQAVGCARGAYEAALKYTKKREQFGRPIASFQLIQNHLVEMISNLTAMQTLCFRLSEMQDGGQLTDEHASLAKVFCSMRTRDVVSRAREVMGGNGILLEYDVARFVADAEAIYSYEGTKEINSLIVGRAITGYSAFVS

SEQ ID NO: 2271 - protein, 408 aa, Micrococcus luteus; identical to SEQ ID NO: 1944

SEQ ID NO: 2272 - protein, 402 aa, Micrococcus luteus; identical to SEQ ID NO: 1946

SEQ ID NO: 2273 - protein, 406 aa, Carnobacterium sp.
MMNTKTMERPVDLATFYPSDLYEYSSALTDGELTVLKELREALEINLRPVLSEYWEKAEFPFEAFEKIGKVRMMDNPLLFEGRENTRKPSELYNVFRYFELAKLDASIATFYTVHGGLFYATLLQGGNEEQIERWADKTASYEIQGCFALTEPEHGSDIAGGLATTARKEGDTWIINGEKRWIGGAGSADEMAVFARDEADGKVKAFMVPGKAEGVHVQKIEGKISLRMTQNGHITFTDVKVGEDRRLQNVNSFKDVAGILRITRADISHLATGLTAGAFEAALRYVKQREQFGKNLGSFQLVQEKLSIMQANVTANLSFSVRLAQMQEEGNYREVNSSMAKMHNALRMRETVALAREVVGGNGITLETDVARFFADAEAIYSYEGTHEINALIVGRYLTGVGAFV

SEQ ID NO: 2274 - protein, 401 aa, Carnobacterium sp.
MENREQVLKEMYPEDILKFSEKLTDGEIEVLQRVRKAVNEHLKPVINDYWKRGEFPTEEFKHVAKTGLISDPVLFENQPNRFTWGNTYFLFLAYDLYKFDASIATFFGVHAGLGYFSFLLGGSPEQQMRWLPKLQNFELQTCFALTEPEHGSDTAAGLATTARREGDKWIINGEKRWIGGASSADLIPVYARDLEDNKVKCFIVEKGQKGLSVDDIDDKIALRIVQNGNIHLDNVEVLESNRLQNINGFKDVAKILYATRAGVAYAGAGMMAGSLAAALEYTTTRVQFGKPIASFQLVQEKLARMQGNAVTALALSARIAELQERGEYSEINASLAKMNNSLRLRETAALGREVCGGNGITLERNVARFFCDAEAIYSYEGTHEMNSLIMGRKLTGISAFV

SEQ ID NO: 2275 - protein, 698 aa, Corynebacterium glutamicum
MSNHVDIVPSYLQGQWVRPENPSRIVDVADASTGETVARVSSEGLDIQGALDYARTEGQKNLKALTFHERALKIKELALYLNEHKDVLYQLAMCSGANKRDNFVDIDGGISTMFTFSSKGRRELPNTNVIVDGPPEVFAKDSSFQGQHIYTTLTGVAVQINAFNFPVWGMLEKFAPSFIAGMPTIVKPATPTGYITAEAVRLMVESGILPEGSLQLISGSVGDLLDHLDYNDHVAFTGSAKTADTLRNLPKVRENGVRFSAEADSLNAAILGPDASVDTPEFEAYTKMLFAEMTSKSGQKCTAIRRAIVPSGLIEDVAQALKQRLDDKVTVGDPRDASATMGPLVSVEQAEDVEGAVEKLIAAGGQVVTGGTVEGAFFAPTILTFADAYAERIHDTEAFGPVVSLIGYGDIDEAIELAALGKGSLVASVATHDPATTARVAAGIAAHHGRLHFIDREDAKTSTGHGSPLPHLIHGGPGRAGGGEELGGVRGIKHYMQRTAIQGSPNHLTAITGEWHTGATTNRVTRAEVEAGTAEHPFRKDLATLKIGDQFASELREVTMGEIQAFAEETGDTFYAHVNEEAAMRNPFFPRRVAHGYLLVSWAAGLFVEPAPGPVLANYGLENLRFIQPVTYGDSIRVELTAKRITPRVTDEYGEVAWDTVLYNQDDEIVAAYDVLTLVEKVNTTYANDQKAEELAGV

SEQ ID NO: 2276 - protein, 719 aa, Komagataella pastoris; identical to SEQ ID NO: 58

SEQ ID NO: 2277 - protein, 719 aa, Komagataella pastoris; identical to SEQ ID NO: 58

SEQ ID NO: 2278 - protein, 719 aa, Komagataella pastoris; identical to SEQ ID NO: 58

SEQ ID NO: 2279 - protein, 625 aa, Volvox carteri
MTTQQCPLAYPDKFHAAAKFWKLRLAGAKTLSQENQLLLYALNQQATVGPNTTARPWGWNVVESTKWQGWKELGNMTTMEAMRLFVRTLDDEQPDWWVLLEQNEAKADSEGPVAAAAAPAPTRTVAQRALLGLWTHLEAATEAGKRPMPRYESAAAVLGGNMYVLGGNYGGRYLSDLWALDLAAGTWSPLQLQPAAGTGADPAAAAAAFPPTAGHTVTVWNGKLYVLGGHTKAKGDAAMVLRVLDPAASTVAEPVTSGQAPSARGGHTATLLGNKLWVIGGEDSARRALSDVHVLDLDTLSWSTPEISGKAPLGRSASCATAHQDRYIVIFGGGSVATCFSDLHMLDTHELTWTQLAQAGAKVTPRAGHAGAVLGGIWYIVGGGNNVKGCTDLLAADLSGLPASGTVTWHVVTSVALRDPLSSEGISLVVLPSDRVLVAFGGYNGKYQNTVNLFRAPEGSAALLAGTLAAAAEAVEEAKAKLANGGAPDGSAAAELRLQVSELRAQLEGARSEAETAIRESAAAKESAAHELALLRKQLTAAQASLAESNKALEDTRSNLSAEQSKVLKLEAQVAELQAKLGQLGELEREMEKYRRAAREAAEKEAASKKGGGFWGYIAGSSGSS

SEQ ID NO: 2280 - protein, 679 aa, Schizophyllum commune; identical to SEQ ID NO: 2268

SEQ ID NO: 2281 - protein, 736 aa, Kluyveromyces lactis; identical to SEQ ID NO: 63

SEQ ID NO: 2282 - protein, 625 aa, Volvox carteri; identical to SEQ ID NO: 2279

SEQ ID NO: 2283 - protein, 724 aa, Candida tropicalis; identical to SEQ ID NO: 374

SEQ ID NO: 2284 - protein, 706 aa, Debaryomyces hansenii; identical to SEQ ID NO: 61

SEQ ID NO: 2285 - protein, 706 aa, Debaryomyces hansenii; identical to SEQ ID NO: 2220

SEQ ID NO: 2286 - protein, 748 aa, Saccharomyces cerevisiae; identical to SEQ ID NO: 976

SEQ ID NO: 2287 - protein, 700 aa, Ailuropoda melanoleuca; identical to SEQ ID NO: 631

SEQ ID NO: 2288 - protein, 751 aa, Zygosaccharomyces rouxii
MTKSSTVNQECAAFKPQKLIQSERSNSRVDVDQINAFLESSPERRDQAQALIQEIVKDPILKTDSSMYDRSKREERAVTARKIARLALYMEHDIKTARKHFKGNDLIEDLQRDTESKLPALSNKDLSIFDRRLSLLHNIDPQLGTRVGVHLGLFGNCIKGNGTNEQIHYWLQERGSSFMKGIYGCFGMTELGHGSNVARLQTKATYNPDSDTFTLLTPNLPATKFWIGGAANSATHCSVYARLIVEGKDYGVKTFVVPLRNPETFQLLPGIAIGDIGHKMGRNGIDNGWIQFHNVVIPREYMLSRFTQVIPSKAPNGKATVKTQPQLDQISGYSALLSGRVNMVMDSFRFGSKFAIIGARYAVGRQQFAKPKQPETQLIDYPLHQYRVLPQIAVPYLVSPVAFKLMDQYYSILDELYKVSSPATFDKTGLAIVSKKLKNLFIDSASLKATNTWLVAELIDQLRQSCGGQGYSSYNAFGKGYDDWVVQCTWEGDNNILSLSSAKSILKKFAASRRGVFDRSLDSGSFDYLEPSFVRAVLTGQETASLRQLQDYTKVWAIALVKFLDHIARLIDVTKDLDSVAKLLVLVSKFHSLHSMLQAYYEKLKNPQDSHVTDAASEAALWDIYKLFSLYFIDKHSGEFQQFKVFTPDQISQTVQPKLLELLQKVRKSIIPLTDAFKLPDDMINAPIGYFDGDIYHNYFSEIIKQNPAEADGAGVPPNADLFTRLLARGSEFDHALGGSPRSEIIERLGK

SEQ ID NO: 2289 - protein, 700 aa, Homo sapiens; identical to SEQ ID NO: 563

SEQ ID NO: 2290 - protein, 719 aa, Komagataella pastoris; identical to SEQ ID NO: 58

SEQ ID NO: 2291 - protein, 692 aa, Danio rerio; identical to SEQ ID NO: 495

SEQ ID NO: 2292 - protein, 700 aa, Homo sapiens; identical to SEQ ID NO: 563

SEQ ID NO: 2293 - protein, 719 aa, Komagataella pastoris; identical to SEQ ID NO: 58

SEQ ID NO: 2294 - protein, 692 aa, Danio rerio; identical to SEQ ID NO: 495

SEQ ID NO: 2295 - protein, 700 aa, Homo sapiens; identical to SEQ ID NO: 563

SEQ ID NO: 2296 - protein, 719 aa, Komagataella pastoris; identical to SEQ ID NO: 58

SEQ ID NO: 2297 - protein, 692 aa, Danio rerio; identical to SEQ ID NO: 495

SEQ ID NO: 2298 - protein, 748 aa, Saccharomyces cerevisiae; identical to SEQ ID NO: 976

SEQ ID NO: 2299 - protein, 690 aa, Micromonas sp.; identical to SEQ ID NO: 2249

SEQ ID NO: 2300 - protein, 657 aa, Trichoplax adhaerens
MASPSSDLDRERRKCTFNVAELTDIVNGGRKKTERRRYLESLVMKEPIFSNEDYYFLSREEKYSDAVKKAVKLVEVLKEHNIENPQEYQILLGVINENLPIALHNSMFKPTIRDQGTDEQRKKWLPLANDYKIIGTYAQTEMGHGTFIRGLETTSTYDPKREEFVLNTPTLTATKWWPGCLGKTSTHAVVMAQLYIKNQCYGLHSFIIQLRSLKDHSPMPGVTVGDIGNKVGYDTNDNGFLAMDNVRIPRENMLMRHAQVYPDGTYRKPANPRLAYGAMVLVRATIVAGSATNLSKAATIAIRYSCVRRQTEAKPGELEPQIIDYVTQQHKLVPQLATAYAFAWIARYMMSTYHALHADIESGHLGALQELHGISSGLKAFTAEMSVSGIEVCRRACGGHGFSAASGLVSIYKDWLPSCTYEGENTVLYLQTARFLLKCFRQPSVTPSSMSYILIKPLPGARWGVKSPEDLMKPILLVEAFEHRAQRTIKSAAQFLESQISQGLDTSEAMNRSGIEFVRCAKAHCYYFVTRNFFQSTALLKCSKEIKESLLTLGVVFALNGIADNSGEFLEDGFVTGTQMEFVRERIQYCYKQLRPNLVGLVDAFAFADQSLNSALGAYDGDVYNRLYNWAKRAPLNKTDVHSSYHKYLKPILKSKI

SEQ ID NO: 2301 - protein, 657 aa, Trichoplax adhaerens
MASPSSDLDRERRKCTFIVAELTDIINGGREKTERRRYLESIILNDPIFGNKDSHFLSREEKYSNGVMKSKRLSEVLKEHNIENPQDYKIMLNVIGESLPIGLHNSMFRPTIRDQGTDEQRKKWLPLANDYKIIGTYAQTELGHGTFIRGLETTSTYDPKREEFVLNTPTLTATKWWPGCLGKTSTHAVVMAQLYIKNQCYGLHSFIVQLRSLKDHSPMPGVTVGDIGNKVGLETNDNGFLAMDNVRIPRENMLMRHAQVYPDGTYRKPANPRLAYGAMVLVRATIVAGSATNLSKAATIAIRYSCVRRQTEAKPGELEPQIIDYVTQQHKLVPQLATAYAFAWIARYMMSTYHALHADIESGHLGALQELHGISSGLKAFTAEMSVSGIEVCRRACGGHGFSAASGLVSIYKDWLPSCTYEGENTVLYLQTARFLLKCFRQPSITPSSMSYILIKPLPGARWGVKSPEDLMKPILLVEAFEHRAQRTIKSAAQFLESQISQGLDTSEAMNRSGIEFVRCAKAHCYYFVTRNFFQSTAQLKCSKEIKESLLTLGVVFALNGIADNSGEFLEDCFVTGTQMEFVRERIQYCYKQLRPNLVGLVDAFAFADQSLNSALGAYDGDVYNRLYNWAKRAPLNKTDVHSSYHKYLRSILKSKI

SEQ ID NO: 2302 - protein, 658 aa, Trichoplax adhaerens
MASPSSDLDRERRKCTFNVAELTDIINGGREKTERRQYLESLVLNEPIFNYDDYYFLSREEKYSDAVKKTVRLVQVLKQHNIEDPEDYQTLLKYVLNLNLPIALHNSMFRPTIRDQGTDEQRKKWLPLANDYKIIGTYAQTELGHGTFIRGLETTSTYDPKREEFVLNTPTLTATKWWPGCLGKTSTHAVVMAQLYIKNQCYGIHSFIIQLRSLKDHSPMPGVTVGDIGNKVGLETNDNGFLAMDNVRIPRENMLMRHAQVYPDGTYRKPANSKLVYGTMVLLRATVVSESATNLSKAATIAIRYSCVRRQTEAKPGELEPQIIDYVTQQHKLVPQLATAYAFAWIARYMMSTYHALHADIESGHLGALQELHGISSGLKAFTAEMSVSGIEVCRRACGGHGFSAASGLVSMYKDRLPSCTYEGENTVLYLQTARFLLKCFRQPSITPSSMSYIQVKPLPGARWGVKSPEDLMKPILLVEAFEHRAQRTIKSAAQFLESQISQGLDTSEAMNRSGIEFVRCAKAHCYYFVTRNFFQSTALLKCSKEIKESLLTLGVVFALNGIADNSGEFLEDCFITGTQMEFVRERILYCYKQLRPNLVGLVDAFAFADQSLNSALGAYDGDVYNRLYNWAKRAPLNKTDVHSSYHKYLKPILKSKI

SEQ ID NO: 2303 - protein, 698 aa, Trichoplax adhaerens; identical to SEQ ID NO: 2205

SEQ ID NO: 2304 - protein, 665 aa, Chlamydomonas reinhardtii
LAMERRKATFNVEELSYVLNGGKEQLEKKMRFAEMLSKTSWGDKSRRYFLNREEEYVGALKAALGIWCKMKSERLSLSDGALMRTLVDFPGGLELHIGMFIPSILSQGSAEQQAKWMPLCMGLKIIGTYAQTELGHGTFVRGLETTATYDKQTQEFVVHSPTLTATKWWPGGLGKTSTHAIVMARLMLPDGAGGVRDHGPHGFVVQIRDMDTHLPLPGVSIGDIGPKFGFGGVDNGFMSFDHLRIPRDAMLMRFSKVTPEGVYVPPPPSNSKASYATMVFVRADIVKNSGSVLARAVTIATRYAAVRRQTAPGPGQRELQVLDYQNCAATLLPLLAAAYALTFMGEDMMGMYRKFEADRDAGRFEGLPELHALSSGLKALCTWIAADGIEECRRTCGGHGYSRLSGLPTLFASYVQNVTWEGDNNVLCLQTARFLIKALAGVKAGRRVEGSAAYLNDAATELAPGRRCAAAGEACWLRPEVAAAALRHAAARSCATAAETLAAASGGRLVFEGAPWNSNTVDSIRAAKAHCALVLHGTFLASVARLEAGAGAININTSTAAALAALFALEGGRGGFLAGTMTAAQAGALRRAHRGLLAALRPNAVALVDAFAFPDYLLHSALGRQDGDVYRGLLDMARGSPLNDTEEGPAWLEVLRPVLAARSRM

SEQ ID NO: 2305 - protein, 665 aa, Chlamydomonas reinhardtii; identical to SEQ ID NO: 2304

SEQ ID NO: 2306 - protein, 403 aa, Streptomyces avermitilis; identical to SEQ ID NO: 2261

SEQ ID NO: 2307 - protein, 413 aa, Streptomyces avermitilis; identical to SEQ ID NO: 2262

SEQ ID NO: 2308 - protein, 700 aa, Unknown; identical to SEQ ID NO: 563
  Description of Unknown: Acyl-CoA polypeptide

SEQ ID NO: 2309 - protein, 669 aa, Oryza sativa; identical to SEQ ID NO: 987

SEQ ID NO: 2310 - protein, 438 aa, Pongo abelii
MALRGVSVRLLSRGPGLHVLRTWVSSAAQTEKGGRTQGQLAKSSRPQFDWQDPLVLEEQLTTDEILIRDTFRTYCQEKLMPRILLANRNEVFHREIISEMGELGVLGPTIKGYGCAGVSSVAYGLLARELERVDSGYRSAMSVQSSLVMHPIYAYGSEEQRQKYLPRLAKGELLGCFGLTEPNSGSDPSSMETRARYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYTLDRMQFGVPLARNQLILKKLADMLTEITLGLHACLQLGRLKDQDKAAPEMVSLLKRNNCGKALDIARQARDMLGGNGISDEYHVIRHAMNLEAVNTYEGTHDMHALILGRAITGIQAFTASK

SEQ ID NO: 2311 - protein, 657 aa, Trichoplax adhaerens; identical to SEQ ID NO: 2300

SEQ ID NO: 2312 - protein, 657 aa, Trichoplax adhaerens; identical to SEQ ID NO: 2301

SEQ ID NO: 2313 - protein, 658 aa, Trichoplax adhaerens; identical to SEQ ID NO: 2302

SEQ ID NO: 2314 - protein, 681 aa, Homo sapiens; identical to SEQ ID NO: 342

SEQ ID NO: 2315 - protein, 428 aa, Oryza sativa
MAGKQGDGREEDGAKVGLPALDISLAFPQATPASIFPPSASDYYQIDDLLTTEEQSIRKNVRAIMEKEIAPIMATYWEKAEFPFHAIPKLSSLGVAGGTIKGYGCPGLSITASAITMAEIARVDASCSTFILVHSSLAMVTIALCGSEVQKQKYLPSLAQLTAVGCWALTEPNHGSDASSLITTATKVPGGWHIDGQKRWIGNSTFADVLVVLARNANTKQLNGFIVRKGAPGLKATKIENKIGLRMVQNGDIVFNKVFVPEEDRLPGVNSFQDISKVLAISRVMVAWQPIGISMGVFDVCHRKQFGVPLVAFQLNQEKLVRMLGNIQAMLLVGWRLCKLYESGKMTPGHASLGKGWTSRMAREVVSLGRELLGGNGILADFLVAKAFCDLEPIYSYEGTYDINSLVTGREITGIASFKPAALAKARL

SEQ ID NO: 2316 - protein, 401 aa, Carnobacterium sp.; identical to SEQ ID NO: 2274

SEQ ID NO: 2317 - protein, 406 aa, Carnobacterium sp.; identical to SEQ ID NO: 2273

SEQ ID NO: 2318 - protein, 453 aa, Pedobacter sp.; identical to SEQ ID NO: 2264

SEQ ID NO: 2319 - protein, 454 aa, Leeuwenhoekiella blandensis; identical to SEQ ID NO: 2270

SEQ ID NO: 2320 - protein, 693 aa, Drosophila melanogaster
MGSEDTSFIPDLPSGGPLAVYRKRANFDWKRLRLIFEKEQGLRIKYKVWRRLENDPLFAHPSRTLPMDEQKRLCAMQVNRMKHLDLVPKEIESLSFSAKTKYLMYINEALACYSPSLSVKIALGVGLFNNAIRAMGTEKHQKYIEAAWNREVITCLAITELSHGSNTKSIRTTATYDPTTQEFVINTPDFEAAKCWVGNLGKTATVAMTFANLYTADGQNHGLHGFLIPIRDPKTLLSYPGVLVGDIGEKCGLNGIDNGFVVFTNYRIPRDNLLNRTSDVTPEGVYESVFTEPGKVLGAALESFSAGRIGIMQESANTLCSAAVIAVRYSAVRKQFGPERHGEEMAILEYQLHQYRIFPYLAAACVQKIATEELTSTYMEIIARSQADSNGFDVLTQNAAEIHALISSSKPLITWAARDAIQEAREACGGHGYLQAAKLGQMRTDHDPLCTYEGDNNVLGQQASNWLLRQWSAKELETPIGSVKFLERRSELLALNYASLAQKTPIASWQFSLRCYEWLLCHLMAKTTAHIEGQLAAGSSKFEARNNSQVAGARELSLAYAEYYALTRYVDHVSTLTVEAPYASVLRLLFDVYAMWLLEKHMTTFYVGGFAAGRDFSAAVRQLLLDSCLKLKDVAVSVADAISPPDFALNSVIARADGLLYENLQNEFMTNEGAFQRPSWWRDVIIPQAQSKL

SEQ ID NO: 2321 - protein, 724 aa, Drosophila melanogaster
MASGVGDGDGGDQNGLNSLLTALGDYYSGRREEKAAANIYDDKRIFPDFRSGPLEEYRERASFCYKRMNVVLEGEDHIRLKHKVWQWMEQHPDYQREPGSDLERTREMANKRQHLLWEQQFYGVNEYLGTPHLLLAFGQAIFSYDFSTSVKFGLSTGMFPSTLVSNGSGRLGKYVAKIADNRILGAYALTEISHGTNALGMRTRATYDVKRQEFIIHTPDFEAAKCWVGNLGKTCTHAIVYAQLYVPDDKHQGLQAFLVPIRDERTLLPFPGVTVGDMGEKIGLNGIDNGFVMFNQYRIPKANLLSKTGDIDAQGNYTSKIKDERKRLGASLGALSVGRVNITAITYVALSKAVTIATRYAASRRQFGPTNSPAEWPVIEYQSQQYRLIPHLATTIALRVATLWIGKENVDLTMKGFTGEDTSQAGMEIHAISSALKPVATWAARDGIQECREACGGHGYLKSSGLGELRNDNDANCTYEGENNTLIQQASNWLISLQRNNADFVAVSPLETVSFLKDMDTILQSKGQERTPAEVLDPLNLLNALNWLTVWQLDTTVKRVEEQQREGKDAFETRNNIQVFAAQKLSIIYGERTIYYVFYKFVIGLPDSAEKKVLQQVLSFYGAHLVTKYSAAFYRGGYFRENSNQLELYEQGILALLPLLKNEAIALVDAIAPTDFILNSPLGMSDGNVYQHLQRTLVSTPGVYERPHWWRDVTYKDYLKRAKL

SEQ ID NO: 2322 - protein, 703 aa, Drosophila melanogaster
MVALSTNGRREEKAAANIYDDKRIFPDFRSGPLEEYRERASFCYKRMNVVLEGEDHIRLKHKVWQWMEQHPDYQREPGSDLERTREMANKRQHLLWEQQFYGVNEYLGTPHLLLAFGQAIFSYDFSTSVKFGLSTGMFPSTLVSNGSGRLGKYVAKIADNRILGAYALTEISHGTNALGMRTRATYDVKRQEFIIHTPDFEAAKCWVGNLGKTCTHAIVYAQLYVPDDKHQGLQAFLVPIRDERTLLPFPGVTVGDMGEKIGLNGIDNGFVMFNQYRIPKANLLSKTGDIDAQGNYTSKIKDERKRLGASLGALSVGRVNITAITYVALSKAVTIATRYAASRRQFGPTNSPAEWPVIEYQSQQYRLIPHLATTIALRVATLWIGKENVDLTMKGFTGEDTSQAGMEIHAISSALKPVATWAARDGIQECREACGGHGYLKSSGLGELRNDNDANCTYEGENNTLIQQASNWLISLQRNNADFVAVSPLETVSFLKDMDTILQSKGQERTPAEVLDPLNLLNALNWLTVWQLDTTVKRVEEQQREGKDAFETRNNIQVFAAQKLSIIYGERTIYYVFYKFVIGLPDSAEKKVLQQVLSFYGAHLVTKYSAAFYRGGYFRENSNQLELYEQGILALLPLLKNEAIALVDAIAPTDFILNSPLGMSDGNVYQHLQRTLVSTPGVYERPHWWRDVTYKDYLKRAKL

SEQ ID NO: 2323 - protein, 669 aa, Drosophila melanogaster; identical to SEQ ID NO: 478

SEQ ID NO: 2324 - protein, 693 aa, Drosophila melanogaster; identical to SEQ ID NO: 2320

SEQ ID NO: 2325 - protein, 693 aa, Drosophila melanogaster; identical to SEQ ID NO: 2320

SEQ ID NO: 2326 - protein, 693 aa, Drosophila melanogaster; identical to SEQ ID NO: 2320

SEQ ID NO: 2327 - protein, 728 aa, Trypanosoma brucei
MMCKGLFSKLPPNIVYRFLYANTGLKSCCWKAPLTAQRRTFHRSPQLHFELNPSQQMYSMEHAFEEPTFRFICEGIDIDYKEEVRRALMEVLPRNPSNFVVRDDLPQSQGSSVQRTVQLLRAIAKKRLLSFAQVNSTPQLFCTFYEVIAMCCTPLALLAADHFTFAAMIALYGSKEMKALLLDHVDSCHIVGAIAHRELIAEGVPLNTEARYNRGENVFVLRGSGKFAVVGAVCADWAIVTATLTLNKDDNMGIHAFAVQLREGGVLKKGVSARPINGENEAMTAAGVGVLHFENVTIPVTSLLLPSEIVDGKLVFAGGAATLTSVQALTRQMRLASGALYVGTLKRSLTNIVRYVAQKWMVGPDGRRNYPVFGVQHVQSPLVKLLCTSYVYMTLWRRVLPAFTKPEAQPADYEDEMKLAGTLYFLTDNLSTLKSFADDFMDVHSSLRSTGTCDVLLTVQMRRDGLDHSSLIREVAFKSVVKNVGTTHWGWWLSSCFQSFAALDRFVKNPFYSPRIADLGRHRIFFSHKHYREKKRLRQSREIERRKGGSEHQWYDWVMFRHEQVVHCGEAYMEMFALEVMMDETQACTDPRARKILRDMGWIFALSRQQDRLDYFLTQQMMSPSKSCILSSHLDNIVTVMAPQCVNLVDAFQVPRALRAPCAAEDMESYWTIPGTDTGIQRGDKVLLFGDRKPFGNTKAEQEKMEESREDFDLFHGLAGKQSFAQEK

SEQ ID NO: 2328 - protein, 680 aa, Picea sitchensis
MEDSEQQFARRASVIARHLINPDTYHEISSLQTSSCLQYSPPENFSGKPTFDIGAMRELIDGHNIEDRDWIFNLMANSDLFCPKRRGGQIYVLPDYNKPMEHQREMTMKRILYLLDKGVFKGWLTKPSLEMEARSSTLHECLGLYDHSLGVKLGVHYNLWGGAIKFLGTKGHREKWLQDTEDFVIRGSFAMTELGHGSNVRGIETITTYDPSTQEFVITTPCESAQKYWIGGAANHATHTVVFSQLIINGKNEGVHAFVAQIRDKYGKICSGVRIADCGHKIGLNGVDNGRIWFDKVRVPREYLLNSVADVSPDGKYHSQIDDPDQRFAAFMAPLTSGRVTIAVTSLYQCKIGLAIAIRYSLTRRAFHLYPNEPEVLLLDYPAHQRRLLPLLAKTYAMCCAVNDLKRIYWKRTPSDSKTIHVLSSGYKAMFTWHDMKTLQECREACGGQGLKTENRIGHLKGEYDVQSTFEGDNNVLMQQVSKALFSEYSAARKKQKPLRGLGLEHMNNNRPIIPAILDSSTLRNIEFQMDIFHLRERDLLERLAAEISQCVSQGTTTAVAFTMSYELAEDLGRAFSERAVLDSFILAETKLAAGSMKDILGLLRTIYALITLEEDISFLRYGYLSPQQSQMGRKEIAKLCNELRPHALSLVDSFGIPQPYLSPIAFDWIEANSWAAVHQ

SEQ ID NO: 2329 - protein, 580 aa, Homo sapiens
MRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHSRRQFGPKTKEEVKIIEHQTQTLRLMPHLATALALTFVSRYAGALLDEDVFQGKELVNSRSLQALVAGLKAYSTWENIRCLQDCRECTGGMVVGRELLAQYTKQYEEKPLFGLLQNWAESVGDKLRTSFLAFNMDTVDDLAFLLKAVKFRERVLQRGLVARIYYKVKTKKEDFFHAWNSCLHHVASLSLAHTHRVTLEQFSLAVKSCPDQEDQTLLMKFCLLYGTKLVFQERAWYLEHKYLTPMASTRIRNQLLDLCDSVKDDARRVISTFNIPHTYLHAPIAGISNPRAAWAFYPAPLQPRPREEARSRRPKLGAKL

SEQ ID NO: 2330 - protein, 485 aa, Marinithermus hydrothermalis
MARTGQEYIEALKENPPNLWIKGEKVEDPTTHPAFKGVVQSMARLYDMQHDPQYKEVLTYTSPTSGKPVGMSFLEPKTREDLAKRSAAYKTWADQTLGMMGRTPDYLNAALTAYGMAADFFAQGDPRFGENVRNYYEYVRENDLCTTHALTNPQVNRGASPANQPDPYIPVGVVKQTAEGIIVRGARMLATLPVADELLVFPSTVLKMEPGNEKYALAFAIPTNTPGLHFICREPLAGTSGYDHPVSSRFEEMDAMCVFDDVLVPWERVFVLNNLEIVNQAYAATGALMHMAHQVVVHKVAKTEAFLGLVSLIAEGIGADAFSHVQEKIAEVIVYLETMKAFWAAAEAKAEVNAYGVMCPDRKTLDGARNLYPRLYQRIHEIVQQIGASGLIMFASEKDFESPLGPFVEKFMQGRNLPAREKTQLFRLAWDMTLSSFGARQALYERYFFGDPVRMHQALFKVYDTEPFKARIRAFLGWKHEEVGA

SEQ ID NO: 2331 - protein, 693 aa, Drosophila melanogaster; identical to SEQ ID NO: 2320

SEQ ID NO: 2332 - protein, 724 aa, Drosophila melanogaster; identical to SEQ ID NO: 2321

SEQ ID NO: 2333 - protein, 703 aa, Drosophila melanogaster; identical to SEQ ID NO: 2322

SEQ ID NO: 2334 - protein, 693 aa, Drosophila melanogaster; identical to SEQ ID NO: 2320

SEQ ID NO: 2335 - protein, 693 aa, Drosophila melanogaster; identical to SEQ ID NO: 2320

SEQ ID NO: 2336 - protein, 693 aa, Drosophila melanogaster; identical to SEQ ID NO: 2320

SEQ ID NO: 2337 - protein, 669 aa, Drosophila melanogaster; identical to SEQ ID NO: 478

SEQ ID NO: 2338 - protein, 694 aa, Truepera radiovictrix
MSQTGHATQVATLPSFIAGHWQTGRGEGALIRDAVYGVPIARISVEGLELEAAFDYARRESGPRLRQLTLHERARVLKRVAQHLMSVKEAFYELSYRSGTTRADAWIDIEGGIGTLFSYSSLARRELPDERFWVEDNPIPLAKDGSFVAQHLLVPKEGVALHINAYNFPCWGMLEKFAPTFLAGVPAIIKPAPQTAYLAEAMVREMLPLLPEGSLQLISGGDVDLLGFVREQDAVTFTGSAETGQKLKGHPNVLARNVPFTLEADSLNCCILGQSVTPDAEEFGLFVKEVVREMTVKAGQKCTAIRRVLVPEAQLGAVQEALAARLAKTVVGDPQREGVRMGPLVSAEQREAVRETVARLQGSCAVVWGGDGVRLEGGDAAKGGFFPPTLLRCDAPLEAREPHELEAFGPVSTLLPYRSLEEACEIARRGRGSLVSSVVTRDPGEARTLVFGLAPLHGRVLVLNRDNAKSSTGHGSPLPQLTHGGPGRAGGGEELGGVRAIKHFMQRTAVQADPSTLMALTNLYVPGAKTHQTPIHPFRKTFDELTVGESYTTRRRTVTEADIVLFAALSGDHFYAHTDELAARDSLFGKRVAHGYFLIAAAAGLFVDPAPGPVLANYGLEDLRFITPVGIGDTIQATLTVKQKTARERREGEARATGVVAWDVLLTNQLDETVARYTVLTLVARDEGERGAEA

SEQ ID NO: 2339 - protein, 690 aa, Rhodothermus marinus
METTVYLGKVQSFAQGRWHTPAGEGRPVFHAVTGEPIAEISSEGLDFKGMLDYARTVGGPKLRQMTFHERARMLKALALYLNEHRAELYELSRATGATKQDAWLDIDGGIGTFFVYASKGRRELPDERFLLEGEPERISRGGTFLGHHLLVPLEGVAIHINAFNFPCWGMLEKLAPTFLAGMPAIVKPASVTAYVAERVVRLMLESGILPEGALQLICGGVGDLFDHLTGQDVVTFTGSAETGLRLKSHPTILRETVRFNMEADSLNFSMLGPDVTPDLPEFELFINEVVREMTIKTGQRCTAIRRTLVPADRVDAVLEALTRRLREVVVGDPANEQVQMGPLVSRDQVAEVQARLEELAAAGEIVCGRDGFSVIDADPERGAFFPPTLLYCARPFEHTAPHEVEAFGPVNTVMPYRDLDEAIRLARMGRGSLVGSMVTADPDVARTVVFGTAPYHGRLLILNRECAKENTGHGSPLPHLVHGGPGRAGGGEEMGGIRGLYRYMQRTAIQGSPDMLTAIGNQWMPGASRPEADVHPFRKYFDELRIGETYTTARRTVTEADIVNFAGVSGDFFYAHMDELAARESEVFQGRVAHGYFVLSAAAGLFVDPRPGPVLANYGLENLRFTKPVRPGDTIQARLTVKQKIPREAREGERPGGVVRWHVDVTNQDDELVATYDILTLVARRPESEA

SEQ ID NO: 2340 - protein, 690 aa, Rhodothermus marinus; identical to SEQ ID NO: 2339

SEQ ID NO: 2341 - protein, 675 aa, Actinosynnema mirum; identical to SEQ ID NO: 2202

SEQ ID NO: 2342 - protein, 702 aa, Arthrobacter chlorophenolicus; identical to SEQ ID NO: 2204

SEQ ID NO: 2343 - protein, 694 aa, Truepera radiovictrix; identical to SEQ ID NO: 2338

SEQ ID NO: 2344 - protein, 403 aa, Chlorella variabilis
MRAFPPAKHDALGLEELLTPAEREVRDRVRRFAESEIAPIISDYWERAEFPFPLVPGFQKLGIGGGHLQGYGCQGLSVMGAAMAAVELARVDGSCSTFFLVHSFLATLTVGLLGSEAQKQELLPEMADFRRVGCWALTEPSNGSDASALATVARRVQGGWVLNGRKRWIGNATWADIAVIWARNSETSQVNAFIVRKGNPGYSATKMENKIALRCVQNGDIKLTDAFVPDADRIPGVSSFSDTNKVLAISRIMVAWQPVGLALGAYDMCARYLQQRRQFGAPLASFQLMQEKLQRMLSTCQAMWLMAWRLTKLYEAGKLTHEQASLVKAWTTLRGREVVALGRELLGGNGILSEFLVAKAFCDAEAYYSYEGSYEVNALVAGRGATGISSIKPPRSGKVQVQA

SEQ ID NO: 2345 - protein, 683 aa, Nakamurella multipartita; identical to SEQ ID NO: 2213

SEQ ID NO: 2346 - protein, 685 aa, Methylobacterium nodulans; identical to SEQ ID NO: 2215

SEQ ID NO: 2347 - protein, 409 aa, Caenorhabditis elegans; identical to SEQ ID NO: 2082

SEQ ID NO: 2348 - protein, 661 aa, Xenopus laevis; identical to SEQ ID NO: 519

SEQ ID NO: 2349 - protein, 660 aa, Danio rerio
MNPDISRERENASFNLEILTNVLDGGAEKTNRRREIESLVIGDPDFQHEDLNFLSRSERYDAAVRKSAQMILKLREYGISDPEEIYSYKTCVHRGRPEPLDLHLGMFLPTLLNQSSPAQLETFFMPAWNLEIIGTYAQTEMGHGTHIRALETTATYDPSTQEFVLNSPTISSIKWWPGGLGKTSNHAIVLAQLYTQGKCHGLHAFITPIRCMKTHMPLPGVVVGDIGPKFGFDEVDNGYLKLENVRIPRENMLMKYAQVEPDGTYVKPPSDKLTYGTMVFIRSMIVGESARALSKSCTIAIRYSAVRHQSELRPGEPEPQILDYQTQQYKLFPLLATAYAFHFVGQYMNKTYHRISGDISLGDFSELPELHALSAGLKAFTTWAANTGIEVCRMSCGGHGYSRCSSLPDIYVTFTPTCTYEGENTVMMLQTARYLVKSYKQARAGQQLTGIVSYLNESQSRIQPHSVSSRPTVVNINDLVSLVEAYKFRAAKLVEVAAKNLQLELQHSKSNEDAWNNTSIDLVRASDAHCHYVVVKLFAAKLSEIGDKAVHSVLSTLALLYALHGVAQNSGDFLKAGLLSVSQLDQISQRLKGLLLEIRPNAVALVDAFDYRDEMLNSSLGRYDGNVYEHMFEWAKKSPLNHTEVHESHNKYLKPLRSKL

SEQ ID NO: 2350 - protein, 661 aa, Xenopus tropicalis; identical to SEQ ID NO: 520

SEQ ID NO: 2351 - protein, 659 aa, Caenorhabditis elegans [sequence omitted]

SEQ ID NO: 2352 - protein, 659 aa, Caenorhabditis elegans [sequence omitted]

SEQ ID NO: 2353 - protein, 659 aa, Caenorhabditis elegans [sequence omitted]

SEQ ID NO: 2354 - protein, 818 aa, Candidatus Midichloria
MPKFEANIRTSMFNYVSNHSHSYFVQTHVGGIAQRISDMPKSAKLVIDDLLTVFIPLIVSIIASSSVFLSMHPLLAAIFFTWLGLHFTLCVFFCLKAANSVSVQSAARALLQGKIVDSMTNHLSVKLFTAHQHEMQTIKEAQADELQKYRYSLIYIEKFKMLLSLISIINITLLLYLAIKLWQQGQITIGDIVFTINSTLGLMTNLWFTGDEISYMFYEIGVCKQSLILLEEPTEISESTLKQIKVTQGKIEFDNVSFNYHNNGNIFKNKSLVIHGGQKVGLVGFSGSGKTTFANLIMRLYEVSSGTVKIDDQDVSQASLLSLRSNIAFIPQDPFLFHRSVLENIRYGNINATDEEVKEVAKKAECDSFIMNLEHGYDTIVGERGSKLSGGQRQRIAIARAMLKNAPIVIMDEATSALDSVTERLIEKSLQHLMVNKTAIVIAHRLSTLLHLDRILVFEKGNIVGDGTHEELLTKGGRYAMLWHMQQSGLLPEHDNGKKGIKMDKNKSSLLFPGQGSQVVGMGVELFNTFNEAKEVFSLIDETLKQNLSQLMFSGELEELTLTANAQPAIMAVSLAVMAVLEKQLNLTIQDLCNVAAGHSLGEYSALAASGVFSLTDTASLLRVRGDAMQSAVNPGEGAMVALIGTDLDSAQKLCNHVANYGACQIANDNGAGQIVLSGATIAIDKAIESATNFGVKKAIKLKVSAPFHSSLMQSAAFKMEQALKGVAIHNPTIDVMANFNVEKHHESITKDLLVSQVAGSVRWRETMEKITTHYEVDTFIEIGPGQVLSGIAKRMYPGSNVFNLHTPKNIEEFSDFL

SEQ ID NO: 2355 - protein, 681 aa, Enterobacter cloacae
MQQLASYLSGTWQNGRGRARTIHHAISNEALWEVTSDGLDMAQARRYAIDHGGSALRAMTFVERAAMLKAVAKYLLEHKETFYAFSAQTGATRADSWVDIEGGIGTLFTYAGLGARELPDDTLWPEDELIPLSKGGGFAARHVLTSKSGVAVHINAFNFPCWGMLEKLAPTWLAGMPAIVKPATASAQVTQAMVKAIVDSGLVPDGALSLICGGAGSLLDHLDFQDVVTFTGSAQTGQSLRVHPNLVANAVPFTMEADSLNCCVLGDDVTPEQPEFALFIREVVREMTAKAGQKCTAIRRIIVPQTQLQAVSDALVARLQAVRVGDPAQEGVKMGALINHEQRADVQEKVNALIEAGCEVRLGGSADLQAAGAFFPPTLLFCPQPDETPAAHAIEAFGPVATLMAYQRREHALQLARAGQGSLAGTLVTADGALAREFILGAARAHGRIQVLNEESAKESTGHGSPLPQLLHGGPGRAGGGEELGGLRAVKHYLQRTAVQGSPTMLASIGKQWVRGAKVQEDRIHPFRKYFEELQPGDSLLTPRRTMTEADIVNFACLSGDHFYAHMDKIAAAESIFGERVVHGYFVISAAAGLFVDAGVGPVIANYGMENLRFIEPVKPGDTLQVRLTCKRKTTKRQKTAEEKPTGVVEWAVEVFNQHQQAVALYSILTLVARQHGDFTD

SEQ ID NO: 2356 - protein, 681 aa, Enterobacter cloacae; identical to SEQ ID NO: 2355

SEQ ID NO: 2357 - protein, 818 aa, Candidatus Midichloria; identical to SEQ ID NO: 2354

SEQ ID NO: 2358 - protein, 660 aa, Myxococcus xanthus
MPELTRALAQLEESLGVSGSEAVRALVPAASPSRAEQGTPTSFDPEALRAVLDRTYPETRAQVRQWLADPAYRYTDTRDTAKYRDQVLAWLKAMADHGLGRIAFPSGNETSADLGAFVTAFETLAYFDLSLVIKAGVHFGLFGASILFLGTEKHHRKYLPQVASLELPGCFAMSELGHGSNVRDVETVARYDAEAGEFVVHTPTETARKEWIGNAARHGRIATVFAQLEVGGRVLGVHALLVPLRDPAGKVLPGIRIEDCGEKMGLNGVDNGRIWFEHVRVPRENLLDRFGQVNAQGEYTSAITGDSKRFFTMLGTLVAGRVSVAAAALSAAKSGLTIAVRYGDLRRQFGPAGDKEFRLLDHQAHQRRLLVPLAKTYAMDFALEYLVERYVKRTEEDAREVESLAAGLKAYSTWHTTAVLQEAREACGGQGYLQANRLAALKADTDVFTTFEGDNTVLMQLVAKGLLTGYRQRFEDDRVFAVLKLLADRATAVVDRNPFAARRTDSDHLRDNDYHLRALRFREEELLATVSKRIRKRLSAGVEAFEAFNQVQVHLLELAHAHVERLVLEQFLKGVADVKDPGLKTVLGRLCDLYGLSCLESANGWFQEHGWLEGTKVKAIRKEVTRLCAELRPDAVALVNAFGVPDTCLAAPIGLGHLSP

SEQ ID NO: 2359 - protein, 660 aa, Myxococcus xanthus; identical to SEQ ID NO: 2358

SEQ ID NO: 2360 - protein, 659 aa, Thermobifida fusca
MPQHGDTARVDVEALRDLLDGRWAAVRRRARDILRGPEFTPRYGLSVAEHRARVTEQLHALARTDLARYGFDPRYGGRGEVGASVAAFEMLVCDLSLMVKMGVQWGLFGGAIQALGTEYHHATYLPGVMSLEIPGCFAMTETGHGSDVQRLRTTATFDPNTDEFVVHTPDEAARKDYIGNAARDGRLAVVFAQLITGGQRHGVHALLVPIRDADGTVLPGIRIEDCGPKAGLNGVDNGRIWFTQVRVPRTALLNRYGDVAADGTYSSPIENPNRRFFTMLGTLVRGRISVAGGAGMAAKTALAIAIRYGQVRRQFLRPGSDSEVALLDYLAYQRRLLPALARTYALHFAQEEMVSRLHDGFTDGPLDERAQRELEAHAAGLKAVATWHAVDTIQTCREACGGAGYLAENRLPQLRADTDVFTTFEGDNTVLLQLVGKSLLTNYRQEFGNLDPLGMAKFAAGQFLGTVIERTAARSLLDRLVQAAPGRGDEDDLRNREWQRALLADRENHVLEGLARRLRAAPADADPFDVVNNVQDHVLLAARAHVDRLVFEAFASGVARIEDEGTRAVVERLCDLAALSLVEQERAWFLEHGRLTPARAKAVTATVNALCQELRPHARDLVDAFGLNDEWLAAPIALGAETARQDQQARARVPVGAET

SEQ ID NO: 2361 - protein, 659 aa, Thermobifida fusca; identical to SEQ ID NO: 2360

SEQ ID NO: 2362 - protein, 587 aa, Photorhabdus luminescens
MDKSLYNSESTLKSYLGIGNEGVSDNLLAVLKSNCVNYQSSVKKFIELLEYIQNNNIRTKPFNELVALHELVAPHDCAVVSMLSIHYNLAIGTVANLGVQTPYVEDLYQKLCSGRAIGVYLATELAHGNDLIAIETQANYLPEKGVFMLNSPSPNAYKFMPNTMPCELPKVAVILAQLNVSGKKYGIFPFLLPLSVNGKLTPGVKITPLGDKPGFYLDNAITSFDNVEIPFEGLLAGNMITLTREGKVSLHIKELRERFSLITNRIHSGKLCMAMISVTAAKSVLHITSTYGNKRQTFGYSGAMPIINYSHFKEGIAWDTLSTITHTLYLRELTRKVSTILSESIKNFKFSDELLIEIITTKSLCTWRTQEILINCRERCGAQGLFTVNKISPYLISNFGTITSEGDNLVLSLKAGGMIILNKMKEINKASFQHNLFPILHDYMNFLYKKLNGLIASNNKKINLDILNKHSGDFLELSQTYAVLSVVTTTIDAYHDNNDDDLCMIIEGYLLDWIHRNMSNLLRSEVINLQESKKIDERRIEYIRQHADRINDYIPSFGVDKAGIETPISSDDYISWYANNHHQLKNN

SEQ ID NO: 2363 - protein, 980 aa, Corynebacterium efficiens
MTVATTFDILLTDEEKQKHTEAGFWKNRLLIDYFDQAAAANPDKLCTVEQNGRHTYRELADDVEIAAHAMIEAGVEPGDVVGIHLPNWYEWLIIHLAAMRVGAITNPLIPIYRDREISHMARTAKVSVLFIAETFRRFNYMDMVDRLRDELPDLKKTIVVRGQTRRKGFDLFEDFLETGRTRREESPVDFTELRPDPNDLALIMFTSGTTGKPKGVMHTHNTVLAGALPWPDKLGMDENDVIHMASTFGHLTGYLYGVSLPFMLGGTAVIQDVWSVDYFVYLVEKYRITHTSGAAPFLHDLLHAENLHHYDMSSLKRFCCMGAPIPRVFITQAKEKLPEMSVFGGWGMTECCLTTMGHPDYPEEKIVNTDGRALAGMETRVVDEEGNEVPRGTQGRLQVRGAFLFRGYLGMLDATLEEYEGDWFNTGDLAVMDDEGFISLSGRDKDVIIRGGENVPVADLENALIQHPDIADVAVVAMPHDRLQEIAAAVVVMEHGREPITMETMKAHLESTNIAKPYWPEYLEVTDTLPRTPSGKPQKFKLREHLAKVAEKLKQDDIDNGVVATPGQITAPPVLTSPRGSWWGPVDITQMDSLFSVEEKSTALKVRQFVDREIRPNIAEWYNAGHFPREIIPELGKLGVLGMYLKGFDCPGRSAVEYGLAAQELEAGDSGLRTFVSVQGSLAMAAIHKHGSLDQKLEWLPRMARGEAVGCFGLTEPTAGSNPAAMKTFARQEPGGDWVLNGTKRWIGLANIADVAIIWAQTEEFGDGRGVRGFVVPTDTPGFSAQVIEPKLSMRASVQCEITLEDVRLPYTAMLPKDSAVGLRGPFSCLNEARYGIVWGVLGAARDSFNSALEYSHHREQFGTPLTHFQITQTKLADMAVAINKGYHLAHHIGRLKDTTGVTPEMISTGKLDNTRIAIQIARDARAMLGGNGISMDYSPLRHANNLESVRTYEGTDEVHQLTIGRFITGVGAFTAEGAK

SEQ ID NO: 2364 - protein, 697 aa, Drosophila pseudoobscura
MANEDTSFIPDLPPGGPLSVYRKRANFDWKRLRLIFEKEQGLRIKYKVWRRLESDPLFAHSSRTLPMDEQKRLCAMQVNRMKQLDLVPREIESLSFSAKTKYLMYINEALASYSPSLSVKIALGVGLFNNAIRAMGTEKHTKYIEAAWNREVITCLAITELSHGSNTKSIRTTATYDPSTQEFVINTPDFEAAKCWVGNLGKTATVAMTFANLYTADGQNHGLHGFLIPVRDPKTLLSYPGVLVGDIGEKCGLNGIDNGFMVFSNYRIPRDNLLNRTGDVTPEGVYESVFAEPGKALGAALESFSAGRIGIMQESANTLCSAAVIAVRYAAVRKQFGPERQGAEMAILEYQLHQYRIFPYLAAACVQKIAVEELTITYLEIIARSQADSNGFDILTQNAAEIHALISASKPRITWAARDAIQEAREACGGHGYLAAAKLGQMRTDHDPLCTYEGDNNVLGQQASNWLLRQWAAKDLETPIGSVRFLERREHLMSLRYAQLVAQSPLSSWEFSLRCYEWLLCHLMAHTTAHIEGELAAGGTKFDARNNSQVAGARELSLAYAEYFALTRYVEHVRRLQVEPAYCKVLRLLFDVYAMWLLEKHMTTFYVGGFAEGKDFSAAVRRLLLDSCLQLKDVAVSVADAIAPPDFALNSVIARADGLLYENLQNEFMTNEGAFQRSSWWRDVIIPQPQPQEKSKL

SEQ ID NO: 2365 - protein, 669 aa, Drosophila pseudoobscura
MPSQEVNPDLLKERHTATFDPHEFAVFWAGGEERYKEKKSLEKMFLEDPALKDDLPISYLSHKELYEHSLRKACIIGEKIRKLRAEGEDGVDTYNALLGGSLGAAILKEGNPLTLHYVMFVPTIMGQGTMDQQVEWLSKAWDCEIIGTYAQTELGHGTFLRGLETRADYDARTQEFVINTPSLSAYKWWPGGLGHTANHAVVVAQLYTKGEFRGLAPFIVQLRHSDTHEPLPGIDIGDIGTKLGMKSVNNGYLGLKNVRVPLNNMLMKNQQVLPDGTYVAPKNSVLTYGTMMFVRCALIRDTAQSLAKASTIATRYSAVRRQSPIDPNQPEPQIMDHTTQQLKLFPQIAKSIVFKTTGDGIWNMYNVLSGEIEQGNLDRLPEMHALSCCLKAICSADAAAGVETCRLSCGGHGYMDCSNFPTIYGMTTAVCTYEGENTVMLLQTARYLVKVYGQALNGEKLVPTVAYINDALKERQFVNFDGSLESIVKAFQFVAANKIRIAYEQIEQRRRQGHSTEMAANLSGTFLTAAADLHGRAFLAESAYTELLAVSRQVSPALADVLKVVLELYLVDACLNRIGDFLRFIDITDKDVTTLEIRLQNCLKQLRPNAVTLVDSFDLHDRVLDSVLGAYDGNVYERIFESTKKNPLNKEPVNEAFHKYLKPFMKAHL

SEQ ID NO: 2366 - protein, 669 aa, Drosophila persimilis
MPSQEVNPDLLKERNTATFDPHEFAVFWAGGEERYKEKKSLEKMFLEDPALKDDLPISYLSHKELYEHSLRKACIIGEKIRKLRAEGEDGVDTYNALLGGSLGAAILKEGNPLTLHYVMFVPTIMGQGTMDQQVEWLSKAWDCEIIGTYAQTELGHGTFLRGLETRADYDARTQEFVINTPSLSAYKWWPGGLGHTANHAVVVAQLYTKGEFRGLAPFIVQLRHSDTHEPLPGIDIGDIGTKLGMKSVNNGYLGLKNVRVPLNNMLMKNQQVLPDGTYVAPKNSVLTYGTMMFVRCALIRDTAQSLAKASTIATRYSAVRRQSPIDPNQPEPQIMDHTTQQLKLFPQIAKSIVFKTTGDGIWNMYNVLSGEIEQGNLDRLPEMHALSCCLKAICSADAAAGVEICRLSCGGHGYMDCSNFPTIYGMTTAVCTYEGENTVMLLQTARYLVKVYGQALNGEKLVPTVAYINDALKERQFVNFDGSLESIVKAFQFVAANKIRIAYEQIEQRRRQGHSTEMAANLSGTFLTAAADLHGRAFLAESAYTELLAVSRQVSPALADVLKVVLELYLVDACLNRIGDFLRFIDLTDKDVTTLEIRLQNCLKQLRPNAVTLVDSFDLHDRVLDSVLGAYDGNVYKRIFESTKKNPLNKEPVNEAFHKYLKPFMKAHL

SEQ ID NO: 2367 - protein, 660 aa, Macaca mulatta; identical to SEQ ID NO: 714

SEQ ID NO: 2368 - protein, 673 aa, Streptomyces avermitilis; identical to SEQ ID NO: 152

SEQ ID NO: 2369 - protein, 673 aa, Streptomyces avermitilis; identical to SEQ ID NO: 152

SEQ ID NO: 2370 - protein, 673 aa, Streptomyces avermitilis; identical to SEQ ID NO: 152

SEQ ID NO: 2371 - protein, 700 aa, Rattus norvegicus; identical to SEQ ID NO: 350

SEQ ID NO: 2372 - protein, 661 aa, Mus musculus; identical to SEQ ID NO: 72

SEQ ID NO: 2373 - protein, 660 aa, Homo sapiens [sequence omitted]

SEQ ID NO: 2374 - protein, 700 aa, Rattus norvegicus; identical to SEQ ID NO: 350

SEQ ID NO: 2375 - protein, 661 aa, Mus musculus; identical to SEQ ID NO: 72

SEQ ID NO: 2376 - protein, 660 aa, Homo sapiens [sequence omitted]

SEQ ID NO: 2377 - protein, 700 aa, Rattus norvegicus; identical to SEQ ID NO: 350

SEQ ID NO: 2378 - protein, 661 aa, Mus musculus; identical to SEQ ID NO: 72

SEQ ID NO: 2379 - protein, 660 aa, Homo sapiens [sequence omitted]

SEQ ID NO: 2380 - protein, 675 aa, Saccharomonospora paurometabolica
MGALPSYVSGGWHTPSGDGTPAYDAATGEEVARISSTGIDMAAALDHGRTVGGPALRKLTFHQRGALLKALVSHLREHRDELYALSARTGATKADSKFDIDGGIGVAAAYASLAKRELPNDTVYPEGRVETLGKGGTFVGRNVLTPLHGVAVQINAFNFPVWGPLEKFAPAFLAGVPSLIKPASQTAYLTHRLVELIVDSGLLPEGSLQLVCGSAGDLLDHVTGQDLVSFTGSAATAQRLRAHPAVVRNSVRFNAEADSLNLSVLGPDAVPGTTEFDLYVKQVVTEMTVKAGQKCTAIRRAFVPAELIDDVERALREKLAKVTVGHPTAEGVRMGALASLEQREEVRRSLKALSGAGRIVFGDPDRVDVVDADHERGAFVSPVLLRADDPDRAEPHEVEAFGPVATLMPYTSVPQLVDLAARGQGSLAGSVVTGDPDFAREVVLGVAPWHGRLLVLDAEDAGESTGHGSPLPAFVHGGPGRAGGGQEMAGVHGVLHHMQRTSVQGSPTVLGRVTGQWVPGAERSADEHPFRKSLARLRPGDSVTAGPRRVTAEDVAHFAEFTGDTFYAHTDEAAAAANPLFGGIVAHGYLVVSLAAGLFVSPEPGPVLANYGLENLRFRTPVKPGDELTVTLTAKQITPREDAEHGEVRWDTEVTNQRDEPVAKYDVLTLVAKDG

SEQ ID NO: 2381 - protein, 669 aa, Drosophila melanogaster
MPAKPVNPDLQKERSTATFNPREFSVLWAGGEERFKEKKALEKLFLEDPALQDDLPISYLSHKELYEHSLRKACIIGEKIRKLRADGEDGVDTYNALLGGSLGSAILKEGNPLALHYVMFVPTIMGQGTMDQQVEWLSKAWDCEIIGTYAQTELGHGTFLRGLETRADYDASTQEFVINTPSLSAYKWWPCGLGHTANHAVVVAQLYTKGEFRGLAPFIVQLRDSDTHRPMPGIDIGDIGTKLGMKGVNNGYLGLKNVRVPLNNMLMKNQQVLPDGTYVAPKNSVLTYGTMMFVRCALIRDTAQSLAKASTIATRYSAVRRQSPIDPNQPEPQIMDHTTQQLKLFPQIAKAIVFKTTGDGIWNMYNVISGEIEQGNLDRLPEMHALSCCLKAICSADAAAGVETCRLSCGGHGYMDCSNFPTIYGMTTAVCTYEGENTVMLLQTARYLVKVYGQALNGEKLVPTVSYISDAINQTKFVNFDGSLRSIVKAFQFVAANKTRIAYEQIELRRKQGYGTEVAANLCGTFLTAAADLHGRAFLAQTAYTELLALSREVSPELAEVLKVVLELYLVDACLNRIGDFLRFIDLTDQDVTKLEVRLENCLKRFRPNAVSLVDSFDLHDRVLDSALGAYDGNVYEHIFESTKKNPLNKEPVNGAFHKYLKPFMKAHL

SEQ ID NO: 2382 - protein, 669 aa, Drosophila melanogaster; identical to SEQ ID NO: 2381

SEQ ID NO: 2383 - protein, 669 aa, Drosophila melanogaster; identical to SEQ ID NO: 2381

SEQ ID NO: 2384 - protein, 675 aa, Saccharomonospora paurometabolica; identical to SEQ ID NO: 2380

SEQ ID NO: 2385 - protein, 708 aa, Anopheles gambiae
LSSNFTLQLPSPSTMEGLLKDENLFNPLPKHGPLAPYRRAATIDWRKMRLTFTDQHELELQHRLYRLFRTSEPFIRGRTVRDQSTDERRRLAMVQLHHLQRARLFHYETFIERPALASIYYATIAEYDMALLVRLTVNYLFFTGAIRMFDEPGGRLAHVIEQAEAGHIAGSFALTEVGHGTNARAIRTRATYDPAHREFVLETPDFEAAKCWAGNLAKSCTDMIVWAQLYTADGACHGVSAFVVPIRDRYTLQPLPGLLVGDLGEKAGLNGVDNGFVLFRGYRIPRENLLARFGDVNEVTGRFESTAKSANERFALSMGPLVIGRINICTVSQTLLAKALTIGIRYSAVRCQFGPTGDDRELPILEYQSQQYRLLPHLATCVALKLFHRWFARVSGDAQVRMLRAAPIESELLLEVHIVASAVKPICSWAARDGIQDAREACGGHGYLRLAGLADLRVDNDANITYEGENNVLLQQVSQQLVGIRSKGEYGAFALMSPLGSMTFLAEYEQIMQQRLERITVEQIEDPKVILNVLSWLTAYTLEGTYRRAEGLLKRGDSKFDVRNDTQIFYAKDLAIVFGERIIFNAFCTFLDTMEQGPERNYLTRLAQLYGATLLLKHMATLQSAGYLTVDALPLVQESILRLLPIVKQDAVAMIDSLAPPDFVLNSPLGAADGNVYARMESELMAGQDVTGRATWWHEILTPTSAKL

SEQ ID NO: 2386 - protein, 430 aa, Oryza sativa; identical to SEQ ID NO: 2012

SEQ ID NO: 2387 - protein, 632 aa, Rattus norvegicus
MTGWSGLFIEVPLYRLAFEVCCHLQGPQGFLQRACQGVSCLPRDSRAAGIMEEKRNNFISQSFVLGEVLCMVDVSMSIKCGVIFLLFGGAVNNLGSPEHVIKWFRPLKEQKYTGMFAMTEKGHGSNIRGIQTEATFDCDSQEFVIDMPCENAQKMYIGNAMHGNYAAVFAQLIIEGKSQGPHCFIVPIRDENGNLYPGVTAIDMMYKEGLNGVDNGILIFDKVRIPRENMLDKLGSVTPDGQYHSPIQSKSARFNAMLAILTPSRLAVTFQAMGAMKLGLMIAIRYSHSRRQFGPKGKEEVKIIEHQMQALRLMSHLATALALTFTSRHAGHILDEDILQGRELINRRSLQALMAGLKAYSTWETVRCLQDCRECTGGMGYMMENRLSGLKCDTDVFVTFEGDNVVMLQVVARELLAQYSKQHKKNPFLGMIQNWTETAMDKLRTSFLVFNTDTVGHLAFLLKAVNFRERVLQRSLVSRIYYKVVTEKGDFFRAWNSCMHHVISLSLAHVHRVALEQFTLAVRQCPNREDQALLMKFCLLYGTKLLFQERGWYLEHKYLTPAASMRIRAQLLNLCESVKDDSLKVISAFNIPHTTIHAPTAGTPNTGAAEAFSPAPTQPLVQNGTRSRLAKL

SEQ ID NO: 2388 - protein, 681 aa, Mus musculus; identical to SEQ ID NO: 345

SEQ ID NO: 2389 - protein, 681 aa, Mus musculus; identical to SEQ ID NO: 345

SEQ ID NO: 2390 - protein, 681 aa, Mus musculus; identical to SEQ ID NO: 345

SEQ ID NO: 2391 - protein, 433 aa, Zea mays
MGSLGGSAGAGDGGKVGLPALDVTLAFPQATPSSLFPPAVSDYYQFDDLLTDEEKALRKKVRGIMEKEIAPIMTEYWEKAEFPFHAIPSLASLGLAGGTIKGYGCPGLSLTASAISIAEVARVDASCSTFILVHSSLAMSTIALCGSEAQKQKYLPSLTQFKTIGCWALTEPDYGSDASSLRTAATKVPGGWHLDGQKRWIGNSTFADVLIILARNADTNQLNGFIVKKGAPGLKATKIENKIGLRMVQNGDIILNKVFVPEEDRLTGINSFQDINKVLAMSRIMVAWQPIGISMGVYDICHRYLKERKQFGAPLAAFQLNQEKLVRMLGNIQAMLLVGWRLCKLYESGKMTPGRSSLGKAWTSKKAREVVSLGRELLGGNGILVDFLVAKAFCDVEPIFSYEGTYDINSLVAGREITGIASFKPAVSAKSRL

SEQ ID NO: 2392 - protein, 667 aa, Caenorhabditis elegans; identical to SEQ ID NO: 2140

SEQ ID NO: 2393 - protein, 667 aa, Caenorhabditis elegans; identical to SEQ ID NO: 2140

SEQ ID NO: 2394 - protein, 667 aa, Caenorhabditis elegans; identical to SEQ ID NO: 2140

SEQ ID NO: 2395 - protein, 678 aa, Selaginella moellendorffii
MEAGQVSSAATRRALVLTGHLKEIDKGSSLVVRQPCLEYSPPELNSEPAFDIELMQGLLDGHDAQTRTFIFNLMSESDLFVSRRVGRRVFLGADYNQPMEVQRELTMKRIQYFLDRGVFRGWLTDDRPQSALRMAAMFEYIGLFDHSLAIKLGVHFHLWGGSVKYLGSKRHHDKWLLPTEEFSVIGCFAMTELGHGSNVRGIETITVYDPSTKEFVINTPCESAQKYWIGGAAMHATHTVVFSQLHMNGKNEGVHAFIAEIRSPDGRICPGVRIADCGHKIGLNGVDNGRIWFDNKRVPRENLLNSVADVTPDGRYVSNITDADQRFGAFMAPLTSGRVTIAVSAVYQSKVGLATALRYALSRRAFALSPNEPEVLLLDYPSHQHRLIPLLAKSYAMSFAACDLKRIYYNRKPEHAKIIHVLSSGYKAMFSWHNLKTLQECREACGGQGLKSENKVGQLKAEYDVQLTFEGDNNVLMQQVSKALLGDFFTSQKKQQPMKGLGLEHMNGPPPTIGTNANVRDVTFQLALFRLRERDLLVKLAQQVRELVSKGSTMANATLASYQLAEDLGRAFSERSVLESILSVENSLAPSPEKTILGLLRSLFVATTVDEDPVFLRHAYLSPDQALSIQKEVASLCREIRPFILSLVDAFGIPAPFLGPIAFDWIAANSWDLEEARS

SEQ ID NO: 2396 - protein, 678 aa, Selaginella moellendorffii
MEAGQVSSAATRRALVLTGHLKEIDKGSSLVVRQPCLEYSPPELNSEPAFDIELMQGLLDGHDAQTRTFIFNLMSESDLFVSRRVGRRVFLGADYNQPMEVQRELTMKRIQYFLDRGVFRGWLTDDRPQSALRMAAMFEYIGLFDHSLAIKLGVHFHLWGGSVKYLGSKRHHDKWLMPTEEFSVIGCFAMTELGHGSNVRGIETITVYDPSTQEFVINTPCESAQKYWIGGAAMHATHTVVFSQLHMNGKNEGVHAFIAEIRSPDGRICPGVRIADCGHKIGLNGVDNGRIWFDNKRVPRENLLNSVADVTPDGRYVSNITDADQRFGAFMAPLTSGRVTIAVSAVYQSKVGLATALRYALSRRAFSLSPNEPEVLLLDYPSHQHRLIPLLAKSYAMSFAACDLKRIYYNRKPEHAKIIHVLSSGYKAMFSWHNLKTLQECREACGGQGLKSENKVGQLKAEYDVQLTFEGDNNVLMQQVSKALLGDFFTSQKKQQPMKGLGLEHMNEPPPTIGTNANVRDVKFQLALFRLRERDLLVKLAQQVRELVSKGSTMANATLASYQLAEDLGRAFSERSVLESILSVENSLAPSPEKTILGLLRSLFVATTVDEDPVFLRHSYLSPDQALSIQKEVASLCREIRPFILSLVDAFGIPAPFLGPIAFDWIAANSWDLEEARS

SEQ ID NO: 2397 - protein, 681 aa, Rattus norvegicus; identical to SEQ ID NO: 343

SEQ ID NO: 2398 - protein, 693 aa, Drosophila melanogaster; identical to SEQ ID NO: 2320

SEQ ID NO: 2399 - protein, 681 aa, Rattus norvegicus; identical to SEQ ID NO: 343

SEQ ID NO: 2400 - protein, 693 aa, Drosophila melanogaster; identical to SEQ ID NO: 2320

SEQ ID NO: 2401 - protein, 681 aa, Rattus norvegicus; identical to SEQ ID NO: 343

SEQ ID NO: 2402 - protein, 693 aa, Drosophila melanogaster; identical to SEQ ID NO: 2320

SEQ ID NO: 2403 - protein, 661 aa, Xenopus laevis; identical to SEQ ID NO: 1135

SEQ ID NO: 2404 - protein, 661 aa, Phascolarctos cinereus; identical to SEQ ID NO: 503

SEQ ID NO: 2405 - protein, 661 aa, Mus musculus; identical to SEQ ID NO: 556
  MOD_RES (277)..(277): Any amino acid
  MOD_RES (279)..(279): Any amino acid

SEQ ID NO: 2406 - protein, 660 aa, Homo sapiens; identical to SEQ ID NO: 346

SEQ ID NO: 2407 - protein, 661 aa, Cavia porcellus; identical to SEQ ID NO: 373

SEQ ID NO: 2408 - protein, 703 aa, Drosophila melanogaster; identical to SEQ ID NO: 2322

SEQ ID NO: 2409 - protein, 700 aa, Mus musculus; identical to SEQ ID NO: 352

SEQ ID NO: 2410 - protein, 700 aa, Mus musculus; identical to SEQ ID NO: 352

SEQ ID NO: 2411 - protein, 661 aa, Rattus norvegicus; identical to SEQ ID NO: 341

SEQ ID NO: 2412 - protein, 661 aa, Xenopus laevis; identical to SEQ ID NO: 1135

SEQ ID NO: 2413 - protein, 661 aa, Phascolarctos cinereus; identical to SEQ ID NO: 503

SEQ ID NO: 2414 - protein, 661 aa, Mus musculus; identical to SEQ ID NO: 556
  MOD_RES (277)..(277): Any amino acid
  MOD_RES (279)..(279): Any amino acid

SEQ ID NO: 2415 - protein, 660 aa, Homo sapiens; identical to SEQ ID NO: 346

SEQ ID NO: 2416 - protein, 661 aa, Cavia porcellus; identical to SEQ ID NO: 373

SEQ ID NO: 2417 - protein, 703 aa, Drosophila melanogaster; identical to SEQ ID NO: 2322

SEQ ID NO: 2418 - protein, 700 aa, Mus musculus; identical to SEQ ID NO: 352

SEQ ID NO: 2419 - protein, 700 aa, Mus musculus; identical to SEQ ID NO: 352

SEQ ID NO: 2420 - protein, 661 aa, Rattus norvegicus; identical to SEQ ID NO: 341

SEQ ID NO: 2421 - protein, 661 aa, Xenopus laevis; identical to SEQ ID NO: 1135

SEQ ID NO: 2422 - protein, 661 aa, Phascolarctos cinereus; identical to SEQ ID NO: 503

SEQ ID NO: 2423 - protein, 661 aa, Mus musculus; identical to SEQ ID NO: 556
  MOD_RES (277)..(277): Any amino acid
  MOD_RES (279)..(279): Any amino acid

SEQ ID NO: 2424 - protein, 660 aa, Homo sapiens; identical to SEQ ID NO: 346

SEQ ID NO: 2425 - protein, 661 aa, Cavia porcellus; identical to SEQ ID NO: 373

SEQ ID NO: 2426 - protein, 703 aa, Drosophila melanogaster; identical to SEQ ID NO: 2322

SEQ ID NO: 2427 - protein, 700 aa, Mus musculus; identical to SEQ ID NO: 352

SEQ ID NO: 2428 - protein, 700 aa, Mus musculus; identical to SEQ ID NO: 352

SEQ ID NO: 2429 - protein, 661 aa, Rattus norvegicus; identical to SEQ ID NO: 341

SEQ ID NO: 2430 - protein, 708 aa, Anopheles gambiae; identical to SEQ ID NO: 2385

SEQ ID NO: 2431 - protein, 557 aa, Caenorhabditis remanei
MHRALLRVQKFQKYTARCLSDAGKAEKLAEFSEKSKYAIRTLDNSSPIEKRSLSRGFAMNRFEKDFMIYPEYTDSDDVRNIEGFVDILQKSLNLSVDSKIIEKEGNLPSEVIETLRSNAIFSVSIPKDFGGIGMKNKEISKVFEELSIDWNIYTSAQIALQVSNILTIYGSDEQKSKYLTALSDGKLRPAVAIVKDTNGGKCELTTGPQGKSMLNGENIRVIGHHNANFYVVFGDNKGEQTCFILDETELATTDKIKFHRDETFGLKGTDIGRIELTALVNEKNVLGAPGNGTEISAELTGSGRMPFAAATVGMAKRTLRELSIWCNRTPSRRTDRSVLSVDSRSQRLVTDLALKVYSLESALYYLSGLIDEGLSIVVDIENSLLSMLTRDVLQTRLTSAPRLISCNQLSRFLEVMADLIPNEKGSEGEVDYRRQIKSIDSVEFDKRIESCGIRGDFYKEDKTTAEYLKKKMRKILLEPAILEVFDDNVFGFDFSTKDCINALENYFSLNAPDKDNGLTSKALHIKIHQFIRSCHHVARSQNPKFQLNDRLKMALFD

SEQ ID NO: 2432 - protein, 663 aa, Dictyostelium purpureum
MDKSTLRRIDNTLKHLTKVTSDIENIHPHLNETPNLKTLKSILDGEYHFDRDRLKELFEESSTFDEIFLNKSIHTDEHREQTLKACKEIIQLQIVKLSDMEKNPKKFLNWFETISLCDPSVSLKFAVQYNLWGGTILFLGTKKHHERYLDGIENGSILGVFGLTELGHGSNVNGLETTATYDEANQEFIINSPTWNSQKYWPGNISRHGQMATVFARLILRGVDKGIHAFVVPIRGEKSNQYPYGKLCDGVEVRDISLKDAYNGIDNGGLLLKNVRIPRENMLDRFSQVDAQGQYHSNIPPNRHFAMTMSVFFIGRACLSLNSLAFTKAGLSIAVNYAKNRHQFGATTKSKQELPIIAYSTTHRRLIPYIARTYALDMAHKTIADLIPTYPKETIHSYTSGFKAITSWAAVEALQSCREVMGGQGFRLCNRVSMLRNHADLVTTGEGDNTVLTQQVAKYLLGLYHQVVKGSKKSVEHLSFKGELAYINNLTAQPPTPNTNANQLSNISYHQWLLEKREFLLIKELHSRLYGRHDDELIEPNTERWFTVWNQSLPLCIRITKANVDRLTQSFFLKKIVEQSGSNLVDTATLTMLKNLCRLDSLVQIQKDFGFFVNTGLMSGESKWIQLEDEITHLSRDISQHASVLTQAFSIPNKFNPLQNSIE

SEQ ID NO: 2433 - protein, 728 aa, Trypanosoma brucei; identical to SEQ ID NO: 2327

SEQ ID NO: 2434 - protein, 663 aa, Dictyostelium purpureum; identical to SEQ ID NO: 2432

SEQ ID NO: 2435 - protein, 728 aa, Trypanosoma brucei
MMCKGLFSKLPPNIVYRFLYANTGLKSCCWKAPLTAQRRTFHRSPQLHFELNPSQQMYSMEHAFEEPTFRFICEGIDIDYKEEVRRALMEVLPRNPSNFVVRDDLPQSQGSSVQRTVQLLRAIAKKRLLSFAQVNSTPHLFCTFYEVIAMCCTPLALLAADHFTFAAMIALYGSKEMKALLLDHVDSCHIVGAIAHRELIAEGVPLNTEARYNRGENVFVLRGSGKFAVVGAVCADWAIVTATLTLNKDDNMGIHAFAVQLREGGVLKKGVSARPINGENEAMTAAGVGVLHFENVTIPVTSLLLPSEIVDGKLVFAGGAATLTSVQALTRQMRLASGALYVGTLKRSLTNIVRYVAQKWMVGPDGRRNYPVFGVQHVQSPLVKLLCTSYVYMTLWRRVLPAFTKPEAQPADYEDEMKLAGTLYFLTDNLSTLKSFADDFMDVHSSLRSTGTCDVLLTVQMRRDGLDHSSLIREVAFKSVVKNVGTTHWGWWLSSCFQSFAALDRFVKNPFYSPRIADLGRHRIFFSHKHYREKKRLRQSREIERRKGGSEHQWYDWVMFRHEQVVHCGEAYMEMFALEVMMDETQACTDPRARKILRDMGWIFALSRQQDRLDYFLTQQMMSPSKSCILSSHLDNIVTVMAPQCVNLVDAFQVPRALRAPCAAEDMESYWTIPGTDTGIQRGDKVLLFGDRKPFGNTKAEQEKMEESREDFDLFHGLAGKQSFAQEK

SEQ ID NO: 2436 - protein, 722 aa, Drosophila pseudoobscura
MASTEDGHSAVNQINEILTSLSDYYSEADNGQQVGNIFDDKKIFPEFRSGPLDVYRQKASFCYKRMNVLLEGEEHIRLKHKVWQWMEQHPDYQREPEVATLERTRELANKRQHLLWEQHFFGVNEYLGTPHLLLAFGQAIFSYDFSSSVKFGLSNGMFPSTLVSNGSGRLGKYIAKISDNRILGAYALTEFSHGTNALGMRTRATYDLKTKEFIIHTPDFEASKCWVGNLGKTCTHAIVYAQLFVPDDKHQGLQAFLVPIRDERTLLPFPGVTVGDMGEKIGLNGIDNGFVSFNQYRIPKANLLSKAGDIDAQGNYNSPIKDERKRLGASLGALSQGRVNITAITYVALSKAVSIATRYGASRRQFGPNNSQTEWPVIEYQSQQYRLIPHLATTIALRVATLWIGKENVDMTMKGFTGEDTSKAGMEIHAISSALKPVATWAARDGIQECREACGGHGYLKAAGLGDLRNDNDANCTYEGENNTLIQQASNWLISLRRGNADFKAVSPLETVSFLSDINSILQTKAEERTPAQALDANNLLKALNWLTAWQLETTVKRAEQLQREGKDAFETRNNIQVFAAQKLSIIYGERTIYYVFYKFVNSLPASAEKQVLQQLLSFYGAHLVTKYSAIFYQGGYFRDSPHIELYQQGILQLLPILKDEAIALIDAIAPTDFILNSPLGMSDGNVYQHLQKTIVSTPGVFERPEWWRDVTYKDYLKRAKL

SEQ ID NO: 2437 - protein, 693 aa, Drosophila sechellia
MASEDTSFIPDLPSGGPLAVYRKRANFDWKRLRLIFEKEQGLRIKYKVWRRLENDPLFAHPSRTLPMDEQKRLCAMQVNRMKYLDLVPKEIESLSFSAKTKYLMYINEALACYSPSLSVKIALGVGLFNNAIRAMGTEKHQKYIEAAWNREVITCLAITELSHGSNTKSIRTTATYDPTTQEFVINTPDFEAAKCWVGNLGKTATVAMTFANLYTADGQNHGLHGFLIPIRDPKTLLSYPGVLVGDIGEKCGLNGIDNGFVVFTNYRIPRDNLLNRTSDVTPEGVYESVFTEPGKVLGAALESFSAGRIGIMQESANTLCSAAVIAVRYSAVRKQFGPERQGEEMAILEYQLHQYRIFPYLAAACVQKIATEELTITYMEIIARSQADSNGFDVLTQNAAEIHALISSSKPLITWAARDAIQEAREACGGHGYLAAAKLGQMRTDHDPLCTYEGDNNVLGQQASNWLLRQWSAKELETPIGSVKFLERRSELPALNYASLVQKTPITSWQFSLRCYEWLLCHLMAKTTAHIEGQLAAGSSKFEARNNSQVAGARELSLAYAEYYALTRYVDHVSTLTVEAPYASVLRLLFDVYAMWLLEKHMTTFYVGGFAAGRDFSAAVRQLLLDSCLKLKDVAVSVADAISPPDFALNSVIARTDGLLYENLQNEFMTNEGAFQRPSWWRDVIIPQAQSKL

SEQ ID NO: 2438 - protein, 703 aa, Drosophila sechellia
MVALSTNGRREEKAVANIYDDKRIFPDFRSGPLEEYRERASFCYKRMNVVLEGEDHIRLKHKVWQWMEQHPDYQREPGSDLERTREMANKRQHLLWEQQFYGVNEYLGTPHLLLAFGQAIFSYDFSTSVKFGLSTGMFPSTLVSNGSGRLGKYVAKIADNRILGAYALTEISHGTNALGMRTRATYDVKREEFIIHTPDFEAAKCWVGNLGKTCTHAIVYAQLYVPDDKHQGLQAFLVPIRDERTLLPFPGVTVGDMGEKIGLNGIDNGFVMFNQYRIPKANLLSKTGDIDAQGNYTSKIKDERKRLGASLGALSVGRVNITAITYVALSKAVTIATRYAASRRQFGPTNSPAEWPVIEYQSQQYRLIPHLATAIALRVATLWIGKENVDLTMKGFSGEDTSQAGMEIHAISSALKPVATWAARDGIQECREACGGHGYLKSSGLGELRNDNDANCTYEGENNTLIQQASNWLISLRRNNADFVAVSPLETVSFLKDMDAILQSKGQERTPTEVLDPLNLLNALNWLTVWQLDTTVKRVEEQQREGKDAFETRNNIQVFAAQKLSVIYGERTIYYVFYKFVIGLPDSAEKKVLQQVLSFYGAHLVTKYSAAFYRGGYFRENSNQLELYEQGILALLPLLKNEAIALVDAIAPTDFILNSPLGMSDGNVYQHLQRTIVSTPGVYERPHWWRDVTYKDYLKRAKL

SEQ ID NO: 2439 - protein, 669 aa, Drosophila sechellia
MPSKPVNPDLQKERSTATFNTREFSVLWAGGEERFKEKKALEKMFLEDPALQDDLPISYLSHKELYEHSLRKACIIGEKIRKLRADGEDGVDTYNALLGGSLGAAILKEGNPLALHYVMFVPTIMGQGTMDQQVEWLSKAWDCEIIGTYAQTELGHGTFLRGLETRADYDASTQEFLINTPSLSAYKWWPGGLGHTANHAVVVAQLYTKGEFRGLAPFIVQLRDSDTHRPMPGIDIGDIGTKLGMKGVNNGYLGLKNVRVPLNNMLMKNQQVLPDGTYVAPKNSVLTYGTMMFVRCALIRDTAQSLAKASTIATRYSAVRRQSPIDPNQPEPQIMDHTTQQLKLFPQIARAIVFKTTGDGIWNMYNVISGEIEQGNLDRLPEMHALSCCLKAICSADAAAGVEMCRLSCGGHGYMDCSNFPTIYGMTTAVCTYEGENTVMLLQTARYLVKVYGQALNGEKLVPTVSYINDAINQTKFVNFDGTLTSIVKAFQFVAANKTRIAYEQIELRRKQGHGTEVAANLCGTFLTAAADLHGRAFLAQTAYTELLALSREVSPELAEVLKVVLELYLVDACLNRIGDFLRFIDLTDQDVTKLEVRLENCLKRLRPNAVSLVDSFDLHDRVLDSALGAYDGNVYEHIFESTKKNPLNKEPVNGAFHKYLKPFMKAHL

SEQ ID NO: 2440 - protein, 722 aa, Drosophila persimilis
MASTEDEHSAVNQINEILTSLSDYYSEADNGQQVGNIFDDKKIFPEFRSGPLDVYRQKASFCYKRMNVLLEGEEHIRLKHKVWQWMEQHPDYQREPEVATLERTRELANKRQHLLWEQHFFGVNEYLGTPHLLLAFGQAIFSYDFSSSVKFGLSNGMFPSTLVSNGSGRLGKYIAKISDNRILGAYALTEFSHGTNALGMRTRATYDLKTKEFIIHTPDFEASKCWVGNLGKTCTHAIVYAQLFVPDDKHQGLQAFLVPIRDERTLLPFPGVTVGDMGEKIGLNGIDNGFVSFNQYRIPKANLLSKAGDIDAQGNYNSPIKDERKRLGASLGALSQGRVNITAITYVALSKAVSIATRYGASRRQFGPNNSQTEWPVIEYQSQQYRLIPHLATTIALRVATLWIGKENVDMTMKGFTGEDTSKAGMEIHAISSALKPVATWAARDGIQECREACGGHGYLKAAGLGDLRNDNDANCTYEGENNTLIQQASNWLISLRRGNADFKAVSPLETVSFLSDINSILHTKAEERTPAQALDASNLLKALNWLTAWQLETTVKRAEQLQREGKDAFETRNNIQVFAAQKLSIIYGERTIYYVFYKFVNSLPASAEKQVLQQLLSFYGAHLVTKYSAIFYQGGYFSDSPHIELYQQGILQLLPILKDEAIALIDAIAPTDFILNSPLGMSDGNIYQHLQKTIVSTPGVFERPEWWRDVTYKDYLKRAKL

SEQ ID NO: 2441 - protein, 669 aa, Drosophila persimilis; identical to SEQ ID NO: 2366

SEQ ID NO: 2442 - protein, 697 aa, Drosophila persimilis; identical to SEQ ID NO: 2364

SEQ ID NO: 2443 - protein, 703 aa, Meyerozyma guilliermondii
MSATNSVSFAPPPDPASLLRRERENASIDPLAMHRFIEGSAEKSSQILRLYSSLERDPVMAASYRDYELDLEEQRELTTMRINRMTRYIETDTASDFARRLNLVTIYDPSMGIRISVNLGLFLNCIRGNGTSDQYEYWAKHHESAIMKQMYGCFGMTELGHGSNVAGCETTATFDKEKDEFVINTPHIGATKWWIGGAAHSATHSVVYARLLVDGKDYGVKTFVVPLRDSNHDLLPGISVGDIGAKMGREGVDNGWIQYSNVRIPRFFMLQKWCRVSAEGKVTLPPLEQLSYISLLGGRVMMAVDSYRMSARFITVALRYAVGRRQFKSQSTRDGKETQLLDYPLHQKRLLPYLALAYAMAVGSNKLEIQHGEIVANLEKAVANNDKKGIEQSIALTKSLFVDSGSLKSTYTWLTADCINEARQSCGGLGYSSYNGFGKTYGDWVVQCTWEGDNNVLGMSAGKTIINNLKLAVQKNKSISGSLSYLSRGRQGMSDKYVLGQDSDVESPEKVLEALETLIIRVAGTALNTLSDNGNDWDSISHTRVLLSKLQCHRYTLFTFIERVAENKDTQLEEALVLLLKLYYQVNILQAFAGEFLTYNVMSGQVQASVSLRAIPSTLTALRPHAIILSDSFQQPDMILNSAIGRYNGDIYENYYGVVKAANPPIRDKAPYSAAFQAMLNRPDLQTRERFEKWGAAKMKLSK

SEQ ID NO: 2444 - protein, 685 aa, Oryza sativa
MSSSPAASRRAAAIARHLAGIPAAKFASLLEPFSCLGYVPPESNEQPPAFALGDLRRLLDGHDLGVRDWMFRVMEQSTLFCSRHGGPGPAGRVFASPDFNKDKEGLREAKMRRIGYLARRGVFRGWLTDTEGDAEAELRRIALLDCIGVYDHSLAIKIGVHFFLWGSAIKFLGTKRHHDKWLSDTENYVIKGCFSMTELGHGSNVRGIETVATYDIKTREFVINTPCESAQKYWIGGAANHATHTIVFAQLHINGRNEGVHAFVAQIRDEHENVMPNIQIADCGHKIGLNGVDNGRIWFNNIRVPRENLLNLVADVLPDGQYVSTIDDPDQRFAAFLSPLTLGRVNIAVNAVYISKVGVAIAVRYALSRRAFSVTPDGPEMLLLDYPSHQRRLLPLLAKACLMSSAGNFMKRMYVKRTPELNKSIHIYSSALKATLTWQNMTTLQECREACGGQGLKTENRIGIFKAEFDVQSTFEGDNNVLMQQVSKALYAEFLTAKRKNQPFKGLGLEHLNGPCPVIPDYLTSGTLRSSSFQMDLLCLRERDLLKRFTTEVSNYLAQGENREKALMLSYQLAEDLARAFTERTILQIFLEDEKNIPTGSLKDILGLLRSLYVMVCIDESASFLRYGCLSRENVAAARKEVMTLCSELRPHALAIVSSFGIPDAFLSPLAFDWIEANARSSGNE

SEQ ID NO: 2445 - protein, 688 aa, Oryza sativa
MEPMSSSPAASRRAAAIARHLAGNPAAKFASLLEPFSCLGYVPPESNEQPPAFALGDLRRLLDGHDLGVRDWMFRVMEQSTLFCSRHGGPGPAGRVFASPDFNKDKEGLREATMRRIGYLARRGVFRGWLTDTEGDAEAELRRIALLDCIGVYDHSLAIKIGVHFFLWGSAIKFLGTKRHHDKWLSDTENYVIKGCFSMTELGHGSNVRGIETVATYDIKTREFVINTPCESAQKYWIGGAANHATHTIVFAQLHINGRNEGVHAFVAQIRDEHENVMPNIQIADCGHKIGLNGVDNGRIWFNNIRVPRENLLNLVADVLPDGQYVSTIDDPDQRFAAFLSPLTLGRVNIAVNAVYISKVGVAIAVRYALSRRAFSVTPDGPEMLLLDYPSHQRRLLPLLAKACLMSSAGNFMKRMYVKRTPELNKSIHIYSSALKATLTWQNMTTLQECREACGGQGLKTENRIGIFKAEFDVQSTFEGDNNVLMQQVSKALYAEFLTAKRKNQPFKGLGLEHLNGPCPVIPDYLTSGTLRSSSFQMDLLCLRERDLLKRFTTEVSNYLAQGENREKALMLSYQLAEDLARAFTERTILQIFLEDEKNIPTGSLKDILGLLRSLYVMVCIDESASFLRYGCLSRENVAAARKEVMTLCSELRPHALAIVSSFGIPDAFLSPLAFDWIEANARSSGNE

SEQ ID NO: 2446 - protein, 735 aa, Trypanosoma cruzi
MAAGMVFRGASRVATAAAANRSTQAAIVFPFASCGMLAGPICIQGRLFYRSFPLRLELNPSRNLYSMEHAFEEPTFRFICEGEDIDYREEVRAALLEVLAKKPSNFVGRTEETWMQENSPQRSVQLLRAVAKKQLLSFAQVKSTPRLFSAFFDVLASCSTSLALIAADHFTFAAMIAKHGTKEMQEAILDDVDTCRFIGTIAHRELIAEGVPLNSEARYDKDEKCFVLRGAGKFAVVGAGCADWAIVTATLTLNKQDNQGPQLFVVQLRERGVLRKGVSIRPMQGENPTMSASGVGILHFDDVRIAVSALLLPSRIVDGGVLITEDADTLTSLQALTLQMRLATAALYAGALKRFLTNVVFFIAQKDVVGPDGRRDYPFFGVQHVQTPLVKIIAKSYVYLADWRRILSVFSKPMERRPTYEDETRLAGTIHFLQETLLELHRFVDEFMGVHASLGSTGNIDAVVMAHLRQEGADQSSLIREVAFKSVTKNIGASHWGWWLTSLLQPFAALDRFVKNPFYSPRIADLGRHLIFFSHKHYSAKKRLRQSREIERRKGGAEHQWYDWVMFRHQQVLHCGEAYMEMFSMEVMMAETQACTDPRARKILRDIGWIYALARQQDRLDYILTQQMISPGKSNVLESHLDNLVTVLAPQCVNLVDAFQVPDAFRSPCAAKTLESYWTIPGTNTGIQRGDRVTLFHDKKPTGDAKEEQENMQESEEEWDLFHGLAELPSFAQKK

SEQ ID NO: 2447 - protein, 675 aa, Arabidopsis thaliana; identical to SEQ ID NO: 103

SEQ ID NO: 2448 - protein, 692 aa, Arabidopsis thaliana; identical to SEQ ID NO: 113

SEQ ID NO: 2449 - protein, 675 aa, Arabidopsis thaliana; identical to SEQ ID NO: 66

SEQ ID NO: 2450 - protein, 675 aa, Arabidopsis thaliana; identical to SEQ ID NO: 103

SEQ ID NO: 2451 - protein, 692 aa, Arabidopsis thaliana; identical to SEQ ID NO: 113

SEQ ID NO: 2452 - protein, 675 aa, Arabidopsis thaliana; identical to SEQ ID NO: 66

SEQ ID NO: 2453 - protein, 675 aa, Arabidopsis thaliana; identical to SEQ ID NO: 103

SEQ ID NO: 2454 - protein, 692 aa, Arabidopsis thaliana; identical to SEQ ID NO: 113

SEQ ID NO: 2455 - protein, 675 aa, Arabidopsis thaliana; identical to SEQ ID NO: 66

SEQ ID NO: 2456 - protein, 777 aa, Capsaspora owczarzaki
MTLTTTTTTATATTEAAELRRVAAVASALRGAGATVMTCDTTRDGHHATLTTANAASGSTGSNKTSNGKKKATTAADAAATIAGLPAWVGELRRELDGEFYELKDELRHFLDSTPLFDLRFGLSTAEQRKITQERALTIIQSKVVQSLFAEHIARKPGSLQKGWASGEIMGMTDLSVNVKLGVMTWLFGGAVMSLGSDELVAKWFAPLARGEFTGMFAMTEIGHGSNVRSIETLATYDPKTQEFVITTPHPYARKAYIGNALNGEYAVVFANLVPADGKSRGPHAFVVPMRSKDKVMYPGVSVWDMGEKEGLNGVDNGVISFSGARIPRDHLLNRFADVDAKGNYTTTIASDSKRFNAMLAALTGTRVALASSANCVMKVGLAIAIRYAARRRQFGPSPPKPKRGSKQAAPTTAPASGASSNPAAFAFSELEEGSVIPIPASVMTSTELPILAYQTHQTRLMPLLAASLAIANLARHAAKTLEKCAIEMQESNREVQALCAGLKAYSSWKCIESLQTARECCGGQGYLAENRLVGMRADTDIYVTFEGDNIVLLQQVAKELIAQYAAQFETGMFTGILSFFSNQVVLSLKTSRFAARSYPVSAPEFHVKALAFKEAKLLTLLAKRLLQRVKREKKDPFLAWNECLDHIVNLSTTHIERVCVEKFYASIATSKASPRVKEILSTAAQLHAASILYRDRAWYLEHNYMTTAHSCELRDIVLELSANFSRDALAVVEAFGIPDRCLHAPIAGVVSGTTAARNSWSYFSNALMDPSFAPRD

SEQ ID NO: 2457 - protein, 660 aa, Unknown; identical to SEQ ID NO: 396
  Description of Unknown: Acyl-CoA polypeptide

SEQ ID NO: 2458 - protein, 660 aa, Unknown [sequence omitted]

SEQ ID NO: 2459 - protein, 660 aa, Unknown [sequence omitted]

SEQ ID NO: 2460 - protein, 660 aa, Unknown [sequence omitted]

SEQ ID NO: 2461 - protein, 660 aa, Unknown [sequence omitted]

SEQ ID NO: 2462 - protein, 660 aa, Unknown [sequence omitted]

SEQ ID NO: 2463 - protein, 660 aa, Unknown; identical to SEQ ID NO: 346
  Description of Unknown: Acyl-CoA polypeptide

SEQ ID NO: 2464 - protein, 669 aa, Drosophila simulans
MPAKPVNPDLQKERSTATFNTREFSVLWAGGEERFKEKKALEKMFLEDPALQDDLPISYLSHKELYEHSLRKACIIGEKIRKLRADGEDGVDTYNALLGGSLGAAILKEGNPLALHYVMFVPTIMGQGTMDQQVEWLSKAWDCEIIGTYAQTELGHGTFLRGLETRADYDASTQEFVINTPSLSAYKWWPGGLGHTANHAVVVAQLYTKGEFRGLAPFIVQLRDSDTHRPMPGIDIGDIGTKLGMKGVNNGYLGLKNVRVPLNNMLMKNQQVLPDGTYVAPKNSVLTYGTMMFVRCALIRDTAQSLAKASTIATRYSAVRRQSPIDPNQPEPQIMDHTTQQLKLFPQIAKAIVFKTTGDGIWNMYNVISGEIEQGNLDRLPEMHALSCCLKAICSADAAAGVETCRLSCGGHGYMDCSNFPTIYGMTTAVCTYEGENTVMLLQTARYLVKVYGQALNGEKLVPTVSYISDAINQTKFVNFDGSLRSIVKAFQFVAANKTRIAYEQIELRRKQGHGTEVAANLCGTFLTAAADLHGRAFLAQTAYTELLALSREVSPELAEVLKVVLELYLVDACLNRIGDFLRFIDLTDQDVTKLEVRLENCLKRLRPNAVSLVDSFDLHDRVLDSALGAYDGNVYEHIFESTKKNPLNKEPVNGAFHKYLKPFMKAHL

SEQ ID NO: 2465 - protein, 669 aa, Drosophila willistoni
MPEQKINPDLQKERNTATFNTHEFSVFWAGGEDKYKEKKALEKMFLEDPALEDDLPISYLSHKELYEHSLRKACLIGEKIRKLRADGEDGVDTYNALLGGSLGAAILKEGNPLALHYVMFVPTIMGQGTMDQQVEWLSKAWDCEIIGTYAQTELGHGTFLRGLETRADYDANTQEFVINTPSLSAYKWWPGGLGHTANHAVVVAQLYTKGEFRGLAPFIVQLRHSETHEPMPGIDIGDIGTKLGMKAVNNGYLGLKNVRVPLNNMLMKNQQVLADGTYVAPKNTVLTYGTMMFVRCALIRDTAQSLAKSSTIATRYSAVRRQSPIDPNQPEPQIMDHTTQQLKLFPQIAKAIVFKTTGDGIWNMYNVLSGEIEQGNLDRLPEMHALSCCLKAICSADAAAGVETCRLSCGGHGYMDCSNFPTIYGMTTAVCTYEGENTVMLLQTARYLVKVYGQALNGEQLVPTVAYINDAVKAKTFANFDGSLESIVKAFQFVAANKVRIAYEQIESRRKQGHSTEVSANLSGIFLTAAADLHGRAFLAQSAYTELVTVSGQVSPALADVLKVVLELYLVDACLSRIGDFLRFIDLTDEDVTKLEVRLETCLKKLRPNAVALVDSFDLHDRVLDSALGAYDGNVYEHIFESTKKNPLNKEPVNKGFHKYLKPFMKAHL

SEQ ID NO: 2466 - protein, 695 aa, Drosophila willistoni
MSNTDTSFIPDLPLGGPLAHYRKRANFDWKRLRLIFEKEQGLRIKYKVWRRLENDPLFAHPSRTLPMDEQKRLCAMQVNRMKHLDLVPKEIESLSFSAKTQYLMYINEALACYSPSLSVKIALGVGLFNNAIRAMGTEKHQKYIEAAWNREVITCLAITELSHGSNTKRIRTTATYDPSTQEFIINTPDFEAAKCWVGNLGKMATVAMTFANLYTADGENHGLHGFLIPIRDPKTLLSYPGVLVGDIGEKCGLNGIDNGFVVFSNYRIPRDNLLNRTSDVTPEGVYESVFDEPGKVLGAALESFSAGRIGIMQESANTLCSAAVIAVRYAAVRKQFGPERQGEESAILEYQLHQYRIFPFLAAACVQKIAVQELTQTYLEIIARSQADSNGFDVLTQNAAEIHALISASKPRITWSARDAIQEAREACGGHGYLRAAKLGQMRTDHDPLCTYEGDNNVLGQQASNWLLRQWSAKELESPIGSVKFLERRQHLLSLKYDQLVQQTPIKTWQFAITCYEWLLCHLMSHTTAHIEGQLAAGANKFDARNNSQVAGAKELSLAYAEYFALSRYAEHVRQLKVEAPYARVLRLVYDVYAMWLLEQHMTTFYVGGFAVGQSFAGSVRELLLASCLQMKEFAVSIADAIAPPDFALNSVIARSDGRLYENLQNEFMTNEGAFQRPSWWRDVIIPQPAEKSKL

SEQ ID NO: 2467 - protein, 722 aa, Drosophila virilis
MDNEQSEGLAPANHLSDILKSLTDYYSGKQNVEPKNIYEDKKIFPNFRSGPLEEYRQKASFCYKRMNVLLEGEEHIRLKHKVWQWMEQHPDYQREPEAPNLERTRELANKRHHLLWEQKFFGVNEYLTSPHLLLAFGQAIFSYDFSFSVKFGLSNGMFPSTLVSNGTGRLGKYVAKISDNRILGAYALTEISHGTNANGMRTRATYDVKTQEFVIHTPDFEAAKCWVGNLGKTCTHAIVYAQLYVPDDKHQGLNAFLVPIRDERTLLPFPGVTVGDLGEKIGLNGIDNGFVMFNQYRIPKANLLSKTGDIDAQGNYSSPIKDQRKRLGASLGALSTGRVNITAITYVALSKAVCIATRYSASRRQFGPSDSQLEWPVIEYQSQQYRLMPHLAATIALRVATLWIGKANVDMTIRGMMGEDTSKEGMEIHAISSAMKPCATWAARDGIQECREACGGHGYLRASGLGDLRNDNDANCTYEGENNTLIQQASNWLISLRRSNANFVDVSPLQTVSFLNDMNAILQTQGQEHNAAHALDVHNLLKALNWLTAWQLDATVKRVEQQQFAGKDAFETRNNIQVFAAQQLSIIYAERTIYYVFYKFVNNLPASAEQQVLLKLLSFYGANLVTKYSALFYQGGYFRNSSHIELYQQGILELLPVLKNEAIALVDAIAPTDFILNSPLGMSDGNVYQHLQRTIVSTPGVYERPYWWRDVTYKNYLQRAKL

SEQ ID NO: 2468 - protein, 669 aa, Drosophila virilis
MPALEVNPDLQKERNTATFDPKEFSIFWAGGADKYKEKKALEKMFLEDPEMKDDLPTSYLSHKELYENSLRKACLIGEKIRKLRADGEDGVDTYNALLGGSLGAAILKEGNPISLHYIMFVPTIMGQGTMEQQVEWLSKAWDCEIIGTYAQTELGHGTFLRGLETRADYDASTKEFVINTPSLSAYKWWPGGLGHTANHAVVVAQLYTKGEFRGLAPFIVQLRDTETHMPMPGIDIGDIGTKLGMKGVNNGYLGLKNVRVPLNNMLMKNQQVLPDGTYVAPKNSVLTYGTMMFVRCALIRDTAQSLAKASTIATRYAAVRRQSPIDPKEPEPQIMEHTTQQLKLFPQIAKAIVFKTTGDGIWNMYNVLSGEIELGNLDRLPEMHALSCCLKAICSADAAAGVETCRLSCGGHGYMDCSNFPTIYGMTTAVCTYEGENTVMLLQTARYLVKVYGQALSGDQLVPTVAYINEAIKQKEFVYFDGSLESIVKAFQFVAANKVRVAYEQIEQRRRQGHSTEVAANLSGVFLTGAADLHGRAFLAQSAYTELMAVSRQVSPALADVLMVVLELYLVDACLNRIGDFLRFIELTDADVTKLEVRLESCLKRLRPNAIALVDSFDLHDRVLDSALGAYDGNVYEHIFESTKKNPLNKEPVNAGFHKYLKPFMKAHL

SEQ ID NO: 2469 - protein, 698 aa, Drosophila mojavensis
MDSIDKVDTSFIPDLPTGGGLAVYRKRANFDWKRLRLIFETEQGLRIKYNVWRRLESDPLFAHASRTLPMDEQKRVVAMQVNSMKQMDLVPKEIESLNFSSKTKYLMYINEALNSYSPSLSVKIALGVGLFNNAIRALGTEKHTKYIDAAWNREIITCLAVTEVSHGSNTKRIRTTATYDPSSQEFVINTPDFEAAKCWVGNLGKMATVAVTFANLITADGENHGLHGFLVPVRDPKTLMPYPGVLVGDIGEKSGLNGIDNGFVVFTNYRIPRDNHLNRTGNVTPEGVYESVFTDPGQALGAALESFSAGRIGIMQESANTLCSAAVIAVRYAAVRKQFGPEREGEEMPIIEYQLHQYRIFPYLACACVQKIAVEELTNIYLQIIARSQADSNGFDILTQNAAEIHAIISASKPRITWSARDAIQEAREACGGHGYLNASKLGQMRSDHDPLCTYEGDNNVLGQQASNWLLRQWSAKELESPIGSVTFLQRREALLQLRFAQLRQQSPLDSWEFALSCYEWLLCHLMAHTTAHIEAQLAAGVHRFEARNNSQVRGARELSLAYAEYFALRSFVAHVRQLRLEQPYAQVLRTLYDVYALWLLESHMTTFYVGGFAVGGEFASAVQQRLLQSCAQLKDVAVSVADAIAPPDFALNSVIARADGLLYENLQNEFMTNEGAFQRPAWWRDVIISQGQEKSKL

SEQ ID NO: 2470 - protein, 669 aa, Drosophila mojavensis
MPALEVNPDLQKERNTATFDPQEFSIFWAGGVEKYKEKKALEKLFLEDPALMDKLPTSYMSHKELYEDSLRKACLIGEKIRKLRADGEDGVDTYAALLGGSLGAALLKEGNPMSLHYVMFVPTIMGQGTMEQQVEWLPKAWDCEIIGTYAQTELGHGTFLRGLETRADYDASTQEFVINTPTMTAYKWWPGGLGHTANYAVVVAQLYTKGEFRGLAPFIVQLRHMETHQPMPGIDIGDIGTKLSMKGVNNGYLGLKNVRVPLNHMLMKNQQVLPDGTYVAPKNSVLTYGTMMFVRCVLIRDTAHSLAKASTIATRYSAVRRQSPIDPKEPEPQIMDHTTQQLKVFPQISKAIVFKIAGDTIWNMYNVLSGELEQGNLERLPEMHALACCLKAICSADASAGVEICRLSCGGHGFMDCSNFPAIYGMTTAVCTYEGENTVMLLQTARYLVKVYGQALAGEKLVPTVAYINEAIKLKQFVNFDCTLESIVKAFQFVAANKTRVAYEQIEMRRRQGHSTEVAANLSGIFLTGAADLHGRAFLAQTAYTELTAISKQVSPALADVLKVVLELYLVDACLNRIGDFLRFIEFTDADVTKLEMRLESCLKRLRPNAVALVDSFDLHDRVLDSALGAYDGKVYDHIFESIKKNPLNKEPVNESFHKYLKPFMKAHL

SEQ ID NO: 2471 - protein, 669 aa, Drosophila grimshawi
MPAMEVNPDLQKERNTATFDPNEFSVFWAGGADKYKEKKALEKMFLEDPALNDEVPTSYMSHKELYENSLRKACLIGEKIRELRANGEDGVDTYNALLGGSLGAALVKEGNPIALHYVMFVPTIMGQGSMEQQVEWLSKAWDCEIIGTYAQTELGHGTFLRGLETRADYDAQTQQFVINTPTLSAYKWWPGGLGHTANHAVVVAQLYTKGEFRGLAPFIVQLRDTDTHMPLPGIDIGDIGTKLGMKAVNNGYLGLKNVRVPLNNMLMKNQQVLPDGTYVAPKNSVLTYGTMMFVRCALIRDTAQSLAKASTIATRYSAVRRQSPIDPKEPEPQIMEHTTQQLKLFPQIAKAIVFKTTGDGIWNMYNVLSGEIELGNLDRLPEMHALSCCLKAICSADAAAGVETCRLSCGGHGYMDCSNFPTIYGMTTAVCTYEGENTVMLLQTARYLVKVYGQALSGDELVPTVAYINEAIKLKYFVNFDGSLESIVKAFQFVAANKVRVAYEQIEQRRRQGHCTEVAANLSGVFLTGAADLHGRAFLAESAYKELMAVSKTVSPALADVLKVVLELYLVDACLNRIGDFLRFIDLTDADVTKLEMRLESCLKRLRPNAVALVDSFDLHDRVLDSALGAYDGNVYDHIFESTKKNPLNKEPVNEAFHKYLKPFMKAHL

SEQ ID NO: 2472 - protein, 703 aa, Drosophila erecta
MVALSTHGRREEKAVANIYDDKRIFPDFRGGPLDEYRQRASFCYKRMNVVLEGEDHIRLKHKVWQWMEQHPDYQRESGTDLERTREMANKRQHLLWEQQFYGVNEYLGTPHLLLAFGQAIFSYDFSTSVKFGLSTGMFPSTLVSNGSGRLGKYVAKIADNRILGAYALTEISHGTNALGMRTRATYDVKRQEFIIHTPDFEAAKCWVGNLGKTCTHAIVYAQLYVPDEKHQGLQAFLVPIRDERTLLPFPGVTVGDMGEKIGLNGIDNGFVMFNQYRIPKANLLSKTGDIDAQGNYTSQIKDERKRLGASLGALSVGRVNITAITYVALSKAVTIATRYAASRRQFGPTNSPAEWPVIEYQSQQYRLIPHLATTIALRVATLWIGKENMDLTMKGFTGEDTSQAGMEIHAISSALKPVATWAARDGIQECREACGGHGYLKSSGLGELRNDNDANCTYEGENNTLIQQASNWLISLRRNNADFVAVSPLETVSFLKDMDAILQTKGQERTPAEVLDPHNLLNALNWLTVWTLDTTVKRVEEQHREGKDAFETRNNIQVFAAQKLSVIYGERTIYYVFYKFVIGLPDSAEKKVLQQVLSFYGAHLVTKYSASFYRGGYFRQNSNQLELYEQGILALLPLLKNEAIALVDAIAPTDFILNSPLGMSDGNVYQHLQRTIVSTPGVYERPHWWRDVTYKDYLKRAKL

SEQ ID NO: 2473 - protein, 669 aa, Drosophila erecta
MPAKPVNPDIQKERNTATFNCREFSVLWAGGEERFKEKKALEKMFLEDPALQDDLPISYLSHKELYEHSLRKACIIGEKIRKLRADGEDGVDTYNALLGGSLGAAILKEGNPLALHYVMFVPTIMGQGTMDQQVEWLSKAWDCEIIGTYAQTELGHGTFLRGLETRADYDASTQEFVINTPSLSAYKWWPGGLGHTANHAVVVAQLYTKGEFRGLAPFIVQLRDSDTHRPMPGIDIGDIGTKLGMKGVNNGYLGLKNVRVPLKNMLMKNQQVLADGTYVAPKNSVLTYGTMMFVRCALIRDTAQSLAKASTIATRYSAVRRQSPIDPNQPEPQIMDHTTQQLKLFPQIAKAIVFKTTGDGIWNMYNVISGEIEQGNLDRLPEMHALSCCLKAICSADAAAGVETCRLSCGGHGYMDCSNFPTIYGMTTAVCTYEGENTVMLLQTARYLVKVYGQALNGEKLVPTVSYISDAVNQTKFANFDGSLRSIVKAFQFVAANKTRIAYEQIELRRKQGHGTEVAANLCGTFLTAAADLHGRAFLAQTAYTELSAMSREVSPGLAEVLQVVLELYLVDACLNRIGDFLRFIDLTDQDVTKLEVRLENCLKRLRPNAVSLVDSFDLHDRVLDSALGAYDGNVYEHIFESTKKNPLNKEPVNGAFHKYLKPFMKAHL

SEQ ID NO: 2474 - protein, 693 aa, Drosophila erecta
MASEDTSFIPDLPSGGPLAAYRKRANFDWKRLRLIFEKEQGLRIKYKVWRRLENDPLFAHPSRTLPMDEQKRLCAMQVNRMKHLDLVPKEIESLSFSAKTKYLMYINEALACYSPSLSVKIALGVGLFNNAIRAMGTEKHQKYIEAAWNREVITCLAITELSHGSNTKSIRTTATYDPSTQEFVINTPDFEAAKCWVGNLGKMATVAMTFANLYTADGQNHGLHGFLIPIRDPKTLLSYPGVLVGDIGEKCGLNGIDNGFVVFTNYRIPRDNLLNRTSDVTPEGAYESVFTEPGKVLGAALESFSAGRIGIMQESANTLCSAAVIAVRYSAVRKQFGPERQGEEMAILEYQLHQYRIFPYLAAACVQKIATEELTTTYMEIIARSQADSNGFDVLTQNAAEIHALISSSKPLITWAARDAIQEAREACGGHGYLAAAKLGQMRTDHDPLCTYEGDNNVLGQQASNWLLRQWGAKQLETPIGSVKFLERRKELLALNYASLVQRTPVTSWQFSLRCYEWLLCHLMAKTTAHIEGQLAAGSSKFEARNNSQVAGARELSLAYAEYYALTRYVDHVSTLTVEASYAAVLRLLFDVYAMWLLEKHMTTFYVGGFAAGRDFSAAVRQLLLDSCLKLKDVAVSVADAISPPDFALNSVIARADGLLYENLQNEFMTNEGAFQRPSWWRDVIIPQAQSKL

SEQ ID NO: 2475 - protein, 669 aa, Drosophila yakuba
MPAKPVNPDLQKERNTATFDVREFSVLWAGGEERFKEKKALEKMFLEDPALQDDLPISYLSHKELYEHSLRKACIIGEKIRKLRADGEDGVDTYNALLGGSLGAAILKEGNPLALHYVMFVPTIMGQGTMDQQVEWLSKAWDCEIIGTYAQTELGHGTFLRGLETRADYDASTQEFVINTPSLSAYKWWPGGLGHTANHAVVVAQLYTKGEFRGLAPFIVQLRDSDSHRPMPGIDIGDIGTKLGMKGVNNGYLGLKNVRVPLNNMLMKNQQVLPDGTYVAPKNSVLTYGTMMFVRCALIRDTAQSLAKASTIATRYSAVRRQSPIDPNQPEPQIMDHTTQQLKLFPQIAKAIVFKTTGDGIWNMYNVISGEIEQGNLDRLPEMHALSCCLKAICSADAAAGVETCRLSCGGHGYMDCSNFPTIYGMTTAVCTYEGENTVMLLQTARYLVKVYGQALNGEKLVPTVSYISDAINQSKFVNFDGSLRSIVKAFQFVAANKTRIAYEQIELRRKQGHGTEVSANLCGTFLTAAADLHGRAFLAQTAYTELTALSREVSPELAEVLKVVLELYLVDACLNRIGDFLRFIDLTDQDVTQLEVRLENCLKRLRPNAVSLVDSFDLHDRVLDSALGAYDGNVYEHIFESTKKNPLNKEPVNGAFHKYLKPFMKAHL

SEQ ID NO: 2476 - protein, 693 aa, Drosophila yakuba
MANEDTSFIPDLPSGGPLAAYRKRANFDWKRLRLIFEKEQGLRIKYKVWRRLENDPLFAHPSRTLPMDEQKRLCAMQVNRMKHLDLVPKEIESLSFSAKTKYLMYINEALACYSPSLSVKIALGVGLFNNAIRAMGTEKHQKYIEAAWNREVITCLAITELSHGSNTKSIRTTATYDPTTQEFVINTPDFEAAKCWVGNLGKMATVAMTFANLYTADGQNHGLHGFLIPIRDPKTLLSYPGVLVGDIGEKCGLNGIDNGFVVFTNYRIPRDNLLNRTSDVTPEGVYESVFTEPGKVLGAALESFSAGRIGIMQESANTLCSAAVIAVRYSAVRKQFGPERQGEEMAILEYQLHQYRIFPYLAAACVQKIATEELTITYMEIIARSQADSNGFDVLTQNAAEIHALISSSKPLITWAARDAIQEAREACGGHGYLAAAKLGQMRTDHDPLCTYEGDNNVLGQQASNWLLRQWSAKELETPIGSVKFLEQRNDLLALNYASLVQRTPITSWQFSLKCYEWLLCHLMAKTTAHIDGQLAAGSSKFEARNNSQVAGARELSLAYAEYYALTRYVDHVSTLTVEAPYASVLHLLFDVYAMWLLEKHMTTFYVGGFAAGRDFSAAVRQLLLDSCLKLKDVAVSVADAIAPPDFALNSVIARADGLLYENLQNEFMTNEGAFQRPSWWRDVIIPQAQSKL

SEQ ID NO: 2477 - protein, 703 aa, Drosophila yakuba
MVALSTHGRREEKEVANIYDDKRIFPDFRGGPLDEYRERASFCYKRMNVVLEGEDHIRLKHKVWQWMEKHPDYQRESGSDLERTRELANKRQHLLWEQQFYGVNEYLGTPHLLLAFGQAIFSYDFSTSVKFGLSTGMFPSTLVSNGSGRLGKYVAKIADNRILGAYALTEISHGTNALGMRTRATYDVKRQEFIINTPDFEAAKCWVGNLGKTCTHAIVYAQLYVPDDKHQGLQAFLVPIRDERTLLPFPGVTVGDMGEKIGLNGIDNGFVMFNQYRIPKANLLSKTGDIDAQGNYTSQIKDERKRLGASLGALSVGRVNITAITYVALSKAVTIATRYAASRRQFGPTNSPAEWPVIEYQSQQYRLIPHLATTIALRVATLWIGKENVDLTMKGFTGEDTSQAGMEIHAISSALKPVATWAARDGIQECREACGGHGYLKSSGLGELRNDNDANCTYEGENNTLIQQASNWLISLRRNNADFVAVSPLETVSFLKDMDAILQSKGQERTPAEVLDPHNLLNALNWLTVWQLDTTVKRVEEQQREGKDAFETRNNIQVFAAQKLSVIYGERTIYYVFYKFVIGLPDSAEKKVLQQVLSFYGAHLVTKYSAAFYRGGYFRENSNQLELYEQGILALLPLLKNEAIALVDAIAPTDFILNSPLGMSDGNVYQHLQRTIVSTPGVYERPHWWRDVTYKDYLKRAKL

SEQ ID NO: 2478 - protein, 669 aa, Drosophila ananassae
MPAKEVNPDLQKERNTATFNPHEFSVFWAGGEDRYKEKKALEKMFLEDPALQDDLPISYLSHKELYEHSLRKACIIGEKIRKLRADGEDGVDTYNALLGGSLGAAILKEGNPLALHYVMFVPTIMGQGTMEQQVEWLSKAWDCEIIGTYAQTELGHGTFLRGLETRADYDPKTQEFVINTPTLSAYKWWPGGLGHTANHAVVVAQLYTKGEFRGLAPFIVQLRDSDTHKPMPGIDIGDIGTKLGMKAVNNGYLGLKNVRVPLNNMLMKNQQVLPDGTYVAPKNSVLTYGTMMFVRCALIRDTAQSLAKSSTIATRYSAVRRQSPIDPNQPEPQIMDHTTQQLKLFPQIAKAIVFKTTGDGIWNMYNVISGEIEQGNLDRLPEMHALSCCLKAVCSADAAAGVETCRLSCGGHGFMDCSNFPTIYGMTTAVCTYEGENTVMLLQTARYLVKVYGQALNGEKLVPTVAYINEALSQQKFVNFDGSLESIVKAFQFVAANKTRIAYEQIELRRKQGHGTEVAANLCGTFLTAAADLHARAFLAQSAYTELLAVSREVSPALGDVLKVVLELYLVDACLNRIGDFLRFIDLTDQDVTKLEVRLESCLKRLRPNAVALVDSFDLHDRVLDSALGAYDGNVYEHIFESTKKNPLNKEPVNGSFHKYLKPFMKAHL

SEQ ID NO: 2479 - protein, 691 aa, Drosophila ananassae
MANEDTSFIPDLPSGGPLAAYRKRANFDWKRLRLIFEKEQGLRIKYKVWRRLENDPLFAHPSRTLPMDEQKRLCAMQVNRMKHLDLVPKEIEKLSFSAKTKYLMYINEALACYSPSLSVKIALGVGLFNNAIRAMGTEKHTKYIEAAWNREVITCLAITELSHGSNTKSIRTTATYDPSTQEFVINTPDFEAAKCWVGNLGKTATVAMTFANLYTADGQNHGLHGFLIPIRDPKTLLSYPGVLVGDIGEKCGLNGIDNGFVVFTNYRIPRDNLLNRTSDVSPEGVYESVFTEPGKVLGAALESFSAGRIGIMQESANTLCSAAVIAVRYAAVRKQFGPERQGEEMAILEYQLHQYRIFPYLAAACVQKIAVEELTFTYLEIIARSQADSNGFDILTQNAAEIHALISASKPRITWAARDAIQEAREACGGHGYLAAAKLGQMRTDHDPLCTYEGDNNVLGQQASNWLLRQWSSKELETPIGSVKFLEQRGELLALKYPSLAQKTPISSWEFSLRCYEWLLCHLMAHTTAHVEAQLAAGGSKFDARNNSQVAGARELSLAYAEYYALSRYVDHVRKLQVEDSYASVLRLLFDVYAMWLLEKHMTTFYVGGFATGQDFAAAVRQLLLDSCLKLKDVAVSIADAIAPPDFALNSVIARADGLLYENLQNEFMTNEGAFQRPTWWRDVILPQSKL

SEQ ID NO: 2480 - protein, 686 aa, Providencia stuartii
MQQLTSYITGKWLYGEGEGRKIYHALTGQALYEVTTAGLPLVDCLDYGRKKGGDALSAMTFQQRGQMLKAVAKYLLEHKASLYEISAQTGATKADSWVDIEGGIATLFSFAGLANRELPDDTIWPEDEMIPLSKQGQFIARHILTSRHGVALHINAFNFPCWGMLEKLAPTWLAGMPAIIKPATASAQVTQAMVRLIVESGLVPEGAIQLICGGIGDMFEYLDFEDVVTFTGSAATGQKLKSHPRLREKSIPFTMEADSLNCAILGVDVTPEQPEFSLFIKEVTREMTVKAGQKCTAIRRIIVPKPQLETVKQALLKRLSGITVGDPAVEGVRMGALINQEQRDDVHEKVMYLQQNGCEILCGGDLQELNVMGADSQKGAFYPPTLLYCADPYTNQAVHETEAFGPVATLIGYETSDQAVELAIMGGGSLAGTLVTADTSVAQDVIRRSARAHGRMLILNEASAAESTGHGSPLPLLVHGGPGRAGGGEELGGLRAVKHYMQRTAIQGSPSMLTAVTKQWIRGADVVTDQVHPFRKYFEDLVIGDTLLTARRTVSEADLVNFACLSGDHFYAHMDKIGAAQSLFGERVAHGYFVVSAAAGLFVDAAVGPVIANYGMENLRFIEPVKIGDTIQVRLTCKKKIKKAQKTAEDKPNGVVEWDVQVFNQNNVAVALYSILTLVERREGDF

SEQ ID NO: 2481 - protein, 626 aa, Oikopleura dioica
MTRLSRVRFSKSPAALRAQWSKAVPVKDLQKIIDHDNHEMRANFREFLKQDTFRPKYAITLAEERQLALDRLQMVCSNDFLSVRDFATNPHRIFAAHELMAMIDPATTTKMTVQFNLFGGTVFRLGTERHHHLLDGIDNLTDIGCFGLTEVGFGNNAVEMETTAVYNKKDDTITINCPSELSHKYWITNGALHAQHCVVFAQLNVDGEEHGVHAILVPIREGVAGEPLEGCTINDMGHRMGLNGVDNALLSFKNVKVPRTNLLNKYSDIDESGKFHSAIKSKRGRFLSVADQLLSGRICIAAMSQGGAKAALSVAVRYAITRLTVGPAGKSDFPIMKYQLQQRAIAPLLARTVSLGIALDDVKDEWFKINSENIEDKVRVMNMVTACCVIKPLCSWNLERTASIARERCGGAGYLSCSRFGTMIGLAHAAMTAEGDNSVLMNKVAKEQLGLFIPRKVVVPEFDLKSNNFIHALMKANEVNKFAALGGAMMRAGKGAIFETWSLLNQDLVQAAAHAYGERIVSESMINAISKNPAASEVLDAIFKLHAVNTIQNNLSDLILSGLISVDNAQAVREEFNSLAATVSELSPDICESFGIPEELLSAPIARDWHAFNQHDNRGEVQPGVF

SEQ ID NO: 2482 - protein, 626 aa, Oikopleura dioica
MTRLSRVRFSKSPAALRAQWSKAVPVKDLQKIIDHDNHEMRASFREFLKQDTFRPKYAITLAEERQLALDRLQMVCSNDFLSVRDFATNPHRIFAAHELMAMIDPATTTKMTVQFNLFGGTVFRLGTERHHHLLDGIDNLTDIGCFGLTEVGFGNNAVEMETTAVYNKKDDTITINCPSELSHKYWITNGALHAQHCVVFAQLNVDGEEHGVHAILVPIREGVAGEPLEGCTINDMGHRMGLNGVDNALLSFKNVKVPRTNLLNKYSDIDESGKFHSAIKSKRGRFLSVADQLLSGRICIAAMSQGGAKAALSVAVRYAITRLTVGPAGKSDFPIMKYQLQQRAIAPLLARTVSLGIALDDVKDEWFKINSENIEDKVRVMNMVTACCVIKPLCSWNLERTASIARERCGGAGYLSCSRFGTMIGLAHAAMTAEGDNSVLMNKVAKEQLGLFIPRKVVVPEFDLKSNNFIHALMEANEVNKFAALGGAMMRAGKGAIFETWSLLNQDLVQAAAHAYGERIVSESMINAISKNPAASEVLDAIFKLHAVNTIQNNLSDLILSGLISVDNAQAVREEFNSLAATVSELSPDICESFGIPEELLSAPIARDWHAFNQHDNRGEVQPGVF

SEQ ID NO: 2483 - protein, 703 aa, Arthrobacter oxydans
MTTTATAPQATVDTVETVPSFIMDAWWTPDAGAAASATPVRDASTGEVLAKVSTEGLDLAAVVDYGRTTGQKELGQFTFHQRALKLKELAQYLNDRREHFYTFSAQTGATKVDSMIDIDGGIGVLFTFGSKGRRELPNSRVVVDGPMEVLSKDGSFAGEHIYTRIPGVAVQINAFNFPVWGMLEKFAPAFLAGVPTIVKPATPTGYVAAAVVKAIVESNILPKGSLQLISGSVRGLLDVLDYRDLVAFTGSASTALSLKSHPNVVQGGVRFTSETDSLNAAILGPDAVEGTPEFDAFVKSVVTEMTAKAGQKCTAIRRAIVPQELVAAVSAAIGKRISERVVLGDPRADGVTMGALASVEQLNDVRAAVQTMLDNGGELAYGTLDSPSVTSADGSTGVVDGGAFMAPVLLNWQDPEAEEVHSLEAFGPVSSVIGYKDLPDAVRLAARGGGSLVASVCTNDPAVARELVTGIAAHHGRVLMLNREDARSSTGHGSPVPHLVHGGPGRAGGGEELGGIRSVMHHMQRTAIQGSPNMLTAVTGVWHAGADRNFTVETEGTHPFRKSLETLRIGDAVRSDLRQVTLEDITAFANSTGDTFYAHTNHEAAEANPFFPGIVAHGYLLLAWGAGLFVEPAPGPVLANYGLENLRFITPVAAGDSIRVTLTAKKITPRETDEYGEVAWDAVLTNQNDEIVATYDVLTLVAK

SEQ ID NO: 2484 - protein, 436 aa, Arabidopsis thaliana; identical to SEQ ID NO: 354

SEQ ID NO: 2485 - protein, 980 aa, Corynebacterium efficiens; identical to SEQ ID NO: 2363

SEQ ID NO: 2486 - protein, 557 aa, Caenorhabditis remanei; identical to SEQ ID NO: 2431

SEQ ID NO: 2487 - protein, 647 aa, Mus musculus
MNSPLRTSWPGLEKGSPQRKRQTTYGQFCGTCWPQLLHVYPYLAESGHHCSAGEMDAPVPRTPDNWHLRPDGDGPRSVHRGHPEPLDLHLGMFLPTLLHQATEEQQERFFMPAWNLEITGTYAQTEMGHGTHLRGLETTATYDPKTQEFILNSPTVTSIKWWPGGLGKTSNHAIVLAQLITRGECYGLHAFVVPIREIGTHKPLPGITVGDIGPKFGYEEMDNGYLKMDNYRIPRENMLMKYAQVKPDGTYVKPLSNKLTYGTMVFVRSFLVGSAAQSLSKACTIAIRYSAVRRQSEIKRSEPEPQILDFQTQQYKLFPLLATAYAFHFLGRYIKETYMRINESIGQGDLSELPELHALTAGLKAFTTWTANAGIEECRMACGGHGYSHSSGIPNIYVTFTPACTFEGENTVMMLQTARFLMKIYDQVQSGKLVGGMVSYLNDLPSQRIQPQQVAVWPTLVDINSLDSLTEAYKLRAARLVEIAAKNLQAQVSHRKSKEVAWNLTSVDLVRASEAHCHYVTVKVFADKLPKIQDRAVQAVLRNLCLLYSLYGISQKGGDFLEGNIITGAQMSQVNSRILELLTVTRPNAVALVDAFDFKDVTLGSVLGRYDGNVYENLFEWAKKSPLNKTEVHESYYKHLKPLQSKL

SEQ ID NO: 2488 - protein, 748 aa, Saccharomyces cerevisiae; identical to SEQ ID NO: 59

SEQ ID NO: 2489 - protein, 748 aa, Saccharomyces cerevisiae; identical to SEQ ID NO: 59

SEQ ID NO: 2490 - protein, 748 aa, Saccharomyces cerevisiae; identical to SEQ ID NO: 59

SEQ ID NO: 2491 - protein, 629 aa, Volvox carteri
MTSTEKATERLQVLARQVTAGNATTRLAVCPKEMKDFLVHDNKELREAIYEFLKDDLYRPNHYQGLMEFREQTLQRLKKFVAQKFFSVRDYTNEPRRFMAALESLMYADYSLAIKAGVHFTLCGGTIAKLGTAYHHNKYLPGMDDLTLPGCFGMTELGHGSNVMGIETTAVYDKASGQFIINTPNDEASKYWIGGSGQHGKICAVFAQLTVNGQWQGPHVFVVRIRDDQGRLMPGVRIADQGPKMGLNGVDNGRIWFDNVRVPREDMLDAFASVSPDGTYSSSIPSVSQRFGTVVGGLTTGRVLIATGGVDGVKLALTVAIRYSCSRTQFGDRPIMDYVTHQARLLPPLAQTYALHLALGHLKTLTAARRPADAKAIHVLSSGLKAAATWGRVEAMQDCRECCGGMGFLSSNKIGPMMTDMNVDVTFEGDNTVMMQQVTRALLEDKAALSRGAPAVPSAGALAAGGTSCSKTLQSLLAYREGALLAQVAGEMAAAATRADGPAAKAAASAAAFDRQLDVVVSIGWAWVERFCHANFLQEVNRAPESLRTALDLLAQLYALSRIQRSLDFYLTVGALNRADVVALRNATMDIYAQLTAGGSRCAAVALCDAFGIPDHLLQAPIAFDWRKV

SEQ ID NO: 2492 - protein, 678 aa, Selaginella moellendorffii; identical to SEQ ID NO: 2396

SEQ ID NO: 2493 - protein, 678 aa, Selaginella moellendorffii; identical to SEQ ID NO: 2395

SEQ ID NO: 2494 - protein, 629 aa, Volvox carteri; identical to SEQ ID NO: 2491

SEQ ID NO: 2495 - protein, 436 aa, Arabidopsis thaliana; identical to SEQ ID NO: 354

SEQ ID NO: 2496 - protein, 693 aa, Drosophila melanogaster; identical to SEQ ID NO: 2320

SEQ ID NO: 2497 - protein, 669 aa, Drosophila melanogaster; identical to SEQ ID NO: 478

SEQ ID NO: 2498 - protein, 703 aa, Drosophila melanogaster; identical to SEQ ID NO: 2322

SEQ ID NO: 2499 - protein, 669 aa, Drosophila melanogaster; identical to SEQ ID NO: 2381

SEQ ID NO: 2500 - protein, 693 aa, Drosophila melanogaster
MASEDTSFIPDLPSGGPLAVYRKRANFDWKRLRLIFEKEQGLRIKYKVWRRLENDPLFAHPSRTLPMDEQKRLCAMQVNRMKHLDLVPKEIESLSFSAKTKYLMYINEALACYSPSLSVKIALGVGLFNNAIRAMGTEKHQKYIEAAWNREVITCLAITELSHGSNTKSIRTTATYDPTTQEFVINTPDFEAAKCWVGNLGKTATVAMTFANLYTADGQNHGLHGFLIPIRDPKTLLSYPGVLVGDIGEKCGLNGIDNGFVVFTNYRIPRDNLLNRTSDVTPEGVYESVFTEPGKVLGAALESFSAGRIGIMQESANTLCSAAVIAVRYSAVRKQFGPERHGEEMAILEYQLHQYRIFPYLAAACVQKIATEELTSTYMEIIARSQADSNGFDVLTQNAAEIHALISSSKPLITWAARDAIQEAREACGGHGYLQAAKLGQMRTDHDPLCTYEGDNNVLGQQASNWLLRQWSAKELETPIGSVKFLERRSELLALNYASLAQKTPIASWQFSLRCYEWLLCHLMAKTTAHIEGQLAAGSSKFEARNNSQVAGARELSLAYAEYYALTRYVDHVSTLTVEAPYASVLRLLFDVYAMWLLEKHMTTFYVGGFAAGRDFSAAVRQLLLDSCLKLKDVAVSVADAISPPDFALNSVIARADGLLYENLQNEFMTNEGAFQRPSWWRDVIIPQAQSKL

SEQ ID NO: 2501 - protein, 730 aa, Naegleria gruberi
MHEARRLSILLNHLNIHVDQEQQQNSLSSNSCSSSSSSKQQQIIYNIPSNASDLNFKGDDHHLELPADESLHRYHLMLKRKDQPLYDQLPTKSLSSLKAFHSKDCKSLASRLLQTAEKTIFDKGYTAAREAVWKILNQETFTIDNEWQDQQLRLQIVSQFREFIKNKPITTQVMNENIFFFLGALESAIQYDTSFTAALVVSMQLFGTCIYKLGTGRHQYLLNDLNSGRDIGSFCMTELTHGSNTRAIETTAHYDHDKKEFIINSPSESSYKYWIGNTAFFGTKTCVFAQLYVNNENKGVHVFVVPIRDQDTLDMYPGITIKDIGSKNGWRGVANGCLRFDHVRIPASALLNKYGDIDTSGNYTSQIKDENVRFALTLAALSMGRLLYIAGPTFALRAGLTTAIRYAHQRRQFGGKDGKENLIWEYPTHLNMMLPMVAISHAFHSGMVTLAHEWASVNNSNMEDFHAVVSGIKAYVCEYVTPALRELRVACGGHGYSSNNRINILMNDMDVFNTAEGDATVLYIQVAKFLLGKASKKANNNPVLKLVLSAEPKAAQNVNLLTFENQAKALAFRVKSLLEKCSTSIAKHMKDKKDAQTAFNLALVDVIELARSYIELEMLFRLDKSLIKNAADEQVKQVFKTLSDIYALTIIKQNLSYYLVYQYFDIDTSKKVMDDILPHLYQTVNPDILEIVDSFNIPDSLLRAPLGLSNNQSYVKRTLQSIGFKAPTIE

SEQ ID NO: 2502 - protein, 730 aa, Naegleria gruberi; identical to SEQ ID NO: 2501

SEQ ID NO: 2503 - protein, 669 aa, Artificial Sequence; identical to SEQ ID NO: 478
  Description of Artificial Sequence: Synthetic construct

SEQ ID NO: 2504 - protein, 669 aa, Artificial Sequence; identical to SEQ ID NO: 478
  Description of Artificial Sequence: Synthetic construct

SEQ ID NO: 2505 - protein, 669 aa, Drosophila melanogaster; identical to SEQ ID NO: 478

SEQ ID NO: 2506 - protein, 680 aa, Populus trichocarpa; identical to SEQ ID NO: 326

SEQ ID NO: 2507 - protein, 673 aa, Unknown; identical to SEQ ID NO: 152
  Description of Unknown: Acyl-CoA polypeptide

SEQ ID NO: 2508 - protein, 650 aa, Ailuropoda melanoleuca
MNQDLRREREAASFNPELLTHVLDGSPESTRRRREIGRRAKNLILNDPDFQHEDLNFLTRSQRYEVAVRKSANMVKKMREFDIADPEEIMWFKKVHLVNFVEPVGLNFSMFIPTLLNQGTTAQQEKWLLSSKGLQIIGTYAQTEMGHGTHLRGLETTATYDPETQEFILNSPTVTSIKWWPGGLGKTSNHAIVLAQLITKGKCYGLHAFIVPIRELGTHKPLPGITVGDIGPKFGYDEMDNGYLKMDNYRIPRENMLMKYAQVKPDGTYVKPVSNKLTYGTMVFVRSFLVGEAARCLSKACTIAIRYSAVRHQSEIKLGEPEPQILDFQTQQYKLFPLLATAYAFQFVGAYMKETYHRINEDIGQGDLSELPELHALAAGLKAFTSWTTNAAIEACRMACGGHGYSHCSGLPNIYVNFTPTCTFEGENTVMMLQTARFLMKSYDQVHSGKLVCGMVSYLNDLPTQRIQPQQVAVWPTVVDIDSPDSLTEAYKLRAARLVEIAAKNLQNEVIHRESKEVAWNLTSVDLVRASEAHCHYVVVKLFSEKLLKIQDKSVHAVLRNLCLLYCLYGISQKAGDFLQGSIMTESQITQVNQRMKELLTAIRPDAVALVDAFDFQDVTLGSVLGRYDGNVYENLFEWAKKSPLNKSEV

SEQ ID NO: 2509 - protein, 728 aa, Trypanosoma brucei; identical to SEQ ID NO: 2327

SEQ ID NO: 2510 - protein, 436 aa, Arabidopsis thaliana; identical to SEQ ID NO: 354

SEQ ID NO: 2511 - protein, 659 aa, Caenorhabditis briggsae
MPLNKLIQDGDNQDLTNERFKSTFDTDALAAVFHSGEDSLKRIREVRDEITKRGHLFDSLPAAHRTRAEKMEDVSRKLKNLMENVNEFADFTNNLDMLTIIRDVMGVEGFPLALHNLMFVPTIQNQADDEQTEWWLMDAIQGKIIGTYAQTELGHGTNLSAIETTATYDKSTEEFIIHTPTTTATKWWPGGLGTSCTHVILVANLIIDNKNYGLHPFFVPIRDRNSYSQMSGVRVGDIGTKMGVNCVDNGFLAFDNYHIPRRNMLMKHSKVSKEGVYTAPSHPKVGYTTMLYMRSEMIMHQSYYLAMAMVIAIRYSAVRRQGEIKPGTQEVQILDYQTQQYRLFPGLARCFAFVTAANTVRQMTESCIQELSHGKSDVLADLHALSCGLKAVVTHQSSTSIDQARQGCGGHGYSDASYLPTLYTCSVGACTYEGENMVMLLQLSKYLMKAAAKAEEGAVMAPLVAYLAKSEPVAIGDKFEKLLSHFEHIARHRVMHAYRQMIEEEKQGIERDYAFANHSVDWTKAARAHTKLFIARGFVKMVQEVSNPEVHAVLTTLAELYLSYELIEMSSDLTANGYLSESQVQEIRHQIYDCMKKIRPNAVSIVDSFDFCDRELRSVLGRRDGHVYENLYKWAQMSPLNQKNLPHVEKYLKPMTSKL

SEQ ID NO: 2512 - protein, 667 aa, Caenorhabditis briggsae
MSAPLIDKYRKMASFDWKKLKAVVEGEEHVRLKAEVVAKMKSEPIFHRDYRVLSREEQREVVHQRWKKIVEWGLFKDPYSDLENFKALTETLEAYDQGTSARLFLHGNVFGAAVKSMGTERHKELVEKIENNEIVGAFCLTEIGHGSNTAEVQTTATFDDGQLVFNCPSIGAIKCWAGNLSHSATHVVVYAQLHVGGKNEGLHGFVIQVRCPKTFQTFPGITIGDMGSKPGCWQGVENGWMEFKNHRAPLSALLNKGCDITPDGKYVTSFKSASEKQSVSLGTLSVGRLGIIAKGMMACTFASTIAIRYSVARRQFGPEKGAENEIPVLEYPLQQYRLFPYLSAAICIRIFQKTFVEKFTEYMMRVMVGEKSEELSEFSKEVHALSSGAKPVATWLGVESLGEARKACGGHGFLHMSRLNTLRDDNDPSQTFEGENFMILQQTSNILLGKVASIGLINTPMSTMTFLNSKPSKFSSWTSDPVNDALSAYRYLTYHLLQTTSSEANKLKQSGKNSFEVRNEIQVHRAVNLSIAYTEHTMIDWVQKFVEDVEDVTLKGVLQKVLNLFSLFLLERHLATLYITGYASGGKFGEELREKLRKAVADVKPESMALVDSIAPDDFILNSALGASDGKAYDHIMEEFRKYTNEQPRWVCDLAQFLQKRSQSSKL

SEQ ID NO: 2513 - protein, 701 aa, Branchiostoma floridae
MLSQDERGDLQAEDELLPDFAPGPLDLYRKKASFSWKEMKVFLEGEDMVKFKKYVWTKLEEDPAFAHPSEDLTLDQQRELTFRRHKRFLEYDFLHDEDVMENPMKGIVIGDCVGMYDWSLSAKYSLNKQMFNTTIKASGSKRHEEVANKSVNTEVMGCFSLTELSHGTNTRATRTTATYDPSTQGFIINTPDFEATKCWIGNLGKMATHTVLYAQLITPDSKNHGLHSFVVQVRNTRTLKAMPGVMVGDMGKKLGQNGLDNGFVAFNKVWVPRESLLNRTGDVTPDGKYVTPYKDPKKRFGASLGALSGGRVGITSMAVCNLKLCLPIAVRYSAARRQFGPPGSAEEIPVLEYQMQQWRLLPYVAAMYALDHFSRTLYMDFIQLRLGVMMKDKSDRQDALGREIHALSSAGKPLSTWTARDAVQECREACGGHGYLAVNRLGDVRNDNDPNCTYEGDNNVLLQQTSNYLLGLANKLRDGTISSPLHSVDFLSDFPAIIKSTFPASSMQECLDAKVAVDAYKWLTCYLLDQSYKKLSGEKSKGKDTFSARNDSQVYYCRSLSIAFMEHTVVDRFYQVSHDESTPASLRPILQKLCCLYGLWALEKHCATLYQGGYFTEAKSVAWVRDAILHLCEQLKNDAVSLVDVVAPPDFILNSPIGMSDGQIYKNLWTSMLSAPRVLERPSWWRDFMDKPVIGSVKSKM

SEQ ID NO: 2514 - protein, 661 aa, Xenopus laevis; identical to SEQ ID NO: 1135

SEQ ID NO: 2515 - protein, 700 aa, Rattus norvegicus; identical to SEQ ID NO: 350

SEQ ID NO: 2516 - protein, 681 aa, Rattus norvegicus; identical to SEQ ID NO: 343

SEQ ID NO: 2517 - protein, 661 aa, Phascolarctos cinereus; identical to SEQ ID NO: 503

SEQ ID NO: 2518 - protein, 661 aa, Mus musculus; identical to SEQ ID NO: 556
  MOD_RES (277)..(277): Any amino acid
  MOD_RES (279)..(279): Any amino acid

SEQ ID NO: 2519 - protein, 660 aa, Homo sapiens; identical to SEQ ID NO: 346

SEQ ID NO: 2520 - protein, 661 aa, Cavia porcellus; identical to SEQ ID NO: 373

SEQ ID NO: 2521 - protein, 703 aa, Drosophila melanogaster; identical to SEQ ID NO: 2322

SEQ ID NO: 2522 - protein, 693 aa, Drosophila melanogaster; identical to SEQ ID NO: 2320

SEQ ID NO: 2523 - protein, 675 aa, Arabidopsis thaliana; identical to SEQ ID NO: 103

SEQ ID NO: 2524 - protein, 669 aa, Drosophila melanogaster; identical to SEQ ID NO: 2381

SEQ ID NO: 2525 - protein, 681 aa, Mus musculus; identical to SEQ ID NO: 345

SEQ ID NO: 2526 - protein, 700 aa, Mus musculus; identical to SEQ ID NO: 352

SEQ ID NO: 2527 - protein, 661 aa, Mus musculus; identical to SEQ ID NO: 72

SEQ ID NO: 2528 - protein, 673 aa, Streptomyces avermitilis; identical to SEQ ID NO: 152

SEQ ID NO: 2529 - protein, 700 aa, Mus musculus; identical to SEQ ID NO: 352

SEQ ID NO: 2530 - protein, 692 aa, Arabidopsis thaliana; identical to SEQ ID NO: 113

SEQ ID NO: 2531 - protein, 667 aa, Caenorhabditis elegans; identical to SEQ ID NO: 2140

SEQ ID NO: 2532 - protein, 659 aa, Caenorhabditis elegans [sequence omitted]

SEQ ID NO: 2533 - protein, 661 aa, Rattus norvegicus; identical to SEQ ID NO: 341

SEQ ID NO: 2534 - protein, 660 aa, Homo sapiens [sequence omitted]

SEQ ID NO: 2535 - protein, 675 aa, Arabidopsis thaliana; identical to SEQ ID NO: 66

SEQ ID NO: 2536 - protein, 748 aa, Saccharomyces cerevisiae; identical to SEQ ID NO: 59

SEQ ID NO: 2537 - protein, 661 aa, Xenopus laevis; identical to SEQ ID NO: 1135

SEQ ID NO: 2538 - protein, 700 aa, Rattus norvegicus; identical to SEQ ID NO: 350

SEQ ID NO: 2539 - protein, 681 aa, Rattus norvegicus; identical to SEQ ID NO: 343

SEQ ID NO: 2540 - protein, 661 aa, Phascolarctos cinereus; identical to SEQ ID NO: 503

SEQ ID NO: 2541 - protein, 661 aa, Mus musculus; identical to SEQ ID NO: 556
  MOD_RES (277)..(277): Any amino acid
  MOD_RES (279)..(279): Any amino acid

SEQ ID NO: 2542 - protein, 660 aa, Homo sapiens; identical to SEQ ID NO: 346

SEQ ID NO: 2543 - protein, 661 aa, Cavia porcellus; identical to SEQ ID NO: 373

SEQ ID NO: 2544 - protein, 703 aa, Drosophila melanogaster; identical to SEQ ID NO: 2322

SEQ ID NO: 2545 - protein, 693 aa, Drosophila melanogaster; identical to SEQ ID NO: 2320

SEQ ID NO: 2546 - protein, 675 aa, Arabidopsis thaliana; identical to SEQ ID NO: 103

SEQ ID NO: 2547 - protein, 669 aa, Drosophila melanogaster; identical to SEQ ID NO: 2381

SEQ ID NO: 2548 - protein, 681 aa, Mus musculus; identical to SEQ ID NO: 345

SEQ ID NO: 2549 - protein, 700 aa, Mus musculus; identical to SEQ ID NO: 352

SEQ ID NO: 2550 - protein, 661 aa, Mus musculus; identical to SEQ ID NO: 72

SEQ ID NO: 2551 - protein, 673 aa, Streptomyces avermitilis; identical to SEQ ID NO: 152

SEQ ID NO: 2552 - protein, 700 aa, Mus musculus; identical to SEQ ID NO: 352

SEQ ID NO: 2553 - protein, 692 aa, Arabidopsis thaliana; identical to SEQ ID NO: 113

SEQ ID NO: 2554 - protein, 667 aa, Caenorhabditis elegans; identical to SEQ ID NO: 2140

SEQ ID NO: 2555 - protein, 659 aa, Caenorhabditis elegans [sequence omitted]

SEQ ID NO: 2556 - protein, 661 aa, Rattus norvegicus; identical to SEQ ID NO: 341

SEQ ID NO: 2557 - protein, 660 aa, Homo sapiens [sequence omitted]

SEQ ID NO: 2558 - protein, 675 aa, Arabidopsis thaliana; identical to SEQ ID NO: 66

SEQ ID NO: 2559 - protein, 748 aa, Saccharomyces cerevisiae; identical to SEQ ID NO: 59

SEQ ID NO: 2560 - protein, 661 aa, Xenopus laevis; identical to SEQ ID NO: 1135

SEQ ID NO: 2561 - protein, 700 aa, Rattus norvegicus; identical to SEQ ID NO: 350

SEQ ID NO: 2562 - protein, 681 aa, Rattus norvegicus; identical to SEQ ID NO: 343

SEQ ID NO: 2563 - protein, 661 aa, Phascolarctos cinereus; identical to SEQ ID NO: 503

SEQ ID NO: 2564 - protein, 661 aa, Mus musculus; identical to SEQ ID NO: 556
  MOD_RES (277)..(277): Any amino acid
  MOD_RES (279)..(279): Any amino acid

SEQ ID NO: 2565 - protein, 660 aa, Homo sapiens; identical to SEQ ID NO: 346

SEQ ID NO: 2566 - protein, 661 aa, Cavia porcellus; identical to SEQ ID NO: 373

SEQ ID NO: 2567 - protein, 703 aa, Drosophila melanogaster; identical to SEQ ID NO: 2322

SEQ ID NO: 2568 - protein, 693 aa, Drosophila melanogaster; identical to SEQ ID NO: 2320

SEQ ID NO: 2569 - protein, 675 aa, Arabidopsis thaliana; identical to SEQ ID NO: 103

SEQ ID NO: 2570 - protein, 669 aa, Drosophila melanogaster; identical to SEQ ID NO: 2381

SEQ ID NO: 2571 - protein, 681 aa, Mus musculus; identical to SEQ ID NO: 345

SEQ ID NO: 2572 - protein, 700 aa, Mus musculus; identical to SEQ ID NO: 352

SEQ ID NO: 2573 - protein, 661 aa, Mus musculus; identical to SEQ ID NO: 72

SEQ ID NO: 2574 - protein, 673 aa, Streptomyces avermitilis; identical to SEQ ID NO: 152

SEQ ID NO: 2575 - protein, 700 aa, Mus musculus; identical to SEQ ID NO: 352

SEQ ID NO: 2576 - protein, 692 aa, Arabidopsis thaliana; identical to SEQ ID NO: 113

SEQ ID NO: 2577 - protein, 667 aa, Caenorhabditis elegans; identical to SEQ ID NO: 2140

SEQ ID NO: 2578 - protein, 659 aa, Caenorhabditis elegans [sequence omitted]

SEQ ID NO: 2579 - protein, 661 aa, Rattus norvegicus; identical to SEQ ID NO: 341

SEQ ID NO: 2580 - protein, 660 aa, Homo sapiens [sequence omitted]

SEQ ID NO: 2581 - protein, 675 aa, Arabidopsis thaliana; identical to SEQ ID NO: 66

SEQ ID NO: 2582 - protein, 748 aa, Saccharomyces cerevisiae; identical to SEQ ID NO: 59

SEQ ID NO: 2583 - protein, 980 aa, Corynebacterium efficiens; identical to SEQ ID NO: 2363

SEQ ID NO: 2584 - protein, 680 aa, Populus trichocarpa; identical to SEQ ID NO: 327

SEQ ID NO: 2585 - protein, 594 aa, Nematostella vectensis
MTRLLDHDNHEKREKFRKILSEDPLMKPKYNISVDEERALALKRLKKLCDQGFISVLDFRHNPRWIFAAHELAAVVDGSMATKMTVQFNLFGGTVLKLGTERHHSKLLKGIDSLEDVGCFGLTELGYGNNAVQMETTATYDNETQEFIVNTPSTLAQKYWITNGACDAHHIVVFAQLYVNGKNEGIHGVLVPIRDKNLKEMPGSSIHDMGPKMGLNGVDNAKFIFDNVRVPRENLLNLYSDVDADGNYTTVVDGNIRKRFLTVADQLLSGRLCIASMSQGVSKACITIATRYSATRLTVGPEGKSDTPILKYQLQQLALMPLLAKTYAYDFALSYVKDCWAFKAEDGSDHANIVTMCCVIKALTGWHVGEAASICRERCGGQGYLSCNRFGPAIGYAHAAMTAEGDNAVLMQKVATERLMVFKPSKEKSQVGEVDLSAVDSLHKLLEAREQALFIELGLKMKKAGKDRFNVWMYEEQDLVQASAHAYGDRLVSECFASAISRSDASLQSILSKLYHLFLLTQVQKGLGYFTTSKLLPLETGAKVGKAAAGLCREVSPQALSLCDAFGMTEEMLSAPIARDWVDYNVTDNLGEVA

SEQ ID NO: 2586 - protein, 695 aa, Nematostella vectensis
MSHHCENNANQQANQNGPLDVYRKQATFDVREMRYFVDGGQDITEFKENIWKRMEKDPLFSHEKTKGASFDGKRRLAFRRVRRVYEGNFLSEDEFVASPLKNQALTDTLGSYDWAIAAKNSLNAIMFARLCKTLSTHPHIQELGEKAERFEAFGCFALTELSHGSNTRAMQTTATYDPKHKEFVINTPHFEATKVWVGNLGRTATHAVVYAQLYTPDGVCHGLHSFVVPVRSTKDLRTLPGITVGDIGEKLGQNGLDNGFAAFDHVRIPRENLLNKGGDVTPDGKYVTPYKDPKKRFGAALGALSGGRVGITSMATTNMRSALPIAIRYSAVRKQFGPPGKDEIPVLEYQMQQWRLIPLLAATYALSYFSRTFFLNFVELQIGIMMGENNDRQEELGREIHALSSASKPLAGFTARDAIQECREACGGHGYLAVNRLGVLRDDNDPNLTYEGDNNMILGQTSNYLMALLDSKHKGATISSPLGSVDFLDSAEEILQRRFSAQTEQECVDHEVLLQTFQWLVCYLWKESGSKLKDQLAMGKDSFTARNDSQVYHCRELALAYIQCEVFRRFKNALISDDEILENLKPVLRKLCSLYGVWTLEKQMGTLYQGRYFTSTNDARILRRAVLTLCFELKDQAVILSDAIAPPDFILDSPIGLSNGEAHKNLYDAIMSDPQATKRVSWWKEARKPPVLSKL

SEQ ID NO: 2587 - protein, 669 aa, Drosophila yakuba; identical to SEQ ID NO: 2475

SEQ ID NO: 2588 - protein, 693 aa, Drosophila yakuba; identical to SEQ ID NO: 2476

SEQ ID NO: 2589 - protein, 703 aa, Drosophila yakuba; identical to SEQ ID NO: 2477

SEQ ID NO: 2590 - protein, 697 aa, Drosophila pseudoobscura; identical to SEQ ID NO: 2364

SEQ ID NO: 2591 - protein, 508 aa, Trichoplax adhaerens
MDIRILLVLELGTFIRGLETTATYDPKTREFILNTPTLTATKWWPGGLAKTATHAAVMAQLWTQNKCYGPHLFILQVRSLEDHTPLPGITLGDIGDKFGYNSIDNGSMQLNNVRIPRDQMLMRHSKVTLDGTYIPPKNPRLAYGAMTLYRCQILIICSGYLARASTIAVRYSAIRRQTETKPGYEPKVLDYVTQQNKLFPHIAGAYALACTGRYMIDFGKRATERLKLEDLSVLAEVRQISDFIGYIEMLNNTYINEQNSGHIYNNWLASCTYEGENTVMYLQSARYLLRCVKNPKSAPLGVSAVLHNPPGKHWDVKNMQDLEKTNTVLEAYRARAYKKVAIADKYLRELQSGGDTSYDAWNKSGIKLVDCAKAFTHYFVIKTFFNMIEKSRLGQSCHLQLHRLSILLALHGIDQNTGDFMLDNFIDFEQIKLIRVKILELFSEIRPVAVCLVDAFDIPDQTLLSVLGRYDGDVYNKLFEWAKEAPLNKTQVHSSYDKYLRNLLTSKL

SEQ ID NO: 2592 - protein, 418 aa, Sorghum bicolor
MMSVACARLTPAASVFPAAVSDYYQFDELLTPEEKNLRINIRQFMEKEVAPIVPKVVLHLVHWLYWETAQFPFHLIPKLGSLGFLGGIIKGHGCPGLSETAYAVCISEVARVDASIASFCLVQSCLAMLCIAQMGSEAQKEKYLPLLSKQQKVCAYALTEPDYGSDASSLNTVARKVPGGWVLNGRKRWPGNSSFADVLVVLARNTSTNQVNGFIVNGGSSGLKINKIENKVSMRMVQNCDIQLDDVFVPDDDRLPGANSFQDLVDSLSFSRVMAAWVSIGIAEGVYDACHRYLGERKQFGVPLATFQLNQEKLVRMLGNIQAMWLLGWRLCKLHASGNITTGHASLGKAWITKQARETVALGRELLGGNGIVTDFHVGKALCDMETVYTYEGSYDVNALIVAREITGISSIRPTSRL

SEQ ID NO: 2593 - protein, 523 aa, Sorghum bicolor
MGEGINGDAGLAAAPYHQWVLLSPAGGSPRPPARYKHAAQVVQDKLYVVGGSRNGRSLSDVQVFDFRTSTWSALNPTRDSNQLNHENNAAGGSFPALAGHSLVKWKNYLVVVAGNTRSSSSSSSNKVSVWLIDVQANSWSAVDTYGKVPTARGGQSVSLLGSRLLMFGGEDNKRRLLNDLHILDLETMMWEEIKSEKGGPAPRYDHSAAVYTDQYLLIFGGSSHSTCFNDLYLLDLQTLEWSQPDAQGAHITPRSGHAGAMIDENWYIVGGGDNANGSTDTVVMNASKFVWSVVTSVSARDPLACEGLTLCSTTVDGEKVLIAFGGYNGKYSNEIFVLKPKARNLVQPRLLQSPAAAAAAASVTAAYAVITGTDEKTRDIVATDDFDIKRAQPASNSKKFVAEIDVLNGENGKLASRLAEVRDENSKLKDKLDMANLSYGELAKELKSVQDQLAAEGSRCQKLESQIATARKRLESAGSLENELDVLHQQISQVEQTIATTQRRKSGGVWKWVAGSAEVSDDE

SEQ ID NO: 2594 - protein, 684 aa, Sorghum bicolor
MDPTSPSPAARRAAAVARHLAGATAPFPASTPLEPSCCLSYVPPESTERPAAFAPGDLRLLLDGHDLPARDWLFRAMEESPLFRSPSARTGSRVFVGADLNDGKEGQREATMRRIAYLKQRGVFRGWLTKDGADAELRKLALLDCIAIYDHSLAIKIGVHFFLWGSAIKFLGTKRHHDKWLVATENYDIMGCFAMTELGHGSNVRGIETIATYDSETREFIINTPCESAQKYWIGGAANHATHTIVFCQLHINGRNEGVHAFVAQIRDEDGTVLPNIRIADCGHKIGLNGVDNGRIWFQNIRVPRENLLNLVADVLPDGQYVSMIDDPDQRFAAFLSPLTLGRVNIAVDSVYISKVSLAIAVRYSLSRRAFSITPDGPETLLLDYPSHQRRLLPLLAKVCLMSSAANFMKNMYVKRTPEMSKAIHIYSSALKATLTWQNMMTLQECREACGGQGLKTENRVGVFKAEFDVQSTFEGDNNVLMQQVSKALYAEFLGAQKKKRPFKGLGLEHLNGSTPVIPDKLTSNILRSSKFQMDLFCLRERDLLKQFAEEVSLHLAQGESREKALMLSYQLAEDLARAFTERTILQIFLEDERNVPSGSLKEVLGLLRSLYVMVNIDESTSFLRYGYLSRDNVALVRKEVLKMCSELRPHALAVVSSFGIPDAFLSPLAFDWIEANTLSTGSH

SEQ ID NO: 2595 - protein, 722 aa, Drosophila pseudoobscura; identical to SEQ ID NO: 2436

SEQ ID NO: 2596 - protein, 418 aa, Sorghum bicolor; identical to SEQ ID NO: 2592

SEQ ID NO: 2597 - protein, 523 aa, Sorghum bicolor; identical to SEQ ID NO: 2593

SEQ ID NO: 2598 - protein, 684 aa, Sorghum bicolor; identical to SEQ ID NO: 2594

SEQ ID NO: 2599 - protein, 678 aa, Physcomitrella patens
MKGDDGSAAARRAGVLARHLAHEMSPLSFLRPSPCLAYQPPEFHCDNSSFDKSIMRELLDGHHVDLRDSFTDLLMSSDLFTSKRVGDRVFASPNFNLTMAEQRDKTLERILFLRSEGVFKGWLSDSSVDDALKRAALFETMGIFDHSLVIKLGVHIHLWGGSIQYLGTKRHHDKWLDRTEDYQVRGCFAMSELGHGSNVRGIETVTTYDTSTEEFIIDTPCESAQKYWIGGAAQHATHTIVFSQLLIDGKNEGVHAFVCQLRDQYGRVMPGIRIADCGHKIGLNGVDNGRIWFDKVRIPRENLLNAVADVTPGGKYKSAIKDPDQQRFGAFMTPLTSGRVTIAVSAIYQSKVGLTTAIRYTLTRRAFSLVPGQPEVLLLDYPSHRHRLLPLLAKTYAMSFAAVDLKYLYLNRTHADSKVIHVLSSGLKAVFSWHNLRTLQECREACGGQGLKTDNRVGQLKAEYDVQLTFEGDNNVLMQQVSKALLADYVSAKRRGKPLKGMGLEHINGSAPVVPEELNRSALRDSKFQLALFQLRERGLLELLTSQVTTLVLKGVSMTDAVISGYQVAEDLGQAFSERSVLESFLKVEQQTTGSMKDILGLLRSLYVLSSADETPVFLRYGYLTPKQSQLIHTEVDSLCGELRPQALNLVDAFGIPQAFLGPIAFDWVEYNSWSNVQ

SEQ ID NO: 2600 - protein, 680 aa, Physcomitrella patens
MSESRSDDGRAVARRTGVLARHLAQELSPVSFFQPSPCLAYQPPELHCDKSSFDKSVMRELLDGHHVALRDSFANLMISSDLFVNKRVGNLTFATPNFNTTMEEHRDKTLDRILFFRSKGVFKGWLTDSSVDHALKRAALFETLGTFDHSLAIKLGVHIHLWGGAIQYLGTKRHHDKWLKITEDYQVRGCFAMSELGHGSNVRGIETVTTYDPSTEEFIIDTPCESAQKYWIGGAAQHATHTIVFSQLLIDGKNEGVHAFVCQLRDQYGHVMPGIRIADCGHKIGLNGVDNGRIWFDKVRVPRENLLNAVADVTPDGKYESAIKDPDQRFGAFMAPLTSGRVTIAVSAIYQAKVGLTTAIRYALTRRAFSLAPEQPEVLLLDYPSHRHRLLPLLAKTYAMSFAAVDLKNLYVRRTPADSKVIHVLSSGLKAVFSWHNLRTLQECREACGGQGLKTDNRVGQLKAEYDVQLTFEGDNNVLMQQVSKALLADYMSAKKRGKPMKGMGLEHINGPALVIPEDLTRSVLRDSKFQLALFQLRERGLLELLSSQVSSLVSKGVSMADAVISSYQLAEDLGQAFSERSILESVLRAEQQTTGSTKEVLGLLRSLYVLSAADEGPVFLRYGYLLPKQSQLISTEVASLCGELRPQAVNLVDAFGIPQAFLGPIAFDWVEYNSWNNVR

SEQ ID NO: 2601 - protein, 669 aa, Drosophila pseudoobscura; identical to SEQ ID NO: 2365

SEQ ID NO: 2602 - protein, 753 aa, Tetrahymena thermophila
MISKFSHKNNWDSIFQDTQNRERRDQLQCAGDDEHVQLHKRLNTSSKSIKQISNNNYYQMLYLQALSYLFSSDLYRFRSREDSLLLYKQKKFKQYILCKQIKQLQTITRKQGRTQLKIQQQVFIMTSQTNFCPHEFAKVLDGSCHETRKKWKEFSQDPLFIPRYNISLREQKDLALERLKVVAKNRVFSVHDFAKNPLNVFANHEMAAWVDGSLATKLTVQLNLFGGTVYTLGTERHLPVAEGVDTLSTIGCFALTELGFGNNAVQMETTSIWDPQTKEFIINSPTVLSQKYWITNGALHCNYAIVFAQLILPGNQKEGVHAFLVRVRNEDGSVCKGVFIEDMGSKFGLNGVDNGRLRFDNVRIPREAILNKFSEMSPSGQFTSTIKDKRQRFLKVADRLLSGRICIASMLIGGTKYCLATAIRYGSQRLAVGKTGKSDTPIMNFNLFQNQVYPLLARTITLNVGFNKVKEVYAESLLKKEEASAFLVCLCCAVKPLITWNSRDVGTTLAHNYYHNPKVERVGGQGYLSVNRLSELLPFAHSGITAEGDNSVLMQKVAKELLTLVSKNQFPFSKPTNSRQDIAKMTKITDIQVLIDLIRIREIDLIKEVSVMTQTQMSQGKDIYEIWMEKENAAIQNLARQFGERIIADFAQQNLANVRQDVKRPLDLYFKLHLVSVVLSNLGWYLMNNVVTSDAARSLEELRKECIVQIHPIALYSVNAFGIPEHLLCAPIAQNYETYNSKPNNGELITSKL

SEQ ID NO: 2603 - protein, 980 aa, Corynebacterium efficiens; identical to SEQ ID NO: 2363

SEQ ID NO: 2604 - protein, 701 aa, Branchiostoma floridae; identical to SEQ ID NO: 2513

SEQ ID NO: 2605 - protein, 693 aa, Drosophila sechellia; identical to SEQ ID NO: 2437

SEQ ID NO: 2606 - protein, 703 aa, Drosophila sechellia; identical to SEQ ID NO: 2438

SEQ ID NO: 2607 - protein, 669 aa, Drosophila sechellia; identical to SEQ ID NO: 2439

SEQ ID NO: 2608 - protein, 753 aa, Tetrahymena thermophila; identical to SEQ ID NO: 2602

SEQ ID NO: 2609 - protein, 669 aa, Drosophila mojavensis; identical to SEQ ID NO: 2470

SEQ ID NO: 2610 - protein, 698 aa, Drosophila mojavensis; identical to SEQ ID NO: 2469

SEQ ID NO: 2611 - protein, 665 aa, Hydra magnipapillata
MYSTTTIIKSCKNFRRLYSTLTTSKMTSSDCKWNKIEMDRDPKELRAKWNKPSFNVDKMKELIDHDNHEMRDEMRKFLSDPIFKPKYNISLSEEREIALQRLKKICEKGFISVLDFKNNPLKIFAAHEIASIVDPAMSTKMTVQFNLFGGTVLKLGTKRHHDRYLKGIDSLEDIGCFALTELGYGNNAVEMETTAVYDIESQEFIINTPSPLAQKYWITNGAIHAKHCVVFAQLNIEGKSHGVHGILVRIRDDNLNTLPGVVVEDMGHKMGVNGVDNAKLSFCNVRVPRENLLNKYSDVAEDGTFQTEIVSNRGRFLTVADQLLSGRLCIAAMSQGGAKTALAIALRYSATRLAVGEKGKSDTPILNFQLQQRALIPLLAETYCLNFSLDYIKERWSSQKENDARDHAQIVTMCCVIKPLCGWNVENVATVTRERCGGQGFLSVNRLGTVLSSSHASITAEGDNAVLMQKVAKERLTEYTKNDLMKIWLSSKFSLGYFTRSNFDDLDHLHGLLKRREDLLYMELGSRMAAAGKAKIFHTWMYESSDLVQHAARAYGERLTSEVCNNTRKNADPSLSNILHKIHHLYVISIIEKNLGWFIEQCLIPYSSASKVAEVSARLCKEIAPQSLALTDAFGLTDDMISAPIALDWIKYNESDNQGEHMSKL

SEQ ID NO: 2612 - protein, 659 aa, Caenorhabditis elegans [sequence omitted]

SEQ ID NO: 2613 - protein, 667 aa, Caenorhabditis elegans; identical to SEQ ID NO: 2140

SEQ ID NO: 2614 - protein, 715 aa, Monosiga brevicollis
MKANTVSLSLYFSLLLLLCCCSLLLSQTDQTSLSLSLSLSLSLSLSLSLSLSLSHIMNPDLKAERAGASFDPKALTPHLYGGQARLERFNAVRRLIEEDPVFRVDDYYFASREERYTRAMEKTSRLVQLVKQHNLSEEESIVMRLCIREQLPLGLHWVMFIPAIKGQGTPEQQKKWLPLAQSLRIVGTYAQTEMGHGTFLRGLETTATYDPATKQFVLHMSDHGPHAFIVQIRDLDSHKPLPGVSVGDIGPKLGYDSMDNGFLKLDHVRIPRDQMLMKFAQDPKPSPVWIHVWSPERPDDFAQVSESGAYTRPPNTKLSYGTMIYVRSVMISDAARHLQAATTIAIRYGVVRRQSLLEETASKETQVLDYNSSQQQLFPLLGWAYACHFAGQHLIKMYQDLQASLNRADLSMLEYVHGTTTGLKALVTTIASEGLETCRKACGGHGYSRFSGLPDFYQDYVPACTYEGENNVMKLQCARYLVKCFRQAAKGRNLAPEMSYIGQATKPSHTSKPLNLDGPDAWLHWKIQSRVLEAKACLSLAAAVRELDRQLGSTSKGKAWNNAAEPLSAAALEHSQVVMLRLLEGGIATPSIADTARRALESLRSLLALKLIQAQAPALQLANLLSAMDVQHLSTAVTKLLAVVRRDAVALVDAFDLSDHFLNSALGRYDGQVYEALYAAAQKSTLNATPVTRAVQEHLQPLMKFSRAMLGMPKL

SEQ ID NO: 2615 - protein, 735 aa, Trypanosoma cruzi
MAAGMVFRGASRVATAAAAHRPTQVTIVFPFASCGMLAGPICIQGRLFYRSFPLRLELNPSGNLYSMEHAFEEPTFRFMCEGEDIDYREEVRAALLEVLAKKPSNFVGRTEETWMQENSPQRSVQLLRAVAKKQLLSFAQVKSTPRLFSAFFDVLASCSTSLALIAADHFTFAAMIAKHGTKEMQEAILDDVDTCRVIGTIAHRELIAEGVPLNSEARYDKDEKCFVLRGAGKFAVVGAGCADWAIVTATLTLNRQDNQGPQLFVVQLRERGVLKKGVSMRPMQGENPTMSASGVGILHFDDVRIAVSALLLPSRVVDGGVLITEDADTSTSLQALTLQMRLATAALYAGALKRFLTNVVFFIAQKDVVGPDGRRDYPFFGVQHVQTPLVKIIAKSYVYLADWRRILSVFSKPTERRPTYEDETKLAGTIHFLQETLLELHRFVDEFMGVHASLGSTGNIDAVVMAHLRQEGADQSSLIREVAFKSVTKNIGASHWGWWLTSLLQPFAALDRFVKNPFYSPRIADLGRHLIFFSHKHYSAKKRLRQSREIERRKGGAEHQWYDWVMFRHQQVLHCGEAYMEMFSMEVMMAETQACTDPRARKILRDIGWIYALARQQDRLDYILTQQMISPGKSNVLESHLDNIVTVLAPQCVNLVDAFQVPDAFRSPCAAKTLESYWTIPGTNTGIQRGDRVTLFHDKKPTGDAKEEQENMQESEEEWDLFHGLAELPSFAQKK

SEQ ID NO: 2616 - protein, 508 aa, Trichoplax adhaerens; identical to SEQ ID NO: 2591

SEQ ID NO: 2617 - protein, 669 aa, Drosophila willistoni; identical to SEQ ID NO: 2465

SEQ ID NO: 2618 - protein, 654 aa, Ciona intestinalis
MFRVLCRKVAGNQVLQANKIHQNVSIIPTSSFMASAAQRNINNAMPPSQLRSSWKSDDGFDINELATLLDHDNHEMRDEFRKFVSDPIMTPKYNIPLAEERDVALKRLKRICDGGFISVLDFQHNPLRIFAAHELAAIIDPAMSTKMTVQFNLFGGTVLKLGTERHHEKLLKGIDTLDDVGCFGLTELGYGNNAVEMETTAVYDKESKEFIINTPTTLAQKYWITNGAVHAKHIIVFAQLKVGDEEHGIHGFMVRIRDDNMQIMPRVRVEDMGHKMGLNGVDNAKLFFDNVRVPRENLLNRYSDVDESGNFTTSIKSNRARFLTVADQLLSGRICIASMCMGGTKASLTTALRYAATRLTVGPRGKSDMAILSYQLQQKALLPLVARTIALNLGLDYVKDRWAFQPQDGSEHAEVVTLCCVIKPLVSWNLEKVSSVTRERCGGQGYLSCNRFGTFIGLAHAAMTAEGDNSVLMQKVAKERLAKFKPIKIAVENEDLSSVAFLHYLMVSRENLKFFELGMKLRDAGKDGLFDEWMLRGSDLVQSSAVAFGERVVSEKFAEVIAKTDGPVKRLLSMTQHLYLIDAVQRDLGYFVSEEILTKEGAREINNVCASLCEQLSPYSLQICDAFKITDEMLSAPIGRDWVEYNVTDNQGEV

SEQ ID NO: 2619 - protein, 620 aa, Ciona intestinalis
MSPEQLRKEWSCTNDRSLTFDPSKMTKLLDHDNHEMRKKFREFMSDPVMTPRYDIPLAEEREVALQRLQRICDAKFISVTDFWTNPLRIFAAHEISAIIDPAMATKMTVQFNLFGGSVVKLGTKRHHDQLIKGIDTLDDVGCFGLTELGYGNNAVEMETTAVYDKESKEFIINTPTTLAQKYWITNGAVHAKHIIVFAQLLIDGDNKGIHGILVRIRDDNMRIMPRVRVEDMGHKMGLNGVDNAKLFFDNVRVPRENLLNRYSDVAEDGSFTSSIDGGRDRFLTVADQLLSGRICIASMSMGAAKACLTIALRYAATRLTVGKGGRSDTSILTYQLQQRALLPLLARTYVMNFALDYVKDMWTKQQLNKGDSKGHAEVVTLCCVIKAIVGWHVGEVATVARERCGGQGYLSCNRFGSYIGSSHASMTAEGDNSVLMQKVAKERLAKFKPRIPEKVAEDLSNDGYLHHLLDARDMIRFSELAVKLMSAGKKGLFETWMLKESDLVQGAAFAFGELLVSDQSQAVLESCDDSLKPMIREIRRLYLLDAVQRDLGWFTAHELISPQTAKQVNEAVAQSCRMLAPHSLELCGSFELTDEMLSAPIALDWVKYNVGDNRGEVDHS

SEQ ID NO: 2620 - protein, 669 aa, Drosophila simulans; identical to SEQ ID NO: 2464

SEQ ID NO: 2621 - protein, 695 aa, Drosophila willistoni; identical to SEQ ID NO: 2466

SEQ ID NO: 2622 - protein, 722 aa, Drosophila virilis; identical to SEQ ID NO: 2467

SEQ ID NO: 2623 - protein, 669 aa, Drosophila virilis; identical to SEQ ID NO: 2468

SEQ ID NO: 2624 - protein, 697 aa, Drosophila persimilis; identical to SEQ ID NO: 2364

SEQ ID NO: 2625 - protein, 722 aa, Drosophila persimilis; identical to SEQ ID NO: 2440

SEQ ID NO: 2626 - protein, 669 aa, Drosophila grimshawi; identical to SEQ ID NO: 2471

SEQ ID NO: 2627 - protein, 669 aa, Drosophila erecta; identical to SEQ ID NO: 2473

SEQ ID NO: 2628 - protein, 693 aa, Drosophila erecta; identical to SEQ ID NO: 2474

SEQ ID NO: 2629 - protein, 703 aa, Drosophila erecta; identical to SEQ ID NO: 2472

SEQ ID NO: 2630 - protein, 691 aa, Drosophila ananassae; identical to SEQ ID NO: 2479

SEQ ID NO: 2631 - protein, 669 aa, Drosophila ananassae; identical to SEQ ID NO: 2478

SEQ ID NO: 2632 - protein, 592 aa, Homo sapiens [sequence omitted]

SEQ ID NO: 2633 - protein, 686 aa, Providencia stuartii; identical to SEQ ID NO: 2480

SEQ ID NO: 2634 - protein, 715 aa, Monosiga brevicollis; identical to SEQ ID NO: 2614

SEQ ID NO: 2635 - protein, 748 aa, Unknown; identical to SEQ ID NO: 59
  Description of Unknown: Acyl-CoA polypeptide

SEQ ID NO: 2636 - protein, 667 aa, Unknown; identical to SEQ ID NO: 2140
  Description of Unknown: Acyl-CoA polypeptide

SEQ ID NO: 2637 - protein, 659 aa, Unknown [sequence omitted]

SEQ ID NO: 2638 - protein, 680 aa, Physcomitrella patens; identical to SEQ ID NO: 2600

SEQ ID NO: 2639 - protein, 678 aa, Physcomitrella patens; identical to SEQ ID NO: 2599

SEQ ID NO: 2640 - protein, 660 aa, Artificial Sequence
  Description of Artificial Sequence: Synthetic construct
MNPDLRRERDSASFNPELLTHILDGSPEKTRRRREIENMILNDPDFQHEDLNFLTRSQRYEVAVRKSAIMVKKMREFGIADPDDIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEMKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYGQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 2641 - protein, 594 aa, Nematostella vectensis; identical to SEQ ID NO: 2585

SEQ ID NO: 2642 - protein, 695 aa, Nematostella vectensis; identical to SEQ ID NO: 2586

SEQ ID NO: 2643 - protein, 735 aa, Trypanosoma cruzi; identical to SEQ ID NO: 2615

SEQ ID NO: 2644 - protein, 587 aa, Photorhabdus luminescens; identical to SEQ ID NO: 2362

SEQ ID NO: 2645 - protein, 748 aa, Saccharomyces cerevisiae; identical to SEQ ID NO: 59

SEQ ID NO: 2646 - protein, 662 aa, Gallus gallus; identical to SEQ ID NO: 517

SEQ ID NO: 2647 - protein, 675 aa, Arabidopsis thaliana; identical to SEQ ID NO: 103

SEQ ID NO: 2648 - protein, 433 aa, Unknown; identical to SEQ ID NO: 114
  Description of Unknown: Acyl-CoA polypeptide

SEQ ID NO: 2649 - protein, 677 aa, Drosophila melanogaster
MSVNADLQRERAAATLDSEDFARWWAGGSGQLEERRALERRFYEDPDFAEPVHPSCLSYKERYEQTVARSTRFLAKLRQWQREKQPQLQLSVNMLRDFRLLLSGSLGTGLFQQSFPLRVHFSMFMTTLLSQGTEEQQAQWLNRSWHMDGVLGTYAQTELGHGTFVRGLETRADYDPITQEFILNTPTQSSYKWWPGGLGNTANVAIVLAQLYVKGKHYGLQSFVVRIRDERTHEPLTGVDVGDIGPRLGGNGVNNGFLGLRDVRIPRNQMLMKNAQVLTDGTFVQGRPPLLLYGTMVYVRVITVKDVLFGLLQAATIATRYSVVRRQSRINSDQPEVSVLDHITQQAKILPQIARGVSYRLVSDWLWRFYEDVLRQLEDESTKGRNSLPELHALSCCLKAVATDEASEGVDLLRKSCGGHGFLSSANFDSIYGLTAATYTYEGEYTVLLLQTARFLVRQYADSLKRKVLPSSVSYLRDTARLIWGKNLVANCVRALEISAMEQVRDAWQTQKMHQSGKVSPEMASNLAGRQLTSAAIAHAHAFFTRNALEQVEALRKKGDLSPNVSLILGQLVELFVIDTFLRQSGCVLRWNNGITGTQLRFVERRFEELLAKLRPNAVALVDGFDFHDRVLGSTLGCHDGRVYERLMEEARRNPINQEPVNSSFHNHLLPMMRGKL

SEQ ID NO: 2650 - protein, 447 aa, Rattus norvegicus
MVPAMLTGYMSLRGVSAWLLSRKLGLRFSRVPRTWSSAAAHTEKTQIRSVKSSRPVFDWKDPLVLEEQLTADEKLIRDTFRNYCQERLMSRILLANRNEVFHRDIVYEMGELGVLGPTIKGYGCAGVSSVAYGLLTRELERVDSGYRSMMSVQSSLVMHPIYTYGSEEQRQKYLPRLAKGELLGCFGLTEPNHGSDPGSMETRARHNPSNKSYTLSGTKTWITNSPVADLFVVWARCEDNCIRGFLLEKGMRGLSAPRIEGKFSLRASATGMIIMDSVEVPEENVLPNVSSLAGPFGCLNTARYGITWGVLGAAEFCLHTARQYALDRIQFGVPLARNQLVQKKLADMLTEITLGLHACLQLGRLKDQDKATPEMVSLLKRNNCGKALDIARQARDILGGNGISDEYHVIRHAMNLEAVNTYEGTHDIHALILGRAITGIQAFTVEK

SEQ ID NO: 2651 - protein, 674 aa, Taeniopygia guttata
MALLETSKHSQGSVLGSVNPDLASERQTASFCVEKLTALLDGGAEQTRIRRAVVEAIQSDPVFSREYQYFQTQNERYEAAVRKAVHLQKKMHEMGWTENGPEYKYIYRALSGDVAFLLHRVFMRSISVLGSDKQVAKWIPLATQHRLIGSYAQTELGHGTYLQGLETTAVFDTATQEFILNTPKISAMKWWPGDMGRSATHTVVFAQLYIHGKCYGIHPFIVQIRSLQDHSLCPGITAGDIGPKMNFEHTDNGYLLLKNVRVPRENMLSKFCEVRPDGTYVRQGSQKINYFTMTAVRISLISDEVLTALMKACTIATRYSVVRRQSKLKPGEQEAKILDYQTQQEKLLPQLAAAYAFHFTNDYLQELFNRGYREIQKKNFDMLPELHALSSGFKAVITQHCTAGVEICLRACGGHGYSLLSGLPSLYTKILASCIYEGENTILLLQTARFLIKCFMAASAGQPVPPSVTYLAAVKHGKCPAKNKVDFLSPDIYTEAYQHVAIRLTSSTAAKLQDLIQSGVKKYDAWNQCTVQLVQAAKAHCHYIAVKNFAETVEKLETKAGIQKIMKHLCDLFALHGIFSNSGAFLHDGYTSAAQMDMVTASYLDLLAVIRKDAVPLVDAFDFTDQSLNSALGSYDGQVYQRLYEWAQKSPTNQMSPAYERYLKPLLHNTLSKL

SEQ ID NO: 2652 - protein, 703 aa, Arthrobacter globiformis
MTTTATAPEATLDTVETVPSFVQDSWWTPDAGSAASAVAVRDASTGEILAKVSTDGLDLAAVVDYGRTTGQTELGKLTFHQRALKLKELAQYLNARREHFYAFSAQTGATKIDSMIDIDGGIGVLFTFGSKGRRELPNAQVVVDGPMEVLSKDGSFAGEHIYTRIPGVAVQINAFNFPVWGMLEKLAPAFIAGVPTIVKPATPTGYVAAAVVKAIIESNILPKGSLQLISGSVRGLLDVLDYRDLVAFTGSASTAQSLKSHPNVVLGGVRFTSETDSLNAAILGPDAVEGTPEFDAFIKSVVTEITVKAGQKCTAVRRAIVPQDLVPAVVSAIGARVEQRVVLGDPRAEGVTMGALASLEQLADVRAAVQSMLDAGGELAYGTLDSPSVTRADGAKGVVEGGAFMSPVVLSWADAEAEPVHSLEAFGPVSSVIGYKDIPDAVRLAARGGGSLVASVCTNDPSVARELVTGIAAHHGRVLMLNREDARSSTGHGSPVPHLVHGGPGRAGGGEELGGIRSVMHHMQRTAIQGSPNMLTAVTGIWHTGADRNFTVETEGTHPFRKSLESLRIGDAVRSDLRQVTLEDITAFANSTGDTFYAHTNQEAAEANPFFPGIVAHGYLLLAWGAGLFVEPAPGPVLANYGLENLRFITPVAAGDSIRVTLTAKKITPRETDEYGEVAWDAVLTNQNDEIVATYDVLTLVEK

SEQ ID NO: 2653 - protein, 404 aa, Arthrobacter globiformis
MPAVDTLPAADFFGYESLLSAAERRKLGELREFLAAEIAPFAGDWWNKAEFPAHILPKLAALELSTPAQRGYSHLFAGLVIAEMTRVDTSIATFFLVHHDLFVESLYRFGSEDQRSRYLDDASNLRTTGAFALTEPDHGSDVAGGMETRARRISGRTGEADAGGDSWVLNGAKRWIGNGTFCDFMLVWARDEADGAVRGFIVDASLPGVGRSRIENKIALRTVQNADIVFEDVRVAEADRFAGIGSFDDTNELLRGSRIMVAWQAVGQQLAAFDVARQYAVERQQFGRPLARFQLIQQQLVSMLGNAMASMGMMVRIAQLQEHSQLQEQGAGMAQVALAKSYTSARMRETVAMGRSILGGNGIVTDYRMAKIFADAEAIYTYEGSYEINTLIVGRAVTGVSAIT

SEQ ID NO: 2654 - protein, 406 aa, Arthrobacter globiformis
MSNDALDPAEASAEYGLPDPSDVLALDSLLAPDELALRQRIRDFTDQQIRPDIADWYEQGVFPMHLPAQLGELGVLGMHLEGYGCPGRSAVEYGLAAMELEAGDSGIRTFVSVQGSLAMSAIHKWGSEDQKQEWLPRMAAGEVIGCFALTEPTAGSDPSSMTTAARRDGTGEDAGWVLDGAKRWIGLASVADVMVVWARTDDGVRGFLVPAGTEGVTATPIGRKLSMRASIQCDVTFDGVRLGPEALLPGARGLSGPFSCLNEARYGIAWGAMGAARDSYEAALRYSMERLQFGKPLSGYQLTQEKLVNMLVEVQKGTMLALHLGRLKDSGRLRPEQISLAKLNNVREAITVAREARTILGGNGITLDYSPLRHAANLESVRTYEGTDEVHTLILGQHITGLPAFR

SEQ ID NO: 2655 - protein, 566 aa, Ajellomyces dermatitidis
MTDKDDFSAALNPAAPDGATILANERARSSIPVEKFSRYLLTSKYIEQQNRILKANLARPDLYKLALARAKWIRQLKDKVGWNDDEYQMAATLCDDVLPYYLHTAIFIATVLQQGSAAQKVYWMPKLEAWEVIGAYAQTELGHGSNVRGLELEARWDPRTKEFVLHSPHLTASKWWNGTMGRTANYVIAVAQLLLPVSGSGAETKVDPETGEYTKPKNPEVVYGSLTHVRAKLVMEARLALARAVTVAVRYLSIRRQFKDKDALQDTAPEINVLDYPTVQFRILPLLATTFPLHYSGKAMGKLYERTRTDIERSGDFAALAELHSTSSGLKSLCTDISANSIETFEGDNYMITQQVARYLIKKVRELESLRRFLASKDTKLYLSVLTSDEDIVEAFEWRAAYLSFKAYEKREIQKQTWNSLLIDFYRLSRAHSQSILVIKFYNAINNDSNNIPSAQTRSTLRDLFRLFALSTMETEACEFYSCGAISNEHLDAVTPRVFDLMQRIRPHVVSLVDATLGRSDDKVYEELFELAHRQNPLNEIIFNPDYRTDELVLGSGDAGQILSKL

SEQ ID NO: 2656 - protein, 674 aa, Rhodobacteraceae bacterium
MSLHQVSSFAAGMWIAPGAGARTIASAITGAPFATAGNAALDVPAMLDYARNTGGPALRKRTFHDRARMLKALAQELSSHKQALYDLSFETGATQRDHLIDIDGGIGTMFVFASKGRREMPDAQVYLDGDSEQLSRNGTFQGQHICTPLLGAALHINAFNFPVWGMLEKLAPALLAGVPAIVKPATNSCYVTELAVRIMLESNILPPGALQLISGGLGGLLDHLNCQDVVSFTGSADTALTLRQTPAILQNSVRFVAEQDSLNASILGPDAVPGTPEFDLFVKEVAREMTTKAGQKCTAIRRIIAPGAQVEAVINALTARLSKITIGDPRQETTRMGALISNGQKADVLEKAALIGQEAEQVFGNPDAFDLQGPKAGAFVPPMLFHCADPDHAQRVHDTEAFGPISTIMGYHDLDHAVTLVNRGRGSLVTSLITHDPGVARDVVMGSAALNGRIYINDRDSMAESTGHGAPLPHLVHGGPGRAGGGEEMGGVRGVQHYMQRTALQGSPRMLSAITSKWMPGAPEVKSPAHPFTRRLAELQIGETLHTAPRLITLADIEHFAAFTGDTFYAHMDDEAAARNPFFPGRVAHGYLLLSFAAGLFVEPNEGPVLANTGLDGLRFMKPVVAGDSIKVRLTVKQKTLRNDDYGEVRWHVTLTNQHDEPVAEYELLTMNAC

SEQ ID NO: 2657 - protein, 676 aa, Ruegeria sp.
MSLLDVSSFAAGQWIAPGAGARNIASAITGEVIAQAGNDTLNVQGMLDYARSVGGPSLRKMTFHDRARMLKALAGHLNQHKQALYDLSFNTGATQSDHMIDIDGGIGTMFVFASKGRREMPDGHVYLDGDVEQLSRNGTFLGQHICTPLQGVAVHINAFNFPVWGMLEKLAPTLLAGVPAIVKPATATCYVTELAVRLMLESGILPDGALQLVSGGLGDMLDHLGMQDVVSFTGSAETALKLRANPVILRNSVRFVAEQDSLNASILGPDAQPGTPEFDLFVKEVSREMTTKAGQKCTAIRRIIAPESQIEAVIAALSERLAKTQIGDPRLEGTRMGALVSNAQKRDVMEKAAIIGQEATRVFGDPERFDVTGADAAKGAFVPPMLYHCEAPDTAERVHDTEAFGPVSTIMGYRDLDHAIALANRGQGSLVASVITHDPAVAREVAIGAGAYHGRLYFNNRDSMKESTGHGSPLPHMVHGGPGRAGGGEEMGGVRGVKHYMQRTAIQGSPDILSAIGEKWVPGGTEIEGPAHPFTRKFGELAVGETLHTAPRTVTLEDIETFAHFTGDTFYAHMDDEAAKRNPFFPGRVAHGYLLLSFAAGMFVQPDEGPVLANTGLDNLRFMKPVAAGDSIKVRLSVKKKTPRNDEYGEVRWHVTLTNQDDEIAAEYELLTMNAY

SEQ ID NO: 2658 - protein, 500 aa, Trichoplax adhaerens
MADVSEISPRDQAMTIQAKNQQPPVVTLLSKYLDGEYHPLKEDLRQFIRNNKLFNMEYSNLNLQEQRYLAHERAKAILRHPKCKNQLDEQVRGSLDFMKKNLILGEVFAFVDPSTNVKLGVMVFLFGGAIINLGSAAQVQKWLGPLKDLQYTGMFAMTERGHGSNVRCIETEATYNIENEEFIINTPTRSAQKMFIGNGLHGEYAIVFAQLILHNKSKGPHAFIVPIRNENGLYPGVTVVDLGLKEGMNGVDNCLLSFDHVRIPREHLLNKYADVLPNGSYVTDILKDSTRFNIMLAALIGTRLAVANHSTACMSVGLTIAIRYAHRQVASLVDDHQTSGGSIATNREIQALASGIKAYASWACVQTMQICRECTGGQGYMAENRIAGLKGDVDVFVTYEGDNTILLQVQKNGMDSFMAWNECLHHLNALAMSHVERVCYEQFVIAVKQCPYPGPRSILAKCCKLYGLNCIYSDRGWYLEESFINAKMAKCIRTEDIIVA

SEQ ID NO: 2659 - protein, 632 aa, Mus musculus; identical to SEQ ID NO: 2128

SEQ ID NO: 2660 - protein, 438 aa, Bos taurus; identical to SEQ ID NO: 1919

SEQ ID NO: 2661 - protein, 438 aa, Mus musculus; identical to SEQ ID NO: 1833

SEQ ID NO: 2662 - protein, 438 aa, Mus musculus; identical to SEQ ID NO: 1833

SEQ ID NO: 2663 - protein, 640 aa, Cricetulus griseus
MAMRELVEGECGGANPLMKLATHFTQDKALRQEGLRPGPWPPGASAAETVSKPLGVGSEDELVAEFLQDQNAPLVSRAPQTFKMDDLLAEMQEIEQSNFRQAPQRAPGVADLALSENWAQEFLAAGDAVDVAQDYNETDWSQEFIAEVTDPLSVSPARWAEEYLEQSEEKLWLGEPEGSSTTDRWYDDYHPEEDLQHTASDFVSKVDDPKLANSEFLKFVRQIGEGQVSLESAAGSGRAQAEQWAAEFIQQQGTSEAWVDQFTRSGNTSALDVEFERAKSAIESDVDFWDKLQAELEEMAKRDAEAHPWLSDYDDLTSASYDKGYQFEEENPLRDHPQAFEEGLRRLEEGDLPNAVLLFEAAVQQDPKHMEAWQYLGTTQAENEQELLAISALRRCLELKPDNRTALMALAVSFTNESLQRQACETLRDWLRYSPAYAHLVTPGEEGASGAGLGPSKRVLGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSALLAMFGLPQ

SEQ ID NO: 2664 - protein, 688 aa, Saccharomonospora glauca
MVTQATPTMSSTRLLRSYVNGGWHTATDEGVPLRDAVTGEVIARVSSTGIDMGAALEYGRRVGGPALRELTFHQRAALLKALASYLREHRDELYALSARTGATRSDSLVDVDGGIGVLFSYASKGKRELPNDTVYLDGPVEPLGKGGTFVGRHICTPLRGVAVQINAFNFPVWGPLEKFAPAFLAGVPSLIKPASQTAYLTEKLVELMLDSGLLPEGTLQLVCGSVGDLLDHVTDQDLVSFTGSAATAQRLRAHPTIVRNAVRFNAEADSLNCSILGPDATPGTAEFDLYVKQLVTEMTVKAGQKCTAIRRAFVPAELLDEVQQAVCERLSRISVGDPANPEVRMGALASLEQREEVRRSLKALSDAGRIVFGDPDHVEVADADAERGAFLSPVLLRADDPQRAEPHEVEAFGPVSTLLPYTSVEQVVDLAARGRGSLVGSVVTGDAEFARTVVLGVAPWHGRMLVLDADDAKESTGHGSPLPMLVHGGPGRAGGGEEMGGIRGVLHHMQRTAVQGSPKVLTAVGNAWVPGAPRSEGVHPFRKSLAELRIGDSVVAGPRTVTDEDIAHFAEFTGDTFYAHTDRAAAEANPLFGGIVAHGYLVVSFAAGLFVSPEPGPVLANYGLENLRFLTPVKPGDELTVTLTCKQITPRENADYGEVRWDADVTNAAGESVAKYDVLTLVAKENER

SEQ ID NO: 2665 - protein, 403 aa, Staphylococcus aureus
MTFEKETVLKTLFPEDVLSIAKGLTDGEVEFLQQVDSLLESKYRENINQHWIDATVPEDYFKDLGELNYFNNPLLYKDCPNAKMPSQLFQFFMSYLLARFDISLATLLGVHQGLGHNTFYFGGSKEQIAKYVPKLQSHELRTCFALTEPEHGSDVAGGLETVAERQGDTWVINGEKKWIGGAHVSDVIPVFAVNKETGKPHCFVVRPEQDGVDIEVIDNKIALRIVPNALIKLTNVKVDEADRLQNITSFKDIAKILYSTRAGVAYMATGGMAGALRATLDYVTERKQFGKPISKYQLIQEKLAMMQGNLAQAMATCAQLANMQAHGEYDEVATSTAKMMNALRLRETVAMGRGITGGNGILADDYDIARFFSDAEAIYTYEGTHEINALVIGRALTGDSAFV

SEQ ID NO: 2666 - protein, 688 aa, Saccharomonospora glauca; identical to SEQ ID NO: 2664

SEQ ID NO: 2667 - protein, 686 aa, Providencia stuartii
MQQLTSYITGKWLYGEGEGRKIYHALTGQALYEVTTAGLPLVDCLDYGRKKGGDALSAMTFQQRGQMLKAVAKYLLEHKASLYEISAQTGATKSDSWVDIEGGIATLFSFAGLANRELPDDTIWPEDEMIPLSKQGQFIARHILTSRHGVALHINAFNFPCWGMLEKLAPTWLAGMPAIIKPATASAQVTQAMVRLIVESGLVPEGAIQLICGGIGDMFEYLDFEDVVTFTGSAATGQKLKSHPRLREKSTPFTMEADSLNCAILGVDVTPEQPEFSLFIKEVTREMTVKAGQKCTAIRRIIVPKPQLETVKQALLKRLSGITVGDPAVEGVRMGALINQEQRDDVHEKVMYLQQNGCEILCGGDLQELNVMGADSQKGAFYPPTLLYCADPYTNQAVHETEAFGPVATLIGYETSDQAVELAIMGGGSLAGTLVTADTSVAQDVIRRSARAHGRMLILNEASAAESTGHGSPLPLLVHGGPGRAGGGEELGGLRAVKHYMQRTAIQGSPSMLTAVTKQWIRGADVVTDQVHPFRKYFEDLVIGDTLLTARRTVSEADLVNFACLSGDHFYAHMDKIGAAQSLFGERVAHGYFVVSAAAGLFVDAAVGPVIANYGMENLRFIEPVKIGDTIQVRLTCKKKIKKAQKTAEDKPNGVVEWDVQVFNQNNVAVALYSILTLVERREGDF

SEQ ID NO: 2668 - protein, 405 aa, Coccomyxa subellipsoidea
MANFPPAAHDVFLFDDLLSTEEKDIRYRTRAFMEKEVAPIIADYWERAAFPFDLVPRLAKLNLGGANLAGYGCPGQSVIGAAMAVIEIARVDASMSTFLMVHNSLAMLTLGLLASEEQKRELLPDMAALKLIGAWGLTEPSNGSDAAALQTTARKVDGGWVLNGRKRWIGNATFADVIVIWARSSETQQVNAFIVRKGARGLRTSKIENKIALRVVQNADIFLDDCFVADSARLPGVTSFKDTNKVLAISRIMVAWQPVGIACGVFDMCKRYVDEREQFGAALGSFQLVQEKLARMLANLQAMFLMCWRLSKLYEEGKMTHELASTTKAWTTLRGREVVSLGRELLGGNGVVTDFLVAKAFGDMEAIYTYEGTYEVNVLVAGRGITGKAAFKAAPARKQPKNVQA

SEQ ID NO: 2669 - protein, 687 aa, Saccharomonospora azurea
MSRHATPPMSTRLLRSYVGGEWRTAADEGTPLHDAVTGEEVARVSSTGIDMGGALEYGRRVGGPALRELTFHQRAALLKALASHLREHRDELYALSARTGATRGDSMFDVDGGIGVLFSYSSKGRRELPNDTVYLDGAVEPLGKAGTFVGRHIATPLRGVAVQINAFNFPVWGPLEKFAPAFLAGVPSLVKPASQTAYLTEKLVELMLASELLPEGSLQLVCGSAGDLLDHVTEQDLVSFTGSAATARRLRAHPAVVRNAVRFNAEADSLNCSILGPDATPGTAEFDLYVKQLVTEMTVKAGQKCTAIRRAFVPAELLDDVQEAVCERLARISVGDPSNPDVRMGALASLEQREEVRRSLKALSDAGRIVFGDPDHVEVVGADAERGAFLSPVLLRADDPQRAEPHEVEAFGPVSTLLPYTSAEQVVELAARGQGSLVGSVVTGDAEFARDVVLGAAPWHGRMLVLDADDAKESTGHGSPLPMLVHGGPGRAGGGEELGGIRAVLHHMQRTAVQASPKVLTAVGNSWVPGAPRSEGVHPFRKSLAELRIGDSVVAGPRIVTDSDVAHFAEFTGDTFYAHTDEAAAAANPLFGGIVAHGYLVVSFAAGLFVSPEPGPVLANYGLENLRFLTPVKPGDELTVTLTCKQITPRENADYGEVRWDADVTNAAGDSVAKYDVLTLVAKEAAR

SEQ ID NO: 2670 - protein, 688 aa, Ostreococcus tauri
MSAQARNVDAHTRALVEPSTAVILASTSDPREDLARERSKASFDARELENLLAGGPKSASLRRRIVDAMTSNEVFSKRGKYFDERDELYVRTLKMYLALPSAVAAMNEKEPIAVARIMRELIDEPGGLDLHLGMFIPTIQGQGDEEQRKYWIPKCVKLECIGTYAQTELGHGTYLRGLETTATYDESKEEFVIHSPTLTSTKWWPGGLGKTSTHAVVMARLFTKGVDHGVHPFVVQIRNNQNHEPLPGCTIGDIGNKMGYNAVDNGFLRFDHVRVPRRAMLMGHSRVETDGTYVPPPVAKVSYGTMVFIRSDIVMNAALFMKKAVTIAIRYNLVRRQSNADKATGMERQVIDYQHSQRTLFPILAMAFAFHCTSDYMRRMYFEFQKVSREKQDFSALPELHATSSGLKAYCSWMTKDAIEACRLTCGGHGYMNLAGFGTTLASYAPNVTYEGDNNVLCLQTARYLLKMYRNTIKGETPPDVIGYLKGTSSRSSLALGSTMRDENAILDAYAHRAWRMVTEASKVTGDMSPDDAMRVHMVQWIRAAKAHCAFVVMYNFVIAYEETRPRVSATTLLVLHRLVCLHGLCGMDDTMGDFLEDGYIDGDQATEIRAEIFRLLAEIRPDAAALVDSFGLSDYFLNSALGAKDGDVYRRLYEQVQDAPFNKRHTPPGYELLQPKLRRGTFGVSRL

SEQ ID NO: 2671 - protein, 695 aa, Rhizopus oryzae
MSFDNNVATKFPNLAPKGPSGELFLANERAKATFDVEELSKFMYTEGQLQKINKVLQVLESDPAFDKTNRYYESREDKITTSLWKDRRLIEVAKEQNWDARDFQIANLLFDQSSPFTLHYNMFIPTLQTQTTDEQKKLFLEPALKHEIIGCYAQTELGHGSNVQGLETTATYIPETQEFELHSPTLTSSKWWIGGLGKAATHAIVMARLITDGKDFGPHPFCVHIRSLEDHRPLKGITVGDIGPKFGFNSVDNGFIMFDHYRIPHVSFLAKYSQINKSTGEYIKPPNAKLSYGTMVYVRANLIMNVHFALAKATTIAVRYSAVRQQFVDASNPRKWDNKIIETPVLDYTMQQYRLLPTVASAYACFFTGREMLRLYNLNQKAMQQGNFSILADLHASSSGLKSLTTTMASDAIEDCRRACGGHGYSLFSGLGQFYQDYLPNVTWEGDNYILTQQTARHLLKTFRNVIAGKAEVSEYNQTVNYLTQFMQNPKAKCPVTKPSDFLNPEMILSAFGFRAAYGISQVAEQLDRHGRSWNSMLVEINRISRAHCQFILVRNFIVTLQNDSQLSGPQKKPIVHVLRLLACLFALTTMEKELSEFLVSGYLSSEQSQMLKQQVIELLDKVRPEAVSLVDAFALPDYFLHSALGRYDGRVYESMTEMAEREPLNHTLVVDGYKECIQPFVKKVRNTNTETAKL

SEQ ID NO: 2672 - protein, 704 aa, Rhizopus oryzae
MTVRFPKHLKPIEPQGKRLLQQERQHATFDANDLMYHIYGKEYIERRDRILRILENDPTLGDKSHRYYNGRAIRFKKSLAAAKRFAELQRIHHWNDEDFAVAESLFDEASAFRLHRSMFMPTIANQGTEEQKKIYLEPALKYEIIGCYAQTEASYLTTTPSLLGHGSNVRGLETTATYQPETETFVLNSPTLTSSKWWIGGLGAAANHAIVMARLISLGNDYGPHPFIVQIRNLENHEPLKGITVGDIGPKFGFNTVDNGFILFDHVHIPHISMLARYSRIDRKTGEYITPPNSKLAYGTMVFVRANIVLESCLVLARAATVAIRYSAIRVQGSDTSNPKKLTDADGTVKTIETPVLDYTMQQYRLFPIIAQAYACHFTGQQMHRMYNENQEKMAQGDFSYLADLHASSSGLKSLTTTLAVSAIEECRRACGGHGYSLFSGLGHFYQDYLPKATWEGDNYLLTQQTARYLIKTMRSVRAGKINSSFSAQYLAEYISSPQARCPFVHIDNLNNPESLLNAFKFRSAFLIDKVVYALDTEKMSWNDMLIEIYRISRAHCQLLLVSNFILAAFDKSDSLKPGIAHALQQVAILFCISTLEQESADFLTCGYLSPEQVLMIKRHLVCILKSIRPNAVALVDAFGLPDYMLNSALGENDGYVYEKMTAMAELEPLNQAKVVDGYEDFIRPLIHNGKHNWRIGKDGVARL

SEQ ID NO: 2673 - protein, 669 aa, Rhizopus oryzae
MSRQAPKDMARERAACEFNIEELAKLWAGGEKKYELLQKAFEFIRSDPELVIQPPRNFLELSRDEMREFTMGQIYRATQILKDTKDKDFAMEIIRAINLYSESFSMRFFVHYALFRNVVNMLGNEEQQRRYIDDIDNFRIFGCFAMTELGHSSALRDMETTATYDIATDEFILDSPTITSTKWWIGMAAQTATHAVVIAQTVIDHKRVGLNWFVVQLRSKYTGELEPNVQIGDIGQKAGHAGVDNGWIQFRQKRIPRKDMLAKWVDLNHHGHYTPAPNPAVMYATLIPERLAMTNVTTQLISQALTIATRYGIVRRQGSKNQQIMDYQSHYVKLIPAIAFMYMVQSTSDVLNGQFNILTSGGKMDPADYLRHMGDMHAMSACLKGLTGWYGSEILETCRRGCGGHAYSAYNGISHLIGEWGVMTTGGGDNVVLLQQAARYLLHQLEQQLEFDEYPSFKFKSSIDYIKDSKRYLKNKTWSVYHASDGIKDFTVLLEAMYSILLHSISMSIKKSTAEDVLLECVRVAEMHCAVFMFSVGAEKYGHPTGTPNIEPSVLAIMKKLTALWGFHVLYTYSDQGFKEEYLTPDHIKSIEETYIDICKSLRSQVIGLTDGFAIPDFVIKAPIAKYNGDIYEAYFDTLLSAPKSTGVPPYHAKYIKPLTERENHEVKK

SEQ ID NO: 2674 - protein, 699 aa, Rhizopus oryzae
MSTFNNNIATKFPDLKPRGPGGEALLEAERAKTSFDVKSLSKFMYTEEWLDKMYKVLRVIENEPAFDKTNRYYQSRADKIKTSLWKDRRMIEIAREQNWDEQELQIANFLFDQSTPFSLHYGMFIPTLQSQTTDEQKKLFLEPALKHQIIGCYAQTELGHGSNVQGIETTATYIPETNEFELHSPTLTSSKWWIGGLGKAANHAIVMARLITDGKDLGPHPFCVQIRSFEDHTPLKGVTVGDIGPKFGFNSVDNGFIMFDHYRIPHISFLAKYSQVQPGTGVYSKPPNAKLSYGTMVYVRANIVMGVRYALAKATTIAIRYSTIRQQFVDAASPKKWDNKVIETPVLDYTMQQYRLLPIVASAYACFFTGREMLRLYDLNQKAMQKGNFNLLADLHASSSGLKSLTTTMAIESIEDCRRACGGHGYSMFSGLGQFYQDYLPNVTWEGDNYILTQQTARYLLKTFRNVVAGKAEPSEYNHTISYLTQYLQNPTAKCPATKPSDFLNPELILSAFGFRAAYGIAKVAEKIDREGRSWNSMLVEISRISRAHCQFILVRNFIVTLQNDATLTQSEHKPINKILKTLAALFALHTMEKELSEFLLSGYISSEQCAMLKEQVISLLDVVRPDAVALVDAFALPDYYLHSALGRYDGCVYEAMTKMAEAEPLNHTLVVEGYEENIKPFVHQGKVFAKKDAAFSRL

SEQ ID NO: 2675 - protein, 714 aa, Rhizopus oryzae
MSAKQRLNAVRQHLTKEELYAKAVDPVTSMNEERAKATFNIRELTHLLDGGEKSTLLKERFMQEFERDPLFKMDDIHDITKDELRERTMEKFRSLIHHLSNESVDIFKKRMEIVSLIDPGFWTRFGVHYGLFVGALQSNATSGQLGYWFQNGALSLSGMVGCFAMTELGHGSNVPGLETTAIFDEASDQFIIHTPTLTATKWWIGGAAHSATHAAVFAQLIVKGKNYGTKCFVVPLRDPKTYNLLPGVNIGDIGKKMGRDGIDNGWIQFTHVRIPRSYMLMKHTKVSRTGLVKEPKLQQLTYGALLQGRVAMVVDSGNVSKKALTIAIRYAAVRRQFSNSNSNIETKLLDYPIHQRRLMPLMAQTFAMLFTGSEMTAMYNKMMSRLENAKPEDTDLEEVLEMLKETHSTSAGLKAFCTWNCLNTIEACRQACGGHGYSAYTGLAGMYQDFAVQCTWEGDNTILTLQLGRYLISSFREAVKGKKLSPGVGYLNKLDSLIGACCSEKDADAILNPQTIVKGWQVVCANVVKNAALEFEQCIKQGLSIDDAYEQCSQSRLYAAKLHSYGYLFNRFLDGVSKVEGNLKVVLMDVCLLYGLYTIEENAGAFLQYGYFSPTQMDLIRLRTNEFCRAVRDQAIPLVDAFNLSDYVINSPLGRADGDVYVHYFEQVKRSNPQNPHPYFNRLIKPLIEREMNDDIVDEEGGLEEEEDEDDEME

SEQ ID NO: 2676 - protein, 675 aa, Amycolatopsis mediterranei
MALLRSYVSGSWHTAADEGVPLHDAATGEEVARISSAGVDFAAALAYGRAVGGPALRELTFHQRAALLKALASHLREHREELYALSARTGATLGDSKFDIDGGIGVLFSYGSKGKRELPNDTVYVEGAVEPLSRGGTFVAQHIATPLRGVAVQINAFNFPVWGPLEKFAPAFLAGVPSLVKPASSTAYLTARLVELIIESGILPEGALQFVAGNVGDLLDHVTAQDLVSFTGSASTAQKLRAHPAIIRNAVRFNAEADSLNCSILGPDAVKGTTEFDLFVKQLTTEMTVKAGQKCTAIRRAFVPASLLDDVAAAASERLAKVTVGNPASEGVRMGALASLEQREEVRRSLKALLDAGSVVFGDPEKVEVVDADAERGAFISPVLLKADPERTEPHEVEAFGPVSTLMPYTSTEQVVDFAARGGGSLAGSIVSADKEFVREVVLGAAPFHGRLLVLDAEDAKESTGHGSPMPQLVHGGPGRAGGGEEMGGIRGVLHHMQRTAVQGSPAVLSAVTGRWVAGAPRTEGVHPFRKSLAELRIGDSVVAGPRVVSQEDVDHFAEFTGDTFYAHTDPAAAAANPLFGGIVAHGYLVVSFAAGLFVSPEPGPVLANYGLENLRFLTPVKVGDSLTVTLTAKQITPRIDQEYGEVRWDADVTNADGESVAKYDVLTLVSKEQP

SEQ ID NO: 2677 - protein, 679 aa, Rhodococcus imtechensis
MSKLLESYAAGRWYTAPDEGTPLLSAVDGSEVARISATGLDLGEMVTYAREVGGPALAKLTFHERAAALKALALTLMAGKDEFYALSTSTGATKRDSGVDIDGGFGTLLSYASKARRELPNDTVYLDGAFEQLGKEGTFLGQHVYTSRRGVAVQINAFNFPVWGFLEKLAPAFIAGVPSIVKPASQSAYLTELVFRRIIESGLLPEGSVQLLSGSARGLLDHLGGQDSVAFTGSADTAATLRAHPNVVGEGVHFNAEADSLNASILGSDVEPGSEEFDLYVKQLVTEMTVKAGQKCTAIRRAFVPTALMDDVIAAAEARLSRVVVGAPDAEGVTMGALASLEQRDEVLKSLRGLTKTAQIVVGDPENFEVVGADKATGAFLPPILLRSDDKDATEPHDIEAFGPVSTVIGYDSTDEVIELAARGKGSLVASLVTRDSALARDIVLGLAPFHGRVLVLNRDDAKESTGHGSPLPVLVHGGPGRAGGGEELGGIRGILHHMQRTAVQATPDILTAVGNKWVTGSQRNDDGTHPFRKNLAQLRIGDTIVGGPRQVTLADIGHFAEFTGDTFYAHTDPEAAAANPLFGGIVAHGYLVVSLAAGLFVEPNPGPVLANFGVDNLRFLTPVKADDSLTVTLTAKLITPRSSADYGEVRWDAVVVNQDGDPVATYDVLTLVAKGENA

SEQ ID NO: 2678 - protein, 679 aa, Rhodococcus imtechensis; identical to SEQ ID NO: 2677

SEQ ID NO: 2679 - protein, 687 aa, Saccharomonospora xinjiangensis
MGTHATPSAQARLLRSYVSGRWHTPADEGAPLHDAATGEEVARISSAGIDMGAALEYGRRVGGPALRELTFHQRAALLKALASHLREHREELYALSARTGATLGDSKFDIDGGIGVLFSYSSKGRRELPNDTVYLDGPVEPLGKGGTFVGRHICTPLRGVAVQINAFNFPVWGPLEKFAPAFLAGVPTLIKPGSQTAYLTERLVELMIGSELLPEGSLQLVCGSAGDLLDHVTGQDLVSFTGSAATAARLRSHPVIVRNSVRFNAEADSLNCAILGPDAKPGTPEFDLYVKQLVAEMTVKAGQKCTAIRRAFVPAELIDDVQEAVCARLARISVGDPSNPEVRMGALASLEQREEVRRSLKALKDAGRIVFGDPDHVDVVGADAERGAFLSPVLLRADDPERTEPHEVEAFGPVSTLLPYTSTEQVIELAARGQGSLVGSVVTGDADFAREVVLGVAPWHGRLLVLDADDAKESTGHGSPLPMLVHGGPGRAGGGEEMGGIRGVLHHMQRTAVQGSPKVLTAVGNSWVQGAPRSEGVHPFRKSLAELRIGDSVVAGPRTVTDADIAHFAEFTGDTFYAHTDEQAAEANPLFGGIVAHGYLVVSFAAGLFVSPEPGPVLANYGLENLRFLTPVKPGDALTVTLTCKQITPRENADYGEVRWDTDVTNAEGESVAKYDVLTLVAKESER

SEQ ID NO: 2680 - protein, 666 aa, Actinoplanes missouriensis
MLESYAAGRWFRAADEGEPLRDATTGEEVARISSRGLDVTAMVQHARQTGGPALRALTFHERAAALKAVAKLLMAGKDEFYALSVRTGATTRDTAVDVDGGIGTLFSFAGKGTRELPNDTIVLDGAVERLGKGGTFVGQHIYTSRPGVAVQINAFNFPVWGMLEKLAPAFLAGLPTIVKPASQTAYLTELVVRRIIESGLLPEGSLQLIAGSAGSLLDELDLQDSVAFTGSAHTAGILRRHPNVIDGGVRLGVEADSLNCSILGPDVRADDPEFDLFIKGVVTEMTVKAGQKCTAIRRVIVPSQIAGQVEDALAARLAKITVGDPRDPEVRMGPLASVGQRDEVVKAVEALRAGSEIVIGSLEERGAFVNPLVLRAAPGAVEPHNVEPFGPVSTVLTYDGLNEAVTLAARGRGSLVASVATHDPEVARTVVLGLAPWHGRVLVLDRDDAKESTGHGSPLPMLVHGGPGRAGGGEELGGIRAVLHHLQRTAIQASPDLLTAVTGQWTTGAQQRAEDVHPFRKSLADLRIGDTIRSGTRVVSLADIDHFAEFTGDTFYAHTDPEAAARNPLFGGIVAHGYLVVSLAAGLFVEPSPGPVLANYGVDNLRFLTPVKAGDAIAVTLTVKQIKPRNSADYGEVRWDAVVTNQNGEAVATYDVLTLVAKTWES

SEQ ID NO: 2681 - protein, 777 aa, Stigmatella aurantiaca; identical to SEQ ID NO: 876

SEQ ID NO: 2682 - protein, 687 aa, Saccharomonospora xinjiangensis; identical to SEQ ID NO: 2679

SEQ ID NO: 2683 - protein, 804 aa, Corallococcus coralloides
MLDAPSRPSARELLSLPSLAPLVPMLYVAWTDGELTGDELRALGAAARSQPWLDLKSSSILALWVDPLRPPPPRELALVREHIRATAEKLATSQQQNLAELGVQLAQALAGEAPLNIPPAELAKALASIEATLGVDGKEAVRSLVPKASRVPKAEPRSHAASFDPVAMTAVLERTYSDVRQRVRGWLEDADFRYKEGLTTTAYRDQVFDWLKHLANDGLGQLAFPKGREGGGDLGAFIAAFETMAFFDLSLVIKAGVHFGLFGSSILFLGTKRHHQQYLPRVASLELPGCFAMSELGHGSNVRDCETVARYDAATGEFVLHTPSETARKEWIGNAARHARIATVFAQLEVDGERLGVHALLVPLRDEKGKVLPGIRIEDCGEKMGLNGVDNGRLWFDHVRVPRDNLLDRYGQVTEAGEYTSSITGDSKRFFTMLGALVAGRVSVACASLSAAKSALTIAVRYGDLRRQFGPQGAPEVRLLDHQVHQLRLLPLVAKAYAVDFALEYLVDRYVHRTEDDAREIEALAAGLKAYASWNATATIQECREACGGQGYLTANRFASLKADTDVFTTFEGDNTVLMQLVAKGLLTGYRQRFEDDRVFAVLRLIVDQAATVFTDRNPIAGRRTDTDHLRDSDFQLRALRFREEALLASVSKRIRKRLTAGVEAFEAFNQVQAHLLALAHASVERIVLEQFLRGVADVKDEALKPVLGRMADLFGLSCLESASGWFLEHGWLTAPKAQAIRKERVKLCEELRPDAVGLVDAFGIPDTCLAAPIGLGRLAPGGERFDDTAADSARAGPADSRAS

SEQ ID NO: 2684 - protein, 402 aa, Streptococcus oralis
MATKEEILRELYPEDLFHYADGLTLGEAKVLQETRRLIEKHLRPVINEYWEKPDFPFEEFYAVAKGAQIMNNPKLFEGREGSWKPSELYIAFLYLELARFDASMATFYTVHGGLCYNTILLGGDERQQKEFLPKLAAFDWQGCFALTEPLSGSDIAGGLATTAERVGDKWILNGEKRWIGGSDTADVVPVFARDVADGKVKCFIVRKGAPGYHAEPIPHKIALRCVRNGHITMKNVEVPDSDRLVNINGFGDVARILTFTRADVAHIAMGVTCGSYVSALKYAKDREQFKRPIAKFQIVQEKLARMQANAVAVIAYSTRIAEMQEKGNELMLNSALAKMHNSLVMRETVALARETCGGNGITLETDVARFFADAESIYTYEGSHEVNALIVGREITGLGAFV

SEQ ID NO: 2685 - protein, 402 aa, Streptococcus constellatus
MATKEEILRELYPEDLFHYADGLTLGEAEVLQETRRLIEKHLRPVINEHWEKPDFPFEQFYTVAKGAQIMNNPKLFEGREGSYKPSELYIAFLYLELARFDTSMATFYTVHGGLCYNTILLGGDERQQKEFLPKLAAFDWQGCFALTEPLSGSDIAGGLATTAERVGDKWILNGEKRWIGGSDTADIIPVFARDVADGKVKCFIVRKGAPGYDVEVIQHKIALRCVRNGHITMTNVEVPDSDRLVNINGFADVARILTFTRADVAHIAMGITCGSFNAALKYATNRQQFKRPIAKFQIIQEKLARMQANAVAAIAYSVRIAEMQEAGNELMLNSALAKMHNSLVMRETVALARETCGGDGITLETDVARFFADAEAVYTYEGSHEVNALIVGREITGLGAFV

SEQ ID NO: 2686 - protein, 402 aa, Streptococcus anginosus
MATKEEILRELYPEDLFHYADGLTLGEAEVLQETRRLIEKHLRPVINEHWEKPDFPFEQFYAVAKGAQIMNNPKLFEGREGSYKPSELYIAFLYLELARFDTSMATFYTVHGGLCYNTILLGGDERQQKEFLPKLAAFDWQGCFALTEPLSGSDIAGGLATTAERVGDKWIINGEKRWIGGSDTADVIPVFARDVADGKIKCFIVRKGAPGYDVEVIQHKIALRCVRNGHITMTNVEVPDSDRLVNINGFEDVARILTFTRADVAHIAMGITCGSFVAALKYTTNRQQFKRPVAKFQIIQEKLARMQANAVAAIAYSVRLAEMQEAGNELMLNSALAKMHNSLVMRETVALAREVGGGDGITLETDVARFFADAEAVYTYEGSHEVNALIVGREITGLGAFV

SEQ ID NO: 2687 - protein, 452 aa, Deinococcus gobiensis
MTTKSGPNPMALLAQIDLEALGRLSEKVDLAALLGAASKMSDKQLSQLTRMMAGGEHKRPELPAPDADFFGQLDGLSDDERAVAATTKAFMHDHVAPIMNEYWNRDEFPRHLIPELRKLDLLRKVWNEDGSRKPNATVVEGLITMEACKVDVSTAVFFGVHAGLAFASIALGGSAEQKAEWLPKMMDLEAIGAFGLTEPEGGSQVSQGMRTTCKRDGDGWTLRGEKKWIGNSTFSDFTVIWARDVDTQEVRGFIVRAGTPGYEVKKIEGKTALRIVENGQITLTDCRVPDTDRLQEVRGWRTTAEVLKLTRAGVAWQGVGCAMGAYELALAYAQNREQFGKRIGEFQLIQNHLVHMLGNVTGMLATVLRLSHMADAGEMRDEHAALAKVVTAARCRETVALARETLGGNGILLENGVAKHFADTEAIYSYEGTNEINTLVVGRAVTGLSAFV

SEQ ID NO: 2688 - protein, 677 aa, Drosophila melanogaster; identical to SEQ ID NO: 2649

SEQ ID NO: 2689 - protein, 402 aa, Streptococcus oralis
MATKEEILRELYPEDLFHYADGLTLGEAEVLQETRRLIEKHLRPVINEYWEKPDFPFEEFYAVAKGAQIMNNPKLFEGREGSWKPSELYIAFLYLELARFDASIATFYTVHGGLCYNTILLGGDERQQKEFLPKLAAFDWQGCFALTEPLSGSDIAGGLATTAERVGDKWILNGEKRWIGGSDTADVVPVFARDVADGKVKCFIVRKGAPGYHAEPIPHKIALRCIRNGHITMKNVEVPDSDRLVNINGFGDVARILTFTRADVAHIAMGVTCGSYVAALKYAKDREQFKRPIAKFQIVQEKLARMQANAVAVIAYSTRIAEMQEKGNELMLNSALAKMHNSLVMRETVALARETCGGNGITLETDVARFFADAESIYTYEGSHEVNALIVGREITGLGAFV

SEQ ID NO: 2690 - protein, 678 aa, Mycobacterium abscessus
MTAVLQSYITGKWTTPKGDADPLVNAATGDEVARYAVGSVDLAAVVAYGREVGGPALRALTFHQRAAALKALAKQLMAAKNDFYPLSAATGATARDSAVDIDGGFGTLFSYASKGVRELPNDTIYLDGASESLGRAGTFVGQHIYTSRPGVAVQINAFNFPVWGMLEKLAPAFLAGVPSIVKPAHQTAYLTELVFRAIIDSGLLPEGSVQLLCVRSHELLDHLDGQDTVLFTGSAATAAKLRSHRNVVTDGVRLNAEADSLNCSILGPDATPGTPEFDLYIKQLVAEMTTKAGQKCTAIRRALVPEALVDAVVTATSERLSKVVVGNPELDSVRMGALASIDQRDEVLRSLKLLQDSATLVFGDPESFTVEGADAAQGAFLPPLLLRAEDPTAAAVHEVEAFGPVSTVIGYRDLDDAVELAARGQGSLVGSLVTHDPEVARKVTIGIAAHHGRILVLDRDDAKESTGHGSPLPTLVHGGPGRAGGGEELGGIRGILHFMQRTAIQASPDMLTAITGRWTTGSARTATEVHPFRKHLEELQIGDTIVGGPRVVSLEDIDHFAEFTGDTFYAHTDPDAAARNPLFGGIVAHGYLVVSLAAGLFVEPNPGPVLANFGVDGLRFLTPVKPGDALTVTLTAKQLTPRLSADYGEVRWDAVVTNQNDDPVATYDVLTLVAKKES

SEQ ID NO: 2691 - protein, 666 aa, Actinoplanes missouriensis; identical to SEQ ID NO: 2680

SEQ ID NO: 2692 - protein, 687 aa, Saccharomonospora azurea; identical to SEQ ID NO: 2669

SEQ ID NO: 2693 - protein, 403 aa, Staphylococcus aureus
MKFEKEKVLKSLFPEDVLSIAKGLTDGEVEFLQQVNHLLESKYRPDINQHWIDATVPEDYFKDLGELNYFNNPLLYKDRPNAKMPSQLFQFFMSYLLARFDISLATLLGVHQGLGHNTFFFGGSKEQIAKYVPKLQSHELRTCFALTEPEHGSDVAGGLETVAERQGDTWVINGEKKWIGGAHVSDVIPVFAVNKETGKPHCFVVRPEQDGVDIEVIDNKIALRIVPNALIKLTNVKVDESDRLQNITSFKDIAKILYSTRAGVAYMATGGMAGALRATLDYVTERKQFGKPISKYQLIQEKLAMMQGNLAQAMATCAQLANMQAHGEYDEVATSTAKMMNALRLRETVAMGRGITGGNGILADDYDIARFFSDAEAIYTYEGTHEINALVIGRALTGDSAFV

SEQ ID NO: 2694 - protein, 688 aa, Saprospira grandis
MSTTPNISNFALGQWQPHEGEGIAQYNAVTGQLISTVGSQGLDYAAMAQYAREVGNRNLRKMTFHQRGRMLKKLALHLYGMRKKYYPLSYQTGATKVDSWIDIDGGIGTLFAYASLRKKFQDQPYFVDGETAPLSKEGTFVGQHIMVPRRGVAIHINAFNFPIWGMLEKLAVNLLAGMPAIVKPAEQTSYLTQAMVQDIVASGILPEGALQLVCGSGVGILDSVTSQDVVTFTGSASTGRMLKSLPQIVEQAVPFNMEADSLNCSVLGLNALPGTPEFDLFIKEVRKEMTVKAGQKCTAIRRILVPRQQMDAVQEALSQQLAKTVVGDPQLEGVRMGALASKEQVAEVRKQVGLLAEENELVFGQMTDFEVMGASAETGAFLAPMLMRSADGFKASRVHELEAFGPASTLIPYDNTEEAAALARMGKGSLVASIVTADDQEAREFVMEAASHHGRILILNRDSAKESTGHGSPMPLLSHGGPGRAGGGEEMGGMRGVKHYLQRTALQGSPTTLSNVTQTYQYGGRYIEDQVHPFRKHFEELQVGETWITHKHTVSETDITNFANVSGDNFYAHMDATSLEGTIFEQRVAHGYFVLAKAAGLFVEPRKGPVLLNYGLEECRFVKPVYPGMTIGVRLTVKEKVAQEKREPEDIAKGIVKFLVDVYDETGESVAIATILTMVKMLDQNGID

SEQ ID NO: 2695 - protein, 679 aa, Gordonia polyisoprenivorans
MSRLLESWTQGRWYAAPDEGTPLLDAVDGSEVARISATGVDRAAMVEYARTVGGEALASLTFHERAGLLKQLGLTLMAGKDEFYELSRKTGATDRDSAVDIDGGFGTVLSYASKARRELPNDTVYLDGPVEPLGKKGTFLGQHLYTSRRGVAVQINAFNFPVWSFLEKLAPAFIAGVPTIVKPASATAYLTELVVRRIVESGILPEGSVQLLCGSAGDLLDHLDGQDSVAFTGSADTAAVLRAHPTVVASGLHFTAEADSLNASILGADIGVDDPEFELYVRQLVTEMTVKAGQKCTAIRRALVPEPLVDAVVEAASTRLAAIRVGNPAAPDVRMGALASIDQRDEVLKSLRGLTKSADIVLGDPDHVELVDAERSKGAFLSPILLRANDSWAPEIHDIEAFGPVSTVIGYRDTDDAIALAARGRGSLVASLVTADTDVATTVVRGIAAYHGRILVLNAEDAAESTGHGSPLPVLVHGGPGRAGGGEELGGIRGVLHHMQRTAVQGTPNILTAIGRRWVSGADRVHTDVHPFRKNLSQLQIGDTIVGGPRQVTRADIDHFAEFTGDTFYAHTDPEAAAANPLFGGIVAHGYLVVSLAAGLFVDPAPGPVLANFGVDGLRFLTPVKAEDSLTVTLTAKQITPRQSADYGEVRWDAVVTNQNDDPVATYDVLTLVAKAEKE

SEQ ID NO: 2696 - protein, 640 aa, Cricetulus griseus; identical to SEQ ID NO: 2663

SEQ ID NO: 2697 - protein, 681 aa, Saccharomonospora viridis; identical to SEQ ID NO: 2254

SEQ ID NO: 2698 - protein, 403 aa, Staphylococcus aureus; identical to SEQ ID NO: 2693

SEQ ID NO: 2699 - protein, 832 aa, Flavobacterium branchiophilum
MINHTQHYVQGKWVVASGEGIPTFDAITGEYVATTSVEGLDIPSILQYGRTKGGEKLRKMTFQERGNMLKSLAIYLTKKKEIFYELSYKTGATRTDSWIDIEGGFGNLYANASLRKLFPNLPYHVEGDPIDLSKGGRFMAHHLLVPKKGVAIHINAFNFPIWGMLEKCAVNWMAGMPAVVLPAPVTAYLTEAVVKEIIASNIIPEGALQLISGTVTNIFDTVESQDVVTFTGSAATGRILKSHPRIIQEAVPFTLEADSLNASILGEDALPGTPEFQLFIQQARSEITVKAGQKCTAIRRLIIPENVIDEVQNALSKALDQVNIGNPRLKEVRMGALVSKKQVEVLHSRIQELSQSAAIVYGNLQQINLMGANEKGAFVSPTLLRENQPFNNAAAHEIEAFGPVATLMPYQNLEQAITLAQMGKGSLVSSIVTYSDKIAKDYVINAASHHGRILVLNRENAKQSTGHGSPLPLLVHGGPGRAGGGQEMGGVRGIKHYMQRCAIQGSPTTLTEITEIYQPKSAYKPISQHPFQYHWEDIQPGMSLQTHNRTVTDTDIINFSNLTWDHFYAHTDITALEGSIFKKRTAHGYFILAAAAGLFVYPNKGPVAANYGLEECRFLKPIYHNDTIYVRLTCKQKIDRDVVAAEHPSGIVKWFVEVFDTQNELVAVATILTMVQKKQTVFVEMTHEKIQECLNKLTENTQPKWGSMTAQHMLEHLEFGYKIAAGIIQNFELITPNHILEKVHHTLYNYNKMPQNFDFPLAQLSQIETVKHANLDEAKHHFWEARAAYLQFFETHPNILLKNAVFGNMNRYEWYLLDRKHLNHHFEQFDIL

SEQ ID NO: 2700 - protein, 832 aa, Flavobacterium branchiophilum; identical to SEQ ID NO: 2699

SEQ ID NO: 2701 - protein, 845 aa, Lacinutrix sp.
MEKIKHYVQGSWTTGKEEGTPILDAVTGEAFTSVAIEGLDVPEILNYGRTKGGEVLRKMTFQERGNMLKKLALYLTKRKDAFYDLSYRTGATKVDSWIDIEGGFGNLFANASLRKLFPNQPYHVEGDAIDLSRGGRFMAHHIMVPKKGVAVHINAFNFPVWGMLEKCAVNWMAGVPAVVLPAPSSSYLAEAVARTIIDSGILPEGALQIINGTVKNILDTVESQDVVTFTGSAQTGRLLKAHPRLIQESVPFTMEADSLNASILGEDAVPGTPEFDLFIKEVRKEMTVKAGQKCTAIRRIIVPEKLVDDVETALAKQLDKVTIGDPRLKEVRMGSLVSHQQVQAVRDSVNDLSKEAQIVYGNLNEINTIGADAKKGAFISPILLRADNPFQNTVIHEREAFGPVSTIMPYKNLDEAITLAQMGKGSLVSSIATNDDKIAKEYVINAASHHGRILVLNRESAKQSTGHGSPLPYLVHGGPGRAGGGEEMGGMRGIKHYLQRTAIQGSPTTITEITGIYQQNAKYKEAEQHPFQYHWEDIQPGMSLKTHKRTLTDNDIQNFANLTWDHFYAHTDITSLDGSIFEKRTAHGYFIISAAAGLFVYPNKGPVAANYGLDSIRFLRPLYHNDTIYVRLTCKEKVDRDVASAEHPSGIVKWHVEVFDANFENRPESQKTEKDSPLVAVATILTMVEKKQETFVEMTSEKIDECLSNLKADAKPKWGIMTPQHMIEHLEYTYKIASGEIQDFDVNTPEKILEKVHHSLYNYDKFPKNSQFPHLEKDTLDDLKHADLETAIEKFKEQREKYIEFHKENPDVKLKNLVFGELNKYEAYLLERKHLNHHFEQFNLL

SEQ ID NO: 2702 - protein, 685 aa, Pseudonocardia dioxanivorans
MTAPTTVPTLRSYVAGAWHSPDPAGARPLHDAVTGEEVARLSSAGVDFGAALSYGRGVGGPALRELTFHQRAGLLKALAGHLREHRDELYAVSARTGATLSDSKFDVDGGIGVLLAYASKGRRELPNDTVYVDGAVEPLGRGGTFVGQHVATPLHGVAVQVNAFNFPVWGPLEKLAPAFLAGVPSLVKPASPTAFLTSALVELIIDSGLLPEGSLQFVAGGVGDLFDHLTGQDLVSFTGSAATAATLRTHPTIVRESVRFNAEADSLNMSILGPDVAPGSPEFDLYVSGVVAEMTIKAGQKCTAIRRAFVPEQHVEAVVEAVSARLATTVVGAPDAEGVRMGALASLDQRGEVRRNIAALADAGRIVHGDPGKVDVVGADAERGAFLSPVLLTADPDRAEPHAVEAFGPVSTVMGYSSIPQVVELAARGNGSLAGSVVTADPAVAREIVLGVAPWHGRVLVLNERDAKESTGHGSPLPALVHGGPGRAGGGEEMGGIRGVLHHMQRTAVQADPDTLTAITGRWVRGSQRRETDVHPFRKHLEELRPGDTIVAGPRRVTQEDVEHFAEFTGDTFYAHMDAAAAAANPLFGERVAHGYLVVSLAAGLFVDPDPGPVLANFGVDDLRFLTPVRFGDELTVTLTCKQLTPRDTAGYGEVRWDADVTRQDGESVARYDVLTLVAKKETAS

SEQ ID NO: 2703 - protein, 404 aa, Aerococcus urinae
MVKESRADIDAVEKMFYSDLYNYAEDLTDGERKVLKEVEKVLKEDIYPVLDEHWDKATFPLEEMQKIIDIDLIQNPKLLEGREDGTISQLFRGFRAYTLAKTDPVIGTFYTSNGGLFHECVKIGGSKEQQEKLMPGVLSWEGKGVLAMTEPEHGSDIAGGMAATAKREGDTWILNGHKKWIGGGTLAKWHAFFARDVDDGQVKMFFVERESEGVETFNTEPKAFFRMMPNAEIIYTDVKVPESQRAQNVNSWKDAANILRNTRSDVAWLLAGATAGAFEAALKYTREREAFGKTVASFQLIQEKLSRMAMNAQATLAIAVRLAQQQERGIYKEENSSMAKMHNGYRARENAALAREVCGGNGILLEYDVPRFMADIEGMYTYEGTHEVNSLIIGRYYTGQQAFI

SEQ ID NO: 2704 - protein, 703 aa, Arthrobacter phenanthrenivorans
MTTTATAPEATVDTVETVPSFVLDSWWTPDAGSAASATPVRDASTGEVLAKVSTEGLDLAEVVDYGRTTGQEELGRLTFHQRALKLKELAQYLHARREHFYTFSAQTGATKVDNLIDIDGGIGVLFTFGSKGRRELPNSQVVVDGPMEVLSKDGSFAGEHIYTRIPGVAVQINAFNFPVWGMLEKFAPAFIAGVPTIVKPATPTGYVAAAVVKAIVESNILPKGSLQLISGSVRGLLDVLDYRDLVAFTGSASTALSLKSHPNVVQGGVRFTSETDSLNAAILGPDAVEGTPEFDAFVKSVVTEMTAKAGQKCTAIRRAIVPQDLVPAVSAAVGKRISERIVLGDPRADGVTMGALASVEQLNDVRAAVQSMLDAGGELAYGTLDSPSVTSADGTTGVVEGGAFMAPVLLNWQDPEAEEVHSLEAFGPVSSVIGYKDLADAVRLAARGSGSLVATVCTNDPEVARELVTGIAAHHGRVLMLNREDARSSTGHGSPVPHLVHGGPGRAGGGEELGGIRSVMHHMQRTAIQGSPNMLTAVTGVWHAGADRNFTVETEGTHPFRKSLETLRIGDAVRSDLRQVMLEDITAFANSTGDTFYAHTNQEAAEANPFFPGIVAHGYLLLAWGAGLFVEPAPGPVLANYGLENLRFITPVAAGDSIRVTLTAKKITPRETDEYGEVAWDAVLTNQNDEIVATYDVLTLVEK

SEQ ID NO: 2705 - protein, 690 aa, Xenorhabdus nematophila
MQQLTSYICGAWVHGQGNTRTIHHAVSGKALYQVSSEGLPLEKSVAYAREKGGKALAVMTFQQRAQMMKAVAKHLLANKEKLYAISTETGATRSDSWVDIEGGVATLFSYAGLAGRELPDDTLWPEDEMIPLSKQSQFVARHVLTSRSGVALHINAFNFPCWGMLEKLAPTWMAGMPAIIKPATASAQLTQAMVKMIIDSGLVPEGALQLICGGIGDLFDHLDYQDAVTFTGSAQTGQMLRAHPRLIEKSIPFTMEADSLNCCILGEDVTPDMPEFGVFIKEVVREMTVKAGQKCTAIRRIMVPAAQMDMVKEALLKRLSGVAVGDPTLPEVRMGALINREQRDEVQAKVNQLLASGCELLCGGSLDKLVLTGNSNSQGAFYPPTLLYCADPMTNQAVHDTEAFGPVSTLMAYQDTEQAITLAMMGQGSLVGSLVTADETVATQVIRATACAHGRMLVLDEAASAESTGHGSPLPMLVHGGPGRAGGGEELGGLRAVKRYMQRTAIQGSPSMLAAIGREWVRGAKVKEDPIHPFRKYFEQLEIGESLLTARRTVTEADIVNFACLSGDHFYAHVDKIGAAESLFGERVAHGYFVVSAAAGLFVDGAVGPVLANYGMENLRFIEPVKIGDTIQVRLTCKKKIKKVQKTPEDKPHGVVMWDVQILNQEKQPVVLYSILTLVERQLCDFSASV

SEQ ID NO: 2706 - protein, 829 aa, Flavobacteriaceae bacterium; identical to SEQ ID NO: 2227

SEQ ID NO: 2707 - protein, 674 aa, Roseobacter sp.
MRDIQSFAAGQWINPGAGSRNIASAITGDVIARAGNDALDIQSMLAYAHGVGGPALRKLTFHDRAKMLKALATYLKDHKQSLYDLSFDTGGTKSDHMIDVDGGIGTMQVYAAKGRREMPDDQIFLDGPPEQLGRAGQFMGRHICTPLQGVAVHINAFNFPVWGMLEKLAPTLLAGVPAIVKPATATCQVTEACFRLMIQSGILPDGAIQMVTGGLGDMLDHLDCQDVVSFTGSAETANKLRSNPALLERSVRFASEQDSLNASVLGSDAAPGTPEFDLFVKEVQREMTAKAGQKCTAIRRIMVPEAHIDAMIDAISARLAKVTIGDPRLETTKMGALVSESQRRDVLEKAALIGAEAERVFGDPDSFAVDGADREKGAFVPPMLFHCADPDNAIRIHDTEAFGPVSTVMPYRDTDHAIALLNKGKGSLVASVITRDGDIARQMAMGAGAFHGRLYFNNRESMAEATGHGAPLPHMVHGGPGRAGGGEELGGIRGVMHYMQRTAIQGSPDILTAIGKQWVPGATEISDRDHPFTRVFGDLDLGETFNSASRTITLDDIETFAHFTGDTFYAHMDEDAAKANPFFPGRVAHGYLLLSFAAGLFVQPDPGPVLANTGLDNLRFMAPVQAGDSIKVRLSVKAKTPRNDEYGEVRWHVTLTNQDDAAVAEYELLTMNAY

SEQ ID NO: 2708 - protein, 676 aa, Rhodobacterales bacterium
MSLLEISSFAAGQWVAPGAGARNIASAITGEVIASAGNDALDVQAMLDYARTVGGPNLRKLTFHDRARMLKALAGHLNQHKQALYDLSFNTGATQSDHMIDIDGGIGTMFVFASKGRREMPDGHVYLDGDVEQLSRNGTFLGQHICTPLRGVAVHINAFNFPVWGMLEKLAPTLLAGVPAIVKPATNSCYVTELAVKLMLDSGILPEGALQLVSGGLGDMLDHLTMQDVVSFTGSANTALKLRANPVILENSVRFVAEQDSLNASILGPDAQPGTPEFDLFVKEVSREMTTKAGQKCTAIRRIIAPQAQVDAVIEALSARLAKTQIGDPRLETTRMGALVSNSQKRDVLEKAAIIGQEAERVFGDPENFSVDGADAEKGAFVPPMLFHCADPDNARRVHDTEAFGPVSTIMGYRDLDHAIDLANRGQGSLVASVITHDPAVAREVAIGAGAYHGRLYFNNRDSMKESTGHGSPLPHMVHGGPGRAGGGEEMGGVRGVKHYMQRTAIQGSPDILSAIGEKWVPGGTEIEGPAHPFTRKFGELSIGETLHTAPRTVTLEDIETFAHFTGDTFYAHMDEEAAKRNPFFPGRVAHGYLLLSFAAGMFVQPDEGPVLANTGLDSLRFMKPVSAGDSIKVRLTVKKKTPRNEEYGEVRWHVTLTNQDDEIAAEYELLTMNAY

SEQ ID NO: 2709 - protein, 683 aa, Shewanella woodyi; identical to SEQ ID NO: 2201

SEQ ID NO: 2710 - protein, 678 aa, Mycobacterium abscessus; identical to SEQ ID NO: 2199

SEQ ID NO: 2711 - protein, 408 aa, Renibacterium salmoninarum
MVTKTLSVQKAKPRQPFKELPTADFFEFESLLSPVERAKLFELREFCAREVTPFAQKWWHEEDVPRSVFQKLSAMGVGAPFRAGYSRLYSGLATLELCKADLSTGAIFGIHHELFVEGIRIFGTEEQKQRFLQRSSDGQILGGFALTEPEHGSDVAGGLTTMVRRDGDGWVLNGAKRWIGNAADGDYVFLWARDSDDGQIRGFILDLSLPGISRTKIENKISMRGIKNADLVMKDVRLAESDRLSTVSSFADTNVLLMGTRMMAGWMAAGVQCAAFEIARKYALERLQFGKPLAKFQLVQQQLVEMLGNATASLAMSARLAQVQDAHDRGVGPELRMEQAALVKGFTSKLCLDTVAKGRSLLGGNGIVTDFGMAKIFADAQPILTFEGTYEVNSLIVGRAITGHSALV

SEQ ID NO: 2712 - protein, 429 aa, Renibacterium salmoninarum
MISLTVQYTRTSKGLKESTTHLSPERRRKRASVQDRLSTVNPVDLPLPDADLMGMIDLLPAAERLRYAAVREFLQRRIRPESIGYWNREEFPFDLLAELAEHGLGELQLDGSSQLFKGLMYFEVARADVSLSALVGIHNELIVGMIDRLGSEAQRERWLPGLRNFRELGAFALTEPDHGSDIAGGLETTAELLDGEWVINGAKRWIGSGTIADFALVWARDVADQQIKGFIVETDRPGYQASKIEHKMGLRIMQNAHIVLDNVRIPEANLLPEATNFAAANELLRDSRAWVGWQAAGIQFGAFDIGRDYALARIQFGRPLAKFQLIQLSLSEILGNATSSLALMLQFARMQEEGSAQMPQAAMVKATTTRLSRESVAKGRALLGGNGVTSDYEMAKLFGDAEILYSYEGTYEINSLIVGRAVTGVGAFV

SEQ ID NO: 2713 - protein, 680 aa, Saccharopolyspora erythraea; identical to SEQ ID NO: 2217

SEQ ID NO: 2714 - protein, 454 aa, Gramella forsetii
MSLFKKVRNTINLLKSVDMDQLAKINQKIDLAEAMKALGTLDERQLTGLMKMLKTKRKKGQHDLPPIDGDFYNLDLKLTEKQREIQLKVRNFMEDEIRPLVNEYWKKDQFPFEVIEKFRDLNIVGVPYEGYGCPNLPFLMEGIIAQEIARVDVSISTFFGVHSGLALGSIYLCGSEDQKQEWLPKMQKMEKIGAFGLTEPNVGSGVAGGLETTCKFDGENWVLNGQKKWIGNATFADVTIIWARDLDSNQVKGFLVRKENPGFKAEKIKGKMALRIVQNALITLKDCKIPESDRLQNANSFKDTANVLRMTRAGVAWQAVGCARGAYESALKYTKKREQFGRPIASFQLIQNHLVEMLSNLTAMQTMVFRLSEMQDQDLLTDEHASLAKVYCSMRMRDVVSRAREVLGGNGILLDYDVARFVADAEAIYSYEGTKEINSLIVGRAITGYSAFVS

SEQ ID NO: 2715 - protein, 454 aa, Gramella forsetii; identical to SEQ ID NO: 2714

SEQ ID NO: 2716 - protein, 465 aa, Alcanivorax borkumensis
MMTALAHAALEQLTDLLGNRCLTDQESAERYGVDWTKVWAPAPCAVALPETTEEVQQIVEIANEHGLHLVPSGGRTGLSAGAVAANNELVVAFDRMNTILDFNEFDRAVTVQPGVITQQLQEFAEQKGLFYPVDFASAGSSQIGGNIGTNAGGIKVIRYGMTRDWITGLKVVTGKGELLDLNKGLIKNATGYDFRHLFIGSEGTLGFVVEATVKLAREPKDLTALVLGAPGFREVMKILHAFQQDIDLTAFEFFSDKAMAHVLEHGVAKPFDTECPFYCLLEFEQLSEQIGDQAMAIFERCVEEGWVLDGVMSQSLQQLDQLWQLRERISESIAPHTPYKNDISVTVSKVPDFVEDIDTVVQDAYPDFEIVWFGHIGDGNMHLNILKPADLPKEDFFAKCNNVSKWVFEIVQKYNGSISAEHGVGMTKKPYLEYSRSPEEIACMKAVKQVFDPNNVMNPGKLFDV

SEQ ID NO: 2717 - protein, 465 aa, Alcanivorax borkumensis; identical to SEQ ID NO: 2716

SEQ ID NO: 2718 - protein, 480 aa, Salinibacter ruber
MQAGLFSFDQRVAPADAHEALRTTAASHPFSLPMPNDLATADIDRDVLARLSEKADVDQLLGALSDLDEDELDRLADGARPQKPQRPSPTPPVNADVYEVFEGLTDAQEATRETVRSFMQAEVEPVANDMWEDGTFPKDLIPKAGALFDEVVGRDAYTFPSDDPIRTNLISFEMSRVEPSFCTFWGVHTLLSMGSVALFGSEAQKERFLEPMAAFDMIGSWALTEPDHGSDVSQGLATTARREGDTWVLDGAKKWAGNATFADVTVVWARDEADGCIKGFLVEQERPGYHVEQIGGKIAKRGVENGLIELDGVELPEANRLPGVSHFGDVSAQLATCRASVAWEAAGLATGAYEKALAYCNERTQFGKPTSSFQMVQDKLVTMLGKVTALQTFVMQLGRLEAGAGAIGNERSSLAKVWACDTMREVVSIARGIMGGNGILLDHDVARLFADAEGVYSYEGSREMNALIVGRAITGQSAFV

SEQ ID NO: 2719 - protein, 804 aa, Corallococcus coralloides; identical to SEQ ID NO: 2683

SEQ ID NO: 2720 - protein, 649 aa, Amycolicicoccus subflavus; identical to SEQ ID NO: 1041

SEQ ID NO: 2721 - protein, 684 aa, Haliscomenobacter hydrossis
MSAKLHNYLQGAWIPHDGDGIPQFDASDGTLIGTCGSEGLDYSSILRYAREVGGPALRKLSFQERGRMLKALALFLSEHKEKYYTLSYRSGATRADSWIDIDGGIGTLFAYASLRRKLPDTRWYLDGEAAKLSKEGSFIGHHLMVPKHGVAIHINAFNFPIWGMLEKLSANLLAGMPAVVKPSEVTSYLSERVVRDIVASGILPAGALQLVCGSGVGILNELSEQDVVTFTGSAETGRVLRALPSIIQNSVPFNMEADSLNAIVLAPDGIPGTPTFELFLKEIRREMTAKTGQKCTAIRRIFVPETLIDAVQVSLGKMLAQTTVGDPRAEGVRMGPLVSKIQQQEVRQKVAQLLQHSQLVCGDLDQFEVNSAHKEKGAFFAPILLRNDQPLVQTSTHEIEAFGPVSTLMPYRDLAEAITLVNMGKGSLVSTIATTDPAFAQEYVMEAAAYHGRILILNEQSAPESTGHGSPMPLLSHGGPGRAGGGEELGGLRGIKHYLQRTAIQGHPTMLGQITEVYQVGGAQPEANIHPFRKYFEELVIGETLTTHKHTVTETDIVNFANLTGDHFYAHVDETALEGTPFERRVAHGYWILSKAAGMFVEPRKGPVMLNYGLEECRFTKPVYPGMTIGVRLTAKEKIAQEQRDENDVPKGIVKWLVEVFDQNNETVAIATILTLVRKKSSTI

SEQ ID NO: 2722 - protein, 415 aa, Salinibacter ruber
MPQPAPPDPKTAPSAPDVSTSETWDPTVFDPPDFYDLEALLSEEARHVRDNVRTVVTEEVMPIIEKYAQRGEFPRHLISTFAEHGLLGSTLPPEYGGEGHSNIAYGLIMQELERGDSGLRSFCSVTGALVMYPIWQYGSDAQRERWLPALASGEAIGCFGLTEPDVGSNPAEMQTRARRDGDGWVIDGQKRWSTNATIADVAVIWAKDEDDTVRGFLVETDRDGVETPPIDDSWSLRAAVTSEVVLDDVRVPDAARLPEVSGLKGPLSCLTQARYGICWGTIGAAMACFDTARQHAQNREQFGGPIGRFQLMQERLVDMVQEITKAQLLNWRLGTLKEAGTMRPQQVSLAKRNNCQTALDVARSARQVLGGNGVTSMYPVMRHMNNLESVVTYEGTHEVHTLIVGEDVTGLNAFT

SEQ ID NO: 2723 - protein, 480 aa, Salinibacter ruber; identical to SEQ ID NO: 2718

SEQ ID NO: 2724 - protein, 702 aa, uncultured Flavobacteriia
MKPAHARYLRKATTHSMKKLGNLLNDQWVYGDSEGTPLLNAIDGQLIAHADSTGLDLDSAYVFAREVGGPALRTMTFQERGRMLKRLALHLHAMKEEFYQVSWATGATRADSWIDIEGGIGNLFANASLRRKLPDTPFATDGDFVPLGKEGTFGGHHLLVPKQGVAVHINAFNFPVWGMLEKVAVNWLAGVPAMVKPATVTSFLTERVVAAIHESGILPPGALQLVCGSARNILDYVDERDVVTFTGSAATGRMLKANPRITEFAVPFNMEADSLNSAILGPDAVPGTPEFDLFVKEVRKEMTVKCGQKCTAVRRIFVPEGVMDAVQEALVGQLAKTTIGDPQTDGVRMGALVGKAQCQDVLDQVQHIEAEAECVFGASKTAEVIGAELERGAFLPPMLMRHDRPHEARAVHDVEAFGPVSTLMPYTDLEEAVALAARGKGSLCCSITTFDRQAAATFVREAAPMHGRILVLDRECAKESTGHGSPMPLLVHGGPGRAGGGEEMGGLRGIKHYMQRTAIQGHPTTLSAITEQYQPGAARPESEPHVFRKHFEDLEIGDTVTTARHTVTEADIVNFANVSGDHFYAHVDETSLDGTMFEGRVAHGYYILSKAAGLFVEPRKGPVLLNYGIDECRFTKPVYPGTTIGVKLTVVEKIAQERREPEDVAKGIVRYRVEVDDHEGEIVAVATILTMVKKRDQGPDAL

SEQ ID NO: 2725 - protein, 638 aa, Spathaspora passalidarum
MEHYDYTQEEERILVTKRIEKMSKYIETEPTKKFFRRLQLMTVIDPSLGIRMLVNLGLFLNCIRGNGTDKQYEFWAKHKEAGKVKQMYGCFGMTELGHGSNVAGCETTATFDEETDSFIIDTPHIGATKWWIGGAAYSATHTVCYARLIVKGVDYGVKTFIVPLRDSLHNLLPGIAIGDIGAKMGRQGVDNGWIQFTEVKVPRFFMLQRWCKVDRRGNVTLPPLEQLSYISLLDGRVGMATDSYRIGARFTTIALRYAVGRRQFKSEGAKEETKLIDYPLHQRRLLPLLALTYVAAVGTYRLELQQSDLLANLDKALANKDKLLLKQSISGTKSLFVDSGSLKSTLTWLAADLVNECRQACGGHGYSAYNGFGKTINDWAVQCTWEGDNNVLAMSTGKTIIKTVQQILSGKKLKDSTLEFLNDAPALYKAKKAVIRKADHVDDIDRVLKAIASLIVKISVDLIPISNTSWDSIGPQRVILSKLRCHYYMLETFKEKLENQIGANSPLRPQLENIMKLYLVSNILSPFIDEFLKNGVISPAVAKYLTIEYPQTLCSEVRPYVIGLTDSFQQPDNFIHSLIGKYNGDIYSNYLGAIKDIHDPANHKAPYSEDLEAMLARPSLVARERHEKTAEVGSILSK

SEQ ID NO: 2726 - protein, 690 aa, Fluviicola taffensis
MIQVKNYICGQWTAGEGEEQKIYNAITGDQIGGVSSAGLDYEAILNYGRTVGGKQLRKMTFQERGRMLKALALFLMDRKNAYYEVSSWTGATKVDSWIDIEGGIGNLFANASLRRQFPDLPYYVDGTAAPMSKNGTFIGHHIMVPKQGVAIHINAFNFPVWGMLEKIAVNLMAGVPAIVKPSEYTSFLTEVVVKDIIDSKILPEGALQLVSGFGRGIIDHVSNQDVVTFTGSAFTGRKLKAHPQLLEESVPFNLEADSLNAMVLGQKAAPGTEEFDIFVKEVTKEITIKAGQKCTAVRRILVPEDFIEEVQKGVAARLASTTIGDPKVEGVRMGSLISRLQVERVRENVEILAKSQKIVYGNMDQFDVVGADKDKGAFFSPILFLNDSPFDKQDVHNVEAFGPVSTIMPYKDLDQAIELTKLGKGSLVTTIVTADDKEAREFVVEAACVNGRILVLNKDCAKESTGHGSPMPLLTHGGPGRAGGGEEMGGKRGVMHYLQRTAIQGHPTTITEITQQYQQGAKGNISSIHPFKKHYEELEVGDQLITDSRLITSEDIDAFAALSGDNFYAHKRETNFTGTMFDQQVAHGYLIMSISAGLFVDSYEINPVLLNYGIDELRFTKPVYPGANIHIRFTCKEKISTDVTPNEEDPKTLIQRGVVKWLVEMLDDTDEPLVGIATILTMVKRLDQSK

SEQ ID NO: 2727 - protein, 442 aa, Aureococcus anophagefferens
MLRRLALAQTRRAHRAARPLSASVSSAEEHAPFDFPPPAKDGFVPFDASDALNVGGRLTEDEQLIRETARSYCQEQLLPRIVAANRHEAFDRAIFREMGALGLLGATIDGYGCAGASSNAYGLIANEVEKVDSAYRSALSVQSSLVMHPIHKFGAEETKARLLPQLAAGELVGCFGLTEPDHGSDPDGMKSKAEFDASTGEYVLNGSKHWITNAPIADVLVVWAKLDGDVRGFVLERSKLAPGMLETPKIEGKFSLRASETGSIFLADARVGPDAILPKAKGLGAPFSCLNSARFGIAWGALGAAEACYDVARRYVGERSQFGAPLAANQLIQKKLADMATELALGYGAAQRVGELKDAGQINPQMLSLVKRNSCGKALDVARAARDMLGGNGIQDEYHVIRHCMNLEAVNTYEGTHDVHALILGRGITGIQAFVPSAAVLP

SEQ ID NO: 2728 - protein, 690 aa, Xenorhabdus nematophila; identical to SEQ ID NO: 2705

SEQ ID NO: 2729 - protein, 582 aa, Xenorhabdus nematophila; identical to SEQ ID NO: 1014

SEQ ID NO: 2730 - protein, 676 aa, Silicibacter lacuscaerulensis
MSLKQISSFAAGQWVAPGAGARTIASAITGEPFATAGNDALDVQAMLAHARDLGGPALRRLTFHERAKMLKALAQALSERKQALYDLSFETGATQKDHLIDIDGGIGTMFVFASKGRREMPDGHVYLDGDVEQLSRNGTFLGQHVCTPLQGVAVHINAFNFPVWGMLEKLAPTLLAGVPAIVKPATNSCYVTELAVRIMLDSGILPEGALQLVSGGLGDMLDHLTCQDVVSFTGSADTAIKLRQNPVIVTNSVRFVAEQDSLNASILGPDAAPGTPEFDLFVKEVVREMTTKAGQKCTAIRRIIAPQAQVEPLIAAISAKLAQTTIGDPRLDGTRMGALVSDGQKADVLAKARLIGQEAERVFGDPDAFEVIGADAEKGAFVPPMLFHCADPDAARHVHDTEAFGPVSTIVGYRDLDHAIALANRGQGSLVTSLITHDPEVARQVVMGAAAFNGRIYINDRDSMQESTGHGSPLPHMVHGGPGRAGGGEEMGGVRGVKHYMQRTALQGSPRMLATIGRKWIPGAPEIQGPAHPFTRKFTELQIGETLNTAPRTITLDDIEHFAHFTGDTFYAHMDEDAAARNPFFPGRVAHGYLLLSFAAGLFVEPNEGPVLANTGLDGLRFMKPVVAGDSIKVRLTVKQKTRRTDDYGEVRWHVTLTNQDDEKVAEYELLTMNAY

SEQ ID NO: 2731 - protein, 684 aa, Labrenzia alexandrii
MGTTARRLESYVEGAWRRGDGEGQPVLNAATGTVHALIGTEGLDFKAALAWGRAKGGPALRAMTIHERALMLKAVGLKLMELKEEFYLENFATGATRRDGWIDIEGGIGTMLTFASKARRELPNTRVLTEGPVEVLSRDGSFVAQHILSPFVGVAVHINAYNFPVWGMLEKIAPSLIAGMPCIVKPASQTAYLTELVVRRMLETGLLPEGALQIVTGSAGDLLDHVDEQDVVTFTGSASTGQKLKSSPAILKHSVRFTMEADSLNASILGADAGPGTDEFDLFVREVANEMTVKAGQKCTAIRRIIVPKTHEQAAVEAIAARLSKTKIGLPDDEAVRMGAIVSLNDRDGVKAKVAELATEAEIVSGSLDTVDLVSGEADHGAFMAPLLLHCAKPLTAEVVHSVEAFGPVATVMSYEDNQEAVELARKGRGSLASSLFSNDEALVHDVVTGLAPFHGRVLIGNRGSAKSSTGHGSPLAPLVHGGPGRAGGGEEMGGMRGVKHFMQRSAVQGTPEMLSAVTGQWVDGASVRSDVHPFRKSLAELQIGDQIATKAREVTLEDVEHFAEFTGDTFYAHMDSEAAKANPFFEDRVAHGYLIASFAAGLFVDPEPGPVLANYGVDNLRFLTPVYFGDSLKVRLTCKEINPRENADHGEVRWDCQVTNQKDEVVAQYDVLTMVAKTWPQAA

SEQ ID NO: 2732 - protein, 419 aa, Kocuria rhizophila
MSKDSTETTGITIEHPEDFPTGTLEPHYDLNEPLATDEAGIYEGVSEEDRAHQLRARTFVQEEVLPVIAEYWDRGEYNLDLVRRMGEMDLLRDGVEVPGMPPMSKMAAGLVAMELSRGDGSISTVSGVQGGLAMRSIALCGSEEQKQRWLPDMATGKLLGAFALTEPAHGSDSIGLESRATPVEGGYILNGAKKWIGNGSMGGITVVWARSDEDGAVHGFVVPQESEGYTGTTMKAKLALRAIHQAEITLENVFVPTENVLPHAKNFRDTSAVLFATRIGVAWAAVGHAQACYETAVHYAMQRHQFGRPLAASQIVQERLTRMLSELTQIQTLVMAMARKEEAGTLSGPQASLAKYTATRTARQVAMNARDLLGGNGILMENRVARHFADIEAIHTYEGTETVQALIIGKSITGISAYK

SEQ ID NO: 2733 - protein, 679 aa, Rhodococcus jostii; identical to SEQ ID NO: 2237

SEQ ID NO: 2734 - protein, 679 aa, Gordonia polyisoprenivorans; identical to SEQ ID NO: 2695

SEQ ID NO: 2735 - protein, 688 aa, Saprospira grandis; identical to SEQ ID NO: 2694

SEQ ID NO: 2736 - protein, 686 aa, Geodermatophilus obscurus
MTAPLLQSYVAGRWYTAPDEGTPIADAVTGETVVRISSTGLDVPAMLDHARTVGGPALRELTFHQRAGLLKQLGLRLMAGKDEFYALSRRTGATDRDSAVDVDGGFGTVLSYASKGRRELPDDTVVLNGAVEPLGRGGTFVGQHLYTPLRGVAVQINAFNFPVWGFLEKLAPAFLAGVPTIVKPASQTAYLTEAVVRTIVESGLLPEGSLQLLAGSATGLLDGLAGQDLVFFTGSAATARKLRSHPAVVANSVRFNAEADSLNCSVLGPDAGPDTPEFDLFVEQLVTEMTVKAGQKCTAIRRAFVPRTLVDDVVEATRDRLAEVVVGAPGAEGVRMGALASRGQREEVLRSLKALRGVAELVAGDPEHFEVVGADRDRGAFLPPMLLRCDDLTAAEPHDVEAFGPVSTVLPYDDVAQAVELAARGQGSLVGSVVTHDRQFAREFVLGAAHAHGRILVLDRDDAAENTGHGSPLPVLVHGGPGRAGGGEELGGIRGVLHHMQRTAVQASPDQLTAIGGRWVAGAERNDDGVHPFRKSLAELRVGDSVTAGPRTVTLEDIEHFAEFTGDTFYAHMDEEAARANPLFGGRVAHGYLLVSFAAGLFVDPAPGPVLANYGVDDLRFLTPVKPGEELTVTLTAKQISSRGGADHGEVRWDAVLVNGEGKPVATYDVLTMVAKTWPPAAGTPS

SEQ ID NO: 2737 - protein, 706 aa, Micrococcus luteus; identical to SEQ ID NO: 2257

SEQ ID NO: 2738 - protein, 405 aa, Streptococcus uberis
MVKESRADKLFASGEMFYSDLYNYADALTDGEKAVLKELEEVLEKDLKPLLAENWHNATFPLEAFQKVIDLRLMDDPRLLEGRENGRISELFRGFRAYTLAKTDPVLGTFYTANGGLFHECVRVGGSEEQVAQLMPGVYSWEGLGVLAMTEPDHGSDIAGGMAATAKREGDHWILNGHKKWIGAGAIAKWHAFFARDVDDNQVKLFYVERETEGVETFVTPQKAFFRMMPNAEIIYRDVKVPESQRAQNVNSWKDCANILRNTRSDVAWLLAGATAGAFEAALKYTREREQFGKPIANFQLIQEKLARMAMNAQATLAIAVRLAEQQEQGIYREEASSMAKLHNGFRARETAALAREVGGGNGILLKYDIPRFFADIEGMYTYEGTHEVNSLIIGRHYTGISAFI

SEQ ID NO: 2739 - protein, 682 aa, Bos taurus; identical to SEQ ID NO: 530

SEQ ID NO: 2740 - protein, 656 aa, Xenopus tropicalis
MVWWRASSADIDVNPDLASERAAPSFCVESLTNLLDGSVEKTRVRRYVVSTILKDPVFSKENHYFKTRQERYEGAIRNSFHLKQKIKELGWREDGPEGEVIYRAMGGELALNIHGVFIKSILALGTDEQVAKWIPLANNCNILGTYAQTELGHGTYLRGLETTATFDISTQEFIINTPQISATKWWPGDLGKTCTHAVVLAHLIIKEKNYGMHPFIVQVRSLKDHSPMPGITVGDIGPKMCFEQIDNGFLMMRNICVPKENMLSRYSEVLPDGTYVKRGSDKINYFTMVAVRVSMLRAEVLEALMKACTISIRYSAVRRQSELKPGDREPKILEYQTQQQKLLPLLATCYAIHFTTCHVNKVYDEVYGAIQAGNFDSLPELHALVSGIKAYATEICSNGIEVCRKACGGHGYSLFSGLPSLYTKVTASCTYEGENTVLHLQAARFLIKCYAAARSGQSLPHSVAYLSSPISGACQASSHTHFLNPDVYIKAYQHRAYRLIDSAAFKMRNLVQSGMEQYAAWNSTSVELVKASIAHTHYIIVKLFADVLDSLSSFPEIQKVLKSLCDLHALHGIFTNSGDFLQDGHLSGKQLEMLTEAYLGLLSLIRRDAVLLVDAFDYADQQLLSALGSYDGNVYYNLLECAQKNPDNKKVTSRKC

SEQ ID NO: 2741 - protein, 670 aa, Xenopus laevis; identical to SEQ ID NO: 534

SEQ ID NO: 2742 - protein, 733 aa, Ashbya gossypii
MTKASVVDQSAPAYAPKRLLAEARAASKVNIEQVFAFLEGSPEKAALTNELLAEFAADPAITQGPEYYDLTKAEQREQTVKKIARLALYLENDIKLARKQHHKDVVRDLQSPDAPMVTMSDMERFEKRSTLVALIDPQLATRLGVNLSLFGNAVRGNGTDEQIKYWLQERGLIFVKGIYGCFAMTELGHGSNVANLQTRATYDPASDSFVIQTPDLVATKWWIGGAAHSATHSTVYARLIVEGKDYGVKVFVVPLRNPKTMELLAGISIGDIGSKMGRDGIDNGWIQFNNVRIPREYMLSRFTKVIPGNPPKVEMEPLLDSISGYAALLSGRVSMVLDSYRFGARFSTIATRYAFGRQQFGDPTNETQLIEYPLHQFRVLPQLAIIYMMAPGAMKLMDTYNSCLGELYGAGDDKKKLTTVSARMKDLFVESASLKATCTWLTSTLIDELRQTCGGHGYSSYNGFGKAYNDWVVQCTWEGDNNVLCLTSGKSLLKKFAGIVRGKKVTICDTSMDYLRMDYIQKVVMGGTKKVSNLSTLPDYYQIWSVILVKYLKRCAETVRDNNDPESVSKLLVSIAKFHAFYSMLQEFHRKLASDQSHVGDAATKEVLWKVYKLSSLYFIDKFSGEFQQLKVMSPDQMTNVQEQMLAILPEIKTHAIRLTDAFHLPDAVINSSIGNYDGDIYHNYFNDVTRVAAKDKAPGVPPYADMLVNFLARGDQFDNLNISETSFKNLGK

SEQ ID NO: 2743 - protein, 678 aa, Nocardiopsis dassonvillei
MPETLQSYARGAWFTPADEGAPLADANTGETVARISSDGPDVAGMVDHARTVGGPALRALTFHQRANILKEVAKHLTGYKEEFYALSHRTGATARDTAVDVDGGFGTLFSFSSKGRRELPNSTVILDGPLEPLGRQGTFVGQHVYTSRPGVAVQINAFNFPVWGMLEKFAPAFLAGMPSIVKPAGQTAYLTVAVVRRMVESGLLPEGSLQLLVGSHRGLLDALGPQDVVGFTGSAATGAILRNHPNVVSGGVQLNVEADSLNCSILGPDVTEEDPEFDLYVKQVVTEMTVKAGQKCTAIRRVIVPASMAEAVTGALTERLARVVVGAADHPDTRMGALVSLDQREEVRKAVKALRATSELVYGDPESVEVAGADDESGAFMSPILLRAEPGAREPHEVEAFGPVSTVITYDGVAEAVELAARGSGSLVGSLVTRDPDVAREVVLGLAPWHGRILVLNRDDAKESTGHGSPLPVLVHGGPGRAGGGEEMGGVRGVKHHMQRTAVQAPPDMVTAITGHWTTGSERTVGDVHPFRKDLSQLRIGDTIRSAERTVTRADIDHFAEFTGDTFYAHTDEEAAAANPLFGGIVAHGYLVVSLAAGLFVDPAPGPVLANFGVDNLRFLTPVKEDATIRVTLTAKQITPRTNADYGEVRWDALVTDQDGEAVATYDVLTLVAKGGEG

SEQ ID NO: 2744 - protein, 738 aa, Lachancea thermotolerans
MTRITTNEFSGPTFKPQAFIQHERRESQLNIDAVNVFLESDPANAQLTHDLVTEVTMDPVLKTGSEYYDMSKDQHRRATALKIAKMAVYLEQDIKRAARNYRGGAVEKFQTSDKTPILTAQDLAIFDKRLSIISNQDPQLGTRIGVHLGLFGNCIRGNGTNEQIRYWLQEKGALFLKGIYGCFAMTELGHGSNVAQLQTRAEYNIQTDTFLINTPNLPATKWWIGGAAHSATHATVYARLIVKGKDYGVKTFVVPLRDPGTFQLLPGVFIGDIGTKMGRDGIDNGWIQFKNVVIPREFMLCRFTKVIRSEQGDDAKVWSEPTLDQISGYSALLNGRVNMVMDSFRFGAKFVTIAVRYAVGRQQFAPAGDKTGKAEETQLINYPLHQYRVLPHLAVVYLISPVAFNLMATYHSTLDQLFKASSSGDKKQLGPVSLKLKDLFIDSASLKATNTWLVATAIDELRQACGGLGYSAYNGFGKGFSDWVVQCTWEGDNSILSLTSARSILKKFTDLSKGKVQESQSFKYLSPSFVTQVLRGSKSAQIRSLEDYIEVWGIMLVKILHYCVDLVSKTKNTDSISKHLIMISRFHAFHTMLQAYYEKLKSPEDSHVSDQESQKMLWNLFRLFSLYFIDKHSGEFLQFKVFTPDQIQTIVQPQLLALLPEIRKECIALTDAFKLPDAMLNAPIGYYDGDIYNNYYAEVLKNNPPEAPGPGKPNYHEVLTTMLRRDYEPEENLAKLGK

SEQ ID NO: 2745 - protein, 687 aa, Saccharomonospora azurea; identical to SEQ ID NO: 2669

SEQ ID NO: 2746 - protein, 709 aa, Citricoccus sp.
MTTQTAAPTVPSYVLDEWWTPGADSRTTDVLDASTGETLARYGAEGLDLGAVLEHGRTVGQRELGKLTLHERALKLKELALYLNEHRKDLYELSHRTGATKVDNMVDIDGGIGVLFTFSSKGRRELPNSNVIQDGGIEPLSKDGSFIGTHVYTRIPGVAVQVNAFNFPVWGMLEKFAPAFIAGVPTVVKPATPTGYVSEAAVRLMVDSGILPAGSLQLISGSARGLLDVMDYRDMMLFTGSATTAQSLKSHPNVISGGVRFSAETDSLNAAILGPDAVEGTPEFEAFVKAVVTEMTVKAGQKCTAIRRTIVPEAQREAVASAIAARIEQRVVVGDPRAEGVTMGALASLAQLQDVRGAVEDMLAAGGELAYGSLDAPTVRTASGEDAVVKDGAFMSPVLLTWADAENEVVHSREAFGPVTSLIGYTDLDDAVRLAARGSGSLVATVCTNDPEVAREVTVGIAGHHGRVHLLNRETAKTSTGHGSPVPHLVHGGPGRAGGGEELGGVRSVKHHMQRTALQGSPNLLTAVTGVWQTGADRQIAGSEAYGAEPGNVHPFRKSLAELRIGDALASDLRQVTQEDITAFANTTGDTFYAHVNPKAAEANPFFPGTVAHGYLLVAWGAGLFVEPAPGPVLANYGLENLRFITPVAAGDSIRITLTAKKITPRVTDEYGEVAWDAIIHNQKDEIVATYDVLTLVEKEDVTYKNWTD

SEQ ID NO: 2747 - protein, 636 aa, Escherichia coli
MQQLASFLSGTWQSGRGRSRLIHHAISGEALWEVTSEGLDMAAARLFAIEKGAPALRAMTFIERAAMLKAVAKHLLSEKERFYALSAQTGATRADSWVDIEGGIGTLFTYASLGSRELPDDTLWPEDELLPLSKEGGFAARHVLTSKSGVAVHINAFNFPCWGMLEKLAPTWLGGMPAIIKPATATAQLTQAMVKSIVDSGLVPEGAISLICGSAGDLLDHLDSQDVVTFTGSATTGQMLRVQPNIVAKSIPFTMEADSLNCCVLGEDITPDQPEFALFIREVVREMTTKAGQKCTAIRRIIVPQTLVNAVSDALVARLQKVVVGDPAQEGVKMGALVNAEQRADVQEKVNTLLAAGCEIRLGGQADLSAAGAFFPPTLLYCPQPDETPAVHATEAFGPVATLMPAQNQQHALQLACAGGGSLAGTLVTADPQIARQFIADAARTHGRIQILNEESAKESTGHGSPLPQLVHGGPGRAGGGEELGGLRAVKHYMQRTAVQGSPTMLAAISKQWVRGAKVEEDRIHPFRKYFEELQPGDSLLTPRRTMTEADIVNFACLSGDHFYAHMDKIAAAESIFGERVVHGYFVLSAAAGLFVDAGVGPVIANYGLESLRFIEPVKPGDTIQARRYHPGASHL

SEQ ID NO: 2748 - protein, 676 aa, Gordonia otitidis
MSGVLKSYACGKWFSAEDEGTPLLSAVDAHEVARISSTGLDLQAMTDYAREVGGPALGALTFHERAALLKQLGLMLMAGKDEFYELSRHTGATTRDSGVDIDGGFGTLLSYASKARRELPNDTIALDGDVEPLGKRGTFVGQHVYTSRRGVAVQINAFNFPVWGFLEKLAPAFIAGVPSIVKPASQTAYLTELVFRRIVESGILPEGSVQLLCGSARDLLDHLGGQDSVAFTGSADTAAMLRAHPAVTGTGLHFTAEADSLNASILGTDVSEDDPEFELYVKQLVTEMTVKAGQKCTAIRRALVPESLVDAVIGAASTRLGRVVVGDPVSEGVTMGALASVEQRDEVLKSLRGLTKSAEVVFGDPDHVDVVGADPAKGAFMSPILLRANDKEAPEPHDIEAFGPVATVIGYTDPADAVSLAARGKGSLVASVVTKDAALAAEIVRGLAPYHGRVLVLNEEDARESTGHGSPLPVLVHGGPGRAGGGEELGGIRGVFHHMQRTAIQGSPDVVTAVGNRWVAGSQRTASEVHPFRKDLGQLMIGDTIVGGPRRVTRADIDHFAEFTGDTFYAHTDPEAAAANPLFGGIVAHGYLVVSLAAGLFVDPAPGPVLANFGVDNLRFLTPVKADDSLTVTLTAKQITPRQNADYGEVRWDAVVTNQNDDPVASYDVLTLVAKP

SEQ ID NO: 2749 - protein, 676 aa, Gordonia otitidis; identical to SEQ ID NO: 2748

SEQ ID NO: 2750 - protein, 680 aa, Gordonia amarae
MSNLLQSYVEGRWVSPGDEGTPLLSAVDGHEVARISSSGVDLAAMVDYARRVGGPALAALTFHERAALLKQLGMTLMAGKAEFYELSRHTGATDRDSAVDIDGGFGTVLSYSSKARRELPNDTICLDGDIEQLGKKGTFLGQHIYTSRRGVAVQINAFNFPVWGFLEKLAPAFIAGVPSIIKPASQTAYLTELVFRRIIESGILPEGSVQLLCGSARDLLDHLDGQDSVAFTGSADTAATLRAHPTVVSSGLRFTAEADSLNCSILGPDVSTSDPEFDLYVKQLVTEMTVKAGQKCTAIRRALVPENLVDDVIRAASERLAAITVGNPADESVRMGALAGIDQRDEVLKSIRALTKSATIVFGDPDSVEVVGADAVSGAFLSPILLHAADKTAPEPHDIEAFGPVSTIIGYSDAADAVALAARGKGSLVASLVTKDAELAGEIVRGLAPFHGRVLVLNSEDARESTGHGSPLPVLVHGGPGRAGGGEELGGIRGVLHHMQRTAVQGTPDVLTATGRRWVTGARRVQGETHPFRKDLGELRIGDTIVGGPRQVTRADIDHFAEFTGDTFYAHTDPEAAAANPLFGGIVAHGYLVVSLAAGLFVDPAPGPVLANFGVDNLRFLTPVKAEDSLTVTLTAKQITPRQSADYGEVRWDAVVTNQNDEPVAAYDVLTLVAKPAASA

SEQ ID NO: 2751 - protein, 653 aa, Gordonia alkanivorans
MDGSDVARISSSGLDVAGMVAHARAVGGPALRSLTFHERAGLLKQLGLTLMAGKEEFYELSTSTGATTRDSAVDIDGGIGTVLSYASKARRELPNDSVYLDGDVERLGKNGTFLGRHIYTPRRGVSVQINAFNFPVWGFLEKLAPAFIAGVPSIIKPASQTAYLTELVVRRIIESGIMPEGSIQLICGSTHDLLDHLDGQDTVAFTGSAATAALLRSHPGIVAAGTRFTAEADSLNASILGPDVAVDDPEFDLFVEQLVTEMTVKAGQKCTAIRRALVPANRVDAVIDATSALLARVVVGDPRADGVTMGPLASLAQREEVRTSVRGLTKSAEIVFGDPEHVDAVGTGTESGAFISPILLRANGNNADEPHDIEAFGPVSTVIGYADTADAIALAARGQGSLVASLVTKDSGVAQEIVLGLAPYHGRILVLNSEDARESTGHGSPLPVLVHGGPGRAGGGEELGGIRGVLHHMQRTAVQGTPDVLAAVGNSWVTGSQRHLGDVHPFRKNLAELRIGDTVVGGPRQVTLADISHFAEFTGDTFYAHTDARAAAANPLFGGIVAHGYLVVSLAAGLFVEPNPGPVLANFGVDTLRFLTPVKAGDSLTVTLTAKELTPRPSADYGEVRWDALVTNQNDDIVATYDVLTLVAKGARQ

SEQ ID NO: 2752 - protein, 705 aa, Batrachochytrium dendrobatidis
MTDGNAHSMKNHSSSGIHESVDALPLPTQLITQERANPSFPVRELTYFMDGGKEVTRLKEMVMLQLERDPVMKTIDHSDLSLSQIRERTMQKVRRLAYYVANEPVRNFKMRMSVLTLVDPGTWTRVGVHFGLFFGALQGQATSEQLQFWVSKGAVTLNGLVGCFAMTELGHGSNVAGLETTATYDEASEEFIIHTPNLTATKWWIGGAAQTATHSVVFARLIVKGRDYGVKNFIVQLRDPTTFALFPGIVIGDIGAKMGRHGVDNGWIQFTHVRIPRSHMLMKHTKVKSNGQVIEPPLQQLTYGALISGRVTMVVDSGNISKKALTIALRYAAIRRQFGARPGVPETRLLDYVIHQHRLIPLLAQAFAMHFTGVEVQSIYDNLMVQMETLRPGDKNIPQILDHLKEVHGTSAGLKAFCTWSALNVIDQCRQSLGGHGYSAYAGLSSLYGDFAVQCTWEGDNTILTLQAGRYLIGCYREAKAGKKQAGGVAYLNELDSFLKIRCLAKNATEISMEMIGQAHWLVAANVIKAAGENFEASLKRGLKEDAAYEECSQARLYAAKIHSYGYLFHRFKDGVLKAPANLQPILTKLCLLYGLYNISENTGPFLQYEFFTSLQIEWVKARVSELCKEIRVDAIPLTDSFNYSDFIINSPLGKYNGDVYQAYFDIINAAHPPAKVPSYFQSEIYPLLHRKLESEDILELEDDE

SEQ ID NO: 2753 - protein, 683 aa, Microbacterium testaceum
MTFLPSYVNGAWWAPGSDPDAAIVRDASTGEEIVRISTRGLDLAGAIAYARREGQKNLGALTFPQRAMVLKNLAIALNERREELYALSERSGSTRRDSLSDIDGGIGVLFTFSSKARRELPAGKVVLDGPIEPLSKDGSFLGRHVYTRLPGVAVQINAFNFPMWGALEKFAPAFLAGLPTIVKPATPTAYVAEAWVRMVVATGLLPEGSLQLVSGSVPGLFDLLDLGDTVGFTGSASTAERLRAQAKPGVRFTSETDSINASILGPDAVPGTPEFDAYVKQLLVELTTKAGQKCTAIRRAIVPRGTTDAVAEALRAKIAERVVIGDPRAEGVTMGPVVSLAQRDEVLRQVRALEEAGGRFVVGSADAPEGAPADGAFLQPMLLAFADATTPAVNDIEAFGPVASIVEYADVADAATIVARGGGSLVTSVATHDPDVATELLTRMGAMNGRVLFLDRDDARTSTGHGAPVPHLVHGGPGRAGGGEELGGIRSVLHYMQRTAIQGSPRMLTALTGVWHPGAETDSAGTHPFRKPLSDLRIGDAVESAEREVTLDDIEVFANFTGDTFYAHMDEESAAANPFFPGRVAHGYLLVSWAAGLFVDPAPGPVLANSGLENLRFVTPVSPGDRIRVALTAKQITPRETDEYGEVRWDAVIRNQDDEIVAQYDVLTLVAKTWAPAPVAVPA

SEQ ID NO: 2754 - protein, 700 aa, Microbacterium testaceum
MTDAAVRPTTPATSTRTPVGGAPSAPHSAAEAAEARIDIDRVTDLLLGTWGDTRRQAREMLKDPALWRDDSLGMDAHRERTLSQLHLLVQNNAVHRAFPKRFGGEENNGANIAGFEELVAADPSLQIKSGVQWGLFGSAVLQLGTAEHHDKWLPGIMSLEIPGAFAMTETGHGSDVAAIGTTATYDPETEEFVIHTPFRGAWKDYLGNAALHGKAATVFAQLITNGVNHGVHCFYVPLRDEDGTFLPGIGGEDDGLKGGLNGIDNGRLHFDHVRIPRTNLLNRYGDVAADGTYSSDIASPGRRFFTMLGTLVQGRVSLDGAAAWASAIGLIIAITYGNQRRQFDSGSGTPEVTLLDYGKHQRRLLPRLATTYAEIFAHDEFLQKFDGVFSGALDTDADREDLETLAAALKPLSTWHALDTLQEAREACGGQGFLFENRLVGLRADLDIFVTFEGDNNILLQLVGKRLLADYARQFKGKDAKALAAFAVGQTAGKLFHGAGLRQLGQAVTDLGSTARSVERGLRADQQHELLAGRVQQMIADIAGRLRPASKLSREDAAALFNANQSELIEAARAHGELLQWEAFTDAINRIEDRGTLQVMTWLRDLFGLQLIEKHLAWHLINGRLSTQRAAAVSSYIDRLCARLRPHAQDLVDAFGYGPEHVRASIATGVEDDRQNEAAAYYAELRASGNAPVPEKKPAK

SEQ ID NO: 2755 - protein, 413 aa, Microbacterium testaceum
MTIDADARTLPGERVSHYDLLGRRDTDYYAVFADIPDADRAVWDRAKAFCDEVGTRMQGEWDAATYPVELLRRMGELELFTDGIEHPELPESSPLAAGLVNMEVSRHDGSLATALAVQGGLALRTLALFGSPEQQARWLGPLADGTVLGAFALTEPDHGSDSVSLETTATRTADGWSLSGTKKWIGNGASGGITFVWARVENEGGDDHGNVRCFLVEQDTPGYTGTVITGKVSLRGIHQAHIAMDDVRLAPDAVLPGTHTFKDASTVLFATRSGVAWSALGHATACYEIARTYATERMQFGKPLAKFQMVQERLAQMLDELTAMQLYCRRLADLESSGGLRPTQASLAKYHNTRAARRVASIARDLLGGNGILLENGVMQHMADIEAIHTYEGTESVQALLLGRDITGMSAFV

SEQ ID NO: 2756 - protein, 453 aa, Croceibacter atlanticus
MSLFGKIKGTLSLLKDIDIEAIAKLNSKIDLKEVMDKVGSLDDDQLNGLMKMLTRKAKRGQHKLPPIDGDFYDLSLKLTPEQREIQLKVRNFMEDEVRPIANEYWKKAEFPQQIIPKLATLNIAGIAYKGYGCPEQNFVMEGIIAIEMARVDVSMSTFFGVHSGLAMGSIYLCGSEEQKLEWLPKMQRMEAIGAFGLTEPNVGSAISQGMETTCQRDGDTWILNGQKKWIGNATFADVTIVWAKDVDDKQVKGFLVRKGTPGFSPEKIEDKMALRTVENALITITDCRISESDRLQEANSFKDTAKVLKMTRAGVAWQAVGCARGAYESAVKYCKKREQFGKPIATFQLIQNHLVEMLANLTAMQTLCYRLSELQDEGLLKDEQASLAKVFCSMRTRDVVSRAREVMGGNGILLEHDVARFVADAEAIYSYEGTKEINSLIVGRAITGYSAFV

SEQ ID NO: 2757 - protein, 435 aa, Arthrobacter aurescens
MMGDYSGSPGFPSGSVPSGPVPAGSVGSVPPSVADLPTADFFDFESLLSVQEQRKLNELRAFLASEIAPHAGHWWEKAEFPEHILPKLAALRLSAPAQRGYTHLFAGLVIAEMTRVDTSIATFFMVHHDLFVESLYDFGSDVQQDRYLDDASNLRTTGAFALTEPNHGSDVAGGMETTARRVERADSDGGDYWVINGAKRWIGNGTFCDYMLVWAKDEKDGAVRAFIVDASLPGITRSRIENKIALRTVQNADIVFADVEVAEADRFAGISSFADTNHLLRGSRIMVAWQAVGQQLAAFDVARQYAVERMQFGKPLAKFQLIQQHLVDMLGNAVASMGMMVRIAQLQEDIFTDAQGVRHGGADMAQVALAKAYCSARMRETVALGRSILGGNGIVTDYRIAKIFADAEAIYTYEGSYEINSLIVGRAVTGVSAIT

SEQ ID NO: 2758 - protein, 405 aa, Arthrobacter aurescens
MLDEKAAGTVTSGAVSERVLPPYPEADLMHVIDLLPTEERARYLEIREFLQTRIRAASIDYWNREEFPFGLLADMAKFGLGGLQTDGSSKLFKGLMYTEIARADVSLSALVGIHNELIVGMIHELGSDEQKRKWLPGLEAFTQLGAFALTEPDHGSDIAGGLSTTARRDGGEWVINGAKRWIGAGTIADFALVWARDLADGHIKGFIVETDRPGYSATKISNKIGLRIMQNAAIVLDEVRVPLENLLPGATEFSRANDLLRDSRAWVGWQAAGIQLAAFDIARSYALERKQFGKELARFQLVQQQLADILGNANASLSMMVELARIQQAGKLEMVQAAMCKATTTRLARSSVSMGRSLLGGNGITTDYEMAKLFGDAEILYTYEGSYEINSMIVARAVTGKSAFV

SEQ ID NO: 2759 - protein, 408 aa, Arthrobacter aurescens
MSTTATPGTGTDQRLYSVADWYDAEALLSTEERQVLGRLRTFLETEAKHLLAEYWERGEFPEQLARPLIDLDVMEPADLTLEAPARGIFHGFRIFELARTDASLATWYTAQAGLFRTAIRVGASEDQQKEWMPKVIDFSLKGVFSLTEPEHGSDIAGGLSTTTARFEANLDGGTWVLDGAKRWIGGASTADVLCVFARDVADGQVKAFLVDRTAAGVTLEKIHGKTSLRMMQNAHITLDNVRVPEAMRLHNVNSFKDVAAMLRAMRSDVAWIATGIQAGAFEAALAYVKERQQFGRSLGSYQLVQEKLARMLGNITASLSLVVRLTEQQAWGIYRDQDSALAKMQTSLMMRETVALAREVVGGNGITLAADVARFHADAEAVYSYEGTHEINALIVGRALTGESAFIH

SEQ ID NO: 2760 - protein, 716 aa, Puccinia graminis
MSDRSIAPVGPPDPSLPPVGSKINFNESPSLDSHEVSPPPGQSADHSGLTFNIPVPAHLKPTGTPGSKLLHIERSHASFDSKSMSFYLYGTTYLEKLNRILAIVQDEDAFDKKRLNYQGRDARFRHALRKEKRLVQIAKEHRWTEEDMSMAEMLIDMPGPFSLHKSMFLKTLQEQGDEEQQKMFTQPAENFQIIGCYAQTELGHGSNVQGLETTATYDKATQEFIIHSPSLTASKWWIGGLGRAADHAVVMAQLYTNGKKYGPHPFVVPNPRHPNSRPFTWYQTTDNGMILFDKVRIPHNHLLSRFSRVDPHSGQYIKPDNAKLAYGTMTYIRAGLVQQARMVLARSAIVAIRYCAIRRQFADKDAPPAENPVLDYQMVQYRIFPILAQAFACHYTGLEMFRLYNESQKNMSEGDFSLLADVHASSSGLKSLCTIMAAQAIEECRRACGGHGFSQASGLGALYADYLPQVTWEGDSYMITQQTGRYLFKTMRTLFQDRNAKLSAENVTGEYILRYLENPNEKSKVEYSGDFHDVQAFIWAYGHRAAFLVAQATRKRDIERRTWNSLLVDIYRCSVAHCQFLMVRNFARVLLYDEALKAKPALHHVIQLVFELYACYTMDVEASEFLASGYISPKQHILLRNRVYSLLAQIRPEAVALCDSFAVPDYLLNSELGRSDGNVYQKLIEFASKEPLNAVKFNVNPWDNELAIGEPSLAKL

SEQ ID NO: 2761 - protein, 681 aa, Niastella koreensis
MKKLGNYVTGRWITGDGEGQALYNAINGETIGYASTRGLDFNAILDYARKTGNPALRKLTFHERGLMLKALALHLRNHLDKFYAISYKTGATKADSWVDIEGGIGNLFSYASLRRKFPNEPYCVDGDAIPLGKGGTFMGQHILVPKEGVAVHINAFNFPVWGMLEKIAVNLLAGVPAVVKPATITSYLTEAVVQEIIASGILPEGSLQLLCGSAGDLLDHVTAQDVITFTGSASTGLQLKSHPRILAENVPFTMEADSLNCIVLGDDVTPNMPEWDIFIKEVRREMTTKAGQKCTAIRRIFVPQNKMEDVWLALGKALSQTTIGNPENDKVRMGSLAGQSQREEVLAQVQKLLASSQIVYGSLDSVQVVDADAKKGAFMSPLLLKNENPFESEAVHSVEAFGPVSTIMPYNSTDEAVALAKKGKGSLVCSIVTADNKIARDYVLGAATYHGRILVLNNECAKESTGHGSPLPLLVHGGPGRAGGGEEMGGTRGVKHYMQRVALQGSPTAITAITNVYQTGAQTREDEKHPFRKYFEELQIGDTLITHKRTVTEADIVNFANVSWDHFYAHTDHTSLQGTIFEKPVAHGYFILSAAAGLFVDAKKGPVLLNYGLEECRFVKPVYAGATIGVQLTCKEKIEQEKKDENDIPKGIVKWLVQVSDETGDPVAVATILTMVAKKSQ

SEQ ID NO: 2762 - protein, 688 aa, Saccharomonospora cyanea
MGTQATPPMSSTRLLRSYVSGGWHTAADEGAPLRDAVTGEEVARISSAGIDMGAALEHGRRVGGPALRELTFHQRAALLKALASYLREHRDELYALSARTGATRGDSKFDVDGGIGVLFSYASKGRRELPNDTVYLDGPVEPLGKGGTFVGRHVCTPLRGVAVQINAFNFPVWGPLEKFAPAFLAGVPSLVKPASQTAYLTEKLVELMLGSELLPEGTLQLVCGSAGDLLDHVTGQDLVSFTGSAATAQRLRAHPAIVRGAVRFNAEADSLNCSILGPDATPGTAEFDLYVKQLVTEMTVKAGQKCTAIRRAFVPAELLDDVQQAVCERLERVSVGDPSNPEVRMGALASLEQREEVRRSLKALRDAGRIVFGDPEHVDVVGADPERGAFLSPVLLRADDPDRAEPHEVEAFGPVSTLLPYTSVEQVVELAARGQGSLVGSVVTGDTEFARDVVLGAAPWHGRLLVLDADDAQESTGHGSPLPMLVHGGPGRAGGGEEMGGIRGVLHHMQRTAVQGSPEVLTAVGNAWVPGAPRSEGVHPFRKSLAELRIGDSVVAGPRTVTDADVAHFAEFTGDTFYAHTDEAAAEANPLFGGIVAHGYLVVSFAAGLFVSPEPGPVLANYGLENLRFLTPVKPGDALTVTLTCKQITPRENADYGEVRWDTDVTNADGESVAKYDVLTLVAKENER

SEQ ID NO: 2763 - protein, 676 aa, Saccharomonospora marina
MGPLPSYVSGEWRAPSGQGAPLLDAVTGEQVATVSSSGLDLGAALEYGRSVGGPALRELTFHQRAGLLKALASHLREHRDELYELSARTGATLGDSKFDVDGGIGVLFAYSSKARRELPNDTVYVEGDVETLAKLGTFVGQHIATPLRGVAVQINAFNFPVWGPLEKFAPAFVAGVPTLVKPASQTAYLTHRLVELVVGSELLPPGSLQLVCGGAGDLLDHLTEQDLVSFTGSAATAQRLRAHPSIVRNSVRFNAEADSLNCSVLGPDATPGTAEFDLYVKQLVTEMTVKAGQKCTAIRRALVPSALIGDVAEAVSDRLASVTVGNPGSDGVRMGALASLEQREEVRRSLKALLDAGSVVFGDPEHVDVVDADPRRGAFISPVLLRADDPGRAEPHEVEAFGPVSTLVPYGSTEEAVRLAARGSGSLAGSIVTADADFARDVVLGVAPWHGRLLVLDADDAAESTGHGSPLPALVHGGPGRAGGGEEMGGIRGVLHHMQRTAVQASPRVLGAVTGRWVPGAPRSQGEHPFRKPLSRLRVGDTVVAGPRAVTEEDIAHFAEFTGDTFYAHTDEEQATANPLFGGIVAHGYLVVSFAAGLFVDPAPGPVLANYGLENLRFLTPVKPGDELTVTLTAKQIVPRENADYGEVRWDTDVTNQRGESVAKYDVLTLVRKEAR

SEQ ID NO: 2764 - protein, 683 aa, Owenweeksia hongkongensis
MKNIQNYVMGEWVNGEGEELVATNAITGDAIGIVSSAGLDYEAILDYGRKKGGAALRKMTFQERGRMLKALALHLVSIKDKFYELSYATGATKIDSWVDIEGGIGNLFANASLRRQFPDLPYYVDGQPAALSKNGTFIGHHIMVPKRGVAVHINAFNFPVWGMLEKIAVNLMAGVPAVVKPAESTSFLTELMVREIIASNILPEGALQVVTGLGRGIIDHVQTGDTVTFTGSAATGKKLQALPHIIDRSVTFNLEADSLNAAILGPDVEPGMPEFDLFVKEVQREVTSKAGQKCTAVRRVLVPEDKMDAVQEALTSRLSKTVIGDPQTEGVRMGSLASKLQVERLVENVERLMKSQEVVYGDLRDFDVVGADKSKGAFASPILFRNNDPFKNTDVHDVECFGPVTSMMPYKTLEDAVEIANMGKGSLVSSIITADDKIAREYVVEAAHMHGRIHVLNAKSAKESTGHGSPMPLLTHGGPGRAGGGEEMGGKRGVLHYLQRTAIQGHPDTIMEITQVYQPGASRPESEKHLFRQHFEELKVGDTVYTHKHTVTDADIASFAQVSGDNFYAHVDATSLDGTIFEGKVAHGYYVLSKAAGMFVDPRKGPVLLNYGLDECRFTKPVYPGMTIGVKFTVKEKIDQEKKSEDDIAKGIVRFNVDVYDETGETVALATILTMVKKIDQSS

SEQ ID NO: 2765 - protein, 602 aa, Kitasatospora setae; identical to SEQ ID NO: 1021

SEQ ID NO: 2766 - protein, 688 aa, Saccharomonospora cyanea; identical to SEQ ID NO: 2762

SEQ ID NO: 2767 - protein, 676 aa, Saccharomonospora marina; identical to SEQ ID NO: 2763

SEQ ID NO: 2768 - protein, 415 aa, Salinibacter ruber; identical to SEQ ID NO: 2722

SEQ ID NO: 2769 - protein, 733 aa, Ashbya gossypii; identical to SEQ ID NO: 2742

SEQ ID NO: 2770 - protein, 679 aa, Bacteriovorax marinus
MKLQSYALGQWSEGKTEGTNLLDASNGNLIGSVCSKGLDFGEMLDFGRRIGNKNLRNMTFHERARALKALALHLLEHKERFYTISYQTGATKIDSWIDIEGGIGNLFVYSSKGRRELPNEKFLVDGAPEHLSKNGTFLGHHIWTPKRGCAVHINAFNFPVWGMLEKIAVNILAGMPAIVKPATATSYLTEVVFREIIDSKLLPEGSLQLVMGSASGILDHATSSDVITFTGSAHTGRMLKSHENILNHNIPFNLEADSLNASILGPDAKPGTPEFDLFVKEVSKEMTIKAGQKCTAIRRIIIPSESVEEVSKALSARLEKVTIGDPRNKDVRMGPLASLDQREEVLAKISELRNECELIYGGSLPKEILGADADKGAFVSPTLLLCQDPMKASAVHSTEAFGPVSTIIPYNSTEEAIEFAHMGGGSLVSSVVTHDNEFATEIVLETASSHGRMLVLNRDCAKESTGHGSPMPQLVHGGPGRAGGGEEMGGIRGVHHYMQRTAIQGHPTTLTALTNVYQPGSEQLDPGTHPFRKYFEELRIGDTHQTHKRTITETDIVNFANVSWDHFYAHTDTTSLEGTIFEKRVAHGYFIISAAAGLFVDPGKGPVLANYGLDELRFIKPVYAGATISVKLTCKEKIDQEAREGEEPRGVVKWQVEVSDETDEVVALATILTLVAKKN

SEQ ID NO: 2771 - protein, 690 aa, Rhodothermus marinus
METTVYLGKVQSFAQGRWYTPAGEGCPVFHAVTGEPIAEISSEGLDFKGMLDHARTVGGPKLRQMTFHERARMLKALALYLNEHRAELYELSRATGATKQDAWLDIDGGIGAFFVYASKGRRELPDERFLLEGEPERISRGGTFLGHHLLVPLEGVAVHINAFNFPCWGMLEKLAPTFLAGMPAIVKPASVTAYVAERVVRLMLESGILPEGALQLICGGVGDLFEHLTGQDVVTFTGSAETGLRLKSHPTILREAVRFNMEADSLNFSMLGPDVTPDMPEFELFINEVVREMTIKTGQRCTAIRRTLVPADRVDAVLEALSRRLREVVVGDPANERVQMGPLVSRDQVAEVQARLEELAAAGEIVCGRDGFSVVDADPERGAFFPPTLLYCAHPFEHTAPHEVEAFGPVNTVMPYRDLDEAIRLARMGRGSLVGSLVTADPDVARTVVFGTAPYHGRLLILNRECAKENTGHGSPLPHLVHGGPGRAGGGEEMGGIRGLYRYMQRTAIQGSPDMLTAIGNQWMPGASRPEADVHPFRKYFDELRIGETYTTARRTVTEADIVNFAGVSGDFFYAHMDELAARESEVFQGRVAHGYFVLSAAAGLFVDPRPGPVLANYGLENLRFTKPVRPGDTIQARLTVKQKIPRETREGERPGGVVRWHVDVTNQDDELVATYDILTLVARQSEPEA

SEQ ID NO: 2772 - protein, 845 aa, Lacinutrix sp.; identical to SEQ ID NO: 2701

SEQ ID NO: 2773 - protein, 684 aa, Haliscomenobacter hydrossis; identical to SEQ ID NO: 2721

SEQ ID NO: 2774 - protein, 406 aa, Carnobacterium sp.
MMNTKTMERPVDLATFYPSDLYEYSSALTDGELTVLKELREALEINLRPVLSEYWEKAEFPFEAFEKIGKVRMMDNPLLFEGRESTRKPSELYNVFRYFELAKLDASIATFYTVHGGLFYATLLQGGNDEQIERWAEKTASYEIQGCFALTEPEHGSDIAGGLATTARKEGDTWIINGEKRWIGGAGSADEIAVFARDEADGKVKAFMVPGKAEGVHVQKIEGKISLRMTQNGHITLTDVKVGEDRRLQNVNSFKDVAGILRITRADISHLATGLTAGAFEAALRYVKQREQFGKNLGSFQLVQEKLSIMQANVTANLSFSVRLAQMQEEGNYREVNSSMAKMHNALRMRETVALAREVVGGNGITLETDVARFFADAEAIYSYEGTHEINALIVGRYLTGVGAFV

SEQ ID NO: 2775 - protein, 420 aa, Carnobacterium sp.
MMENREQVLRMEKREPVSKLENREQILKEMYPEDILKFSESLTDGEIVVLQRVRKAVNEHLKPVINDYWKRGEFPTEEFKHVAKTGLINDPALFENQPNQFMWRNTYFLFLAYDLYKFDASIATFFGVHAGLGYFSFLLGGSPEQQMRWLPKLQNFELQTCFALTEPEHGSDTAAGLATTARREGDKWIINGEKRWIGGASSADLIPVYARDVEDNKVKCFIVEKGQKGLSVDDIDDKIALRIVQNGNIHLDNVEVVESNRLQNINGFKDVAKVLYATRAGVAYAGAGMMAGSLEAALEYTTNRVQFGKPIASFQLVQEKLARMQGNAVNALALSARLAELQERGEFSEINASLAKMNNSLRLRETVALGREVCGGNGITLERNVARFFCDAEAIYSYEGTHEMNALIMGRKLTGISAFV

SEQ ID NO: 2776 - protein, 406 aa, Carnobacterium sp.; identical to SEQ ID NO: 2774

SEQ ID NO: 2777 - protein, 420 aa, Carnobacterium sp.; identical to SEQ ID NO: 2775

SEQ ID NO: 2778 - protein, 690 aa, Fluviicola taffensis; identical to SEQ ID NO: 2726

SEQ ID NO: 2779 - protein, 685 aa, Pseudonocardia dioxanivorans; identical to SEQ ID NO: 2702

SEQ ID NO: 2780 - protein, 404 aa, Aerococcus urinae; identical to SEQ ID NO: 2703

SEQ ID NO: 2781 - protein, 703 aa, Arthrobacter phenanthrenivorans; identical to SEQ ID NO: 2704

SEQ ID NO: 2782 - protein, 777 aa, Stigmatella aurantiaca; identical to SEQ ID NO: 876

SEQ ID NO: 2783 - protein, 408 aa, Renibacterium salmoninarum; identical to SEQ ID NO: 2711

SEQ ID NO: 2784 - protein, 429 aa, Renibacterium salmoninarum; identical to SEQ ID NO: 2712

SEQ ID NO: 2785 - protein, 675 aa, Sphingomonas wittichii; identical to SEQ ID NO: 2207

SEQ ID NO: 2786 - protein, 435 aa, Arthrobacter aurescens; identical to SEQ ID NO: 2757

SEQ ID NO: 2787 - protein, 405 aa, Arthrobacter aurescens; identical to SEQ ID NO: 2758

SEQ ID NO: 2788 - protein, 707 aa, Arthrobacter aurescens; identical to SEQ ID NO: 2228

SEQ ID NO: 2789 - protein, 408 aa, Arthrobacter aurescens; identical to SEQ ID NO: 2759

SEQ ID NO: 2790 - protein, 703 aa, Arthrobacter sp.; identical to SEQ ID NO: 2198

SEQ ID NO: 2791 - protein, 699 aa, Rhodopseudomonas palustris; identical to SEQ ID NO: 2236

SEQ ID NO: 2792 - protein, 676 aa, Ruegeria sp.; identical to SEQ ID NO: 2210

SEQ ID NO: 2793 - protein, 430 aa, Deinococcus geothermalis
MPVHAASRRLGDPPPRRSPGRLRQAAGVVCASELMALNRSKGAVMIDEFGVFDLLTPEERLIRESVRAFCDAELLPKIAEWWDSGDFPVREVMRKFGQLGLLGPTTPEEYGGAGTSYSAYGAMMYELERVDSGLRSAASVQGSLVMFPILNYGSEAQKRRYLPGLASGELIGCFGLTEPDGGSDPGAMRTRAHRDGNAYVLHGNKMWITNSPVADLAVVWAKDDEGIIRGFIVPTDTPGFSAPKIHRKMSLRASVTGEIVLEECRIPAENVLPGSGGLKSPLSCLTSARFGIAWGAMGALEAVLQTALDYTGSRRTFGKPIAARQLVQDKLVRMATDHSAGLLLAWRLGQLKDTGRMNYAQVSYAKRNNVRVALQGARLARELLGGNGITTEYPVIRHMLNLETVDTYEGTHDIHTLIVGRHLTGLGALE

SEQ ID NO: 2794 - protein, 674 aa, Rhodopseudomonas palustris; identical to SEQ ID NO: 2238

SEQ ID NO: 2795 - protein, 664 aa, Jannaschia sp.; identical to SEQ ID NO: 2246

SEQ ID NO: 2796 - protein, 420 aa, Corynebacterium efficiens
MTTHLADQTAKPTTTTPKHVTDLMNIEGLLTPGEIEVRDRIAAFVDRRIRPNIAEWYDNAVLPRELLPEMAAEGLFGMHIEGYGCGGRTATEYGIAMQELEAGDSGLRTVVSVQGSLAMTAIAKHGSEEQKQTWLPGMAKGEIIGCFGLTEPTAGSDPASMGTRATWENGEWVLNGEKRWIGLANIADVAIIWAKVSDEDARAAGVLAGPGSDNGEKVRGFIVPTGTDGFHAEAITQKLSMRASIQCEIHMDNVRLDGDAILPKNPGLKGPFMCLNEARFGIAWGALGAARDSIEAAIEYSSTRMQFDRPLSSFQLTQKKLADMTVELNKGQLLALQLGRAHDAGTLENHQISVGKLANCRTAIEICREARTILGGNGISLDYSPLRHANNLESVRTYEGTDEVHTLIIGQKLTGESAFR

SEQ ID NO: 2797 - protein, 410 aa, Corynebacterium efficiens
MSAPTLSPATVPPVTEHPDFLLLDSDLSAEDIALRDRIRAFGQEHILPIINEYWERAEFPMEVLEPLADLGIVGTFIQGYGCPGLSRQAAGIVARELGRIDGSVNTFFGVHSNLGMGAIYTLGNEEQRQRWLPDMAKLKKIGAFALTEPNHGSDSVALETSARREGDHWVLNGHKRWIGNGHAADVIVVFARDEADGNVKAFVVEKNEDGTYPEGYQPEVITGKVGKRAILQGDIVIDNLRVPVENRLENCESFAGVNRVLSATRGGASWEAVGHGMAAFELASQYALSREQFGAPIAGYQLVQEKLATMLSDVTQMQLLCTRMAQLQERGEFTGSMAAMIKMVTSRKALAACREARDMFGGNGLLLENHIARHLTDMEVVSTYEGTDSIQALLVGREITGISAFTTKKR

SEQ ID NO: 2798 - protein, 432 aa, Corynebacterium efficiens
MARVGTPTPPQPRSLPSSTTIHTEMPMPTGQLSADVVEHADYLLLDADFTQGERVLRDQVRAFGKEHILPIINDYWERAEFPYEILEPLAGLGLAGTVIKGYGCPGLSRLENGIVSRELGRIDGSICTFFGVHSGLSMGSINILGSEEQRRRWLPDMAKFRKTGAFALTEPNHGSDSVSLETSARREGDSWVLNGHKRWIGNGHAGDIIVVYARDEADQQVKAFVVEKQRNGEYPPGYRAEVITGKTGKRAILQGDIVIDNLRIPEENRLTNCHSFKDVNRVLAATRGGVAWESTGHAMAGFELAAQYALQRHQFGSPIASYQLVQTKLAHMLADVVENQLLCVRMAELQERGEFSTPMASLTKMTTAKNALSICREARDMMGGNGLLLNNHIARHMTDMEVSYTYEGTDSIQALIVGRDITGISAFTHSRK

SEQ ID NO: 2799 - protein, 707 aa, Nesterenkonia sp.
MTAIAADHETTISPTRPLPSYLADSWWAPEDPQKISTVRDASTGEPICRVSAEGLDTAAAVEHARSVGQRSLGELTIHERAMLLKRIAQHLDEHKEELYTLSDRTGATRRDHLIDVDGGIGTLRTFSSKARKELPNAQVIVDGAVEQLSRDGSFLGEHIYTRLAGVAVQINAFNFPVWGMLEKLAPSFIAGVPTLVKPASQTAYVTQACVRLMVDSGLLPAGAIQLISGSAGDLLDHLDHRDVLAFTGSASTAQLLRSHPSVQTAGLRFTAETDSLNAAILGPDAGPETPEFEAFIKSVVLEMTAKAGQKCTAVRRTIVPSEHVDAVVEALRERLDSRAVLGDPRDEATTVGALASKDQQAEVARAVTTLMEAGGTVRCGGVDADLGGVDAEAGAFFPPTVLSFDDARTPQVHAVEAFGPVTSVLGYADVDDAVELAALGGGSLVATVCTHDPQIAGAFARGIGSHHGRVLFLDRDDAKTSTGHGSPLPHLVHGGPGRAGGGEELGGVRAVKHHMQRTAVQGSPDLLTGITGVWHRGARAQTATPETVADGSAVHPFRKSLAELRLGDQFASGLRTVALEDIDAFAASTGDTFYAHTDEEAATANPFFPRRVAHGYLLVSWAAGLFVEPAPGPVLANTGLENLSFETPVTYDDAIRVTLTAKEIIPREDEDFGQVRWDTVLHNQHDEVVATYDVLTRVAAEKKPEWA

SEQ ID NO: 2800 - protein, 696 aa, Tribolium castaneum
MSDTSFIKDLPSGPLDAYRDRATFDWKKMKLFFEDPDLLKVKMRVWETLEKDPIFQTPKTELNSEEMKRRSALQLRKYCQLSFVTPEMANLPYKRKTRYMMTINEALAVTFPDVSVKHAIGIGLFKNTLTTLGTERHKNVLDAAWKGKILSCLALTEIAHGSNTKQMRTTATYDKTRQEFIINTPDFEAAKCWVGNLGKTCTMGLLFAQLYTNGQCYGLHAFLVPIRDPKTLLPYPGIVVGDMGEKIGLHGIDNGFIMFKNYRIPRENLLNRTGDVTPDGDYKSSFSEPGKILGAALENLSTGRVGIMQESANNLVCAVTIAVRYAAVRKQFAKSPDERSELPIIEYELHQWRIFPYVAAAAVLKIFVAGFTDEYLATVQKSTSATQIEDLTSYVAEIHAVVSSGKPLITWICRDAVQECREACGGHGFLKSARFGELRGAIDPCVTYEGDNNVLGQQASNWLVRQWEKTKVGEELCTPLETCAFFRRSGEILRRKFELELVQDVLEMNFIHVCYEWLITYLVEETYIKQQKLLKEGFCKTEARNKSQVYCASVLTRVYAEYNAFRFYCKELSKAEKSLEGVLQQLGLLYGLVNIDKYSSYFYQGGYANTPLFSHLVKGGVLELCKTLKDNILGVIDAMAPPDYVVKSVLGKSDGKLYENLQNAIMGNPDSMTRPHWWREIIVPDAPDFKQPKSKL

SEQ ID NO: 2801 - protein, 684 aa, Tribolium castaneum; identical to SEQ ID NO: 973

SEQ ID NO: 2802 - protein, 674 aa, Drosophila pseudoobscura
MSSVNVDLQRERSGASIDSEDFARWWAGGSDKLEERRALERFVFKDAELEEAVHPSCLSYKERYEQTIARSTKFLVKLRQWHSTNQPQFSLSVDSLREFRVLLSGQLGTALFQQSFPLRLHFSMFLTTLLSQGTEEQLHKWLTRAWHMDGIIGTYAQTELGHGTFVRGLETRADYDAESEEFVLNTPSLSAYKWWPGGLGNTANMTIVLAQLYVKGQHHGLQPFLVRIRDEETHQPLPGVDVGDIGPKLGGNGVNNGFLGLRNVRIPRDQMLMKNAQVLPDGTFVQGRPPLLLYGTMVYVRVITLRDVLHGLLQAATIATRYSVVRRQSPIDDNQPEVQILDHITQQVKILPQIARGVCYRLAADWLWNFYASVLDQLERGSGQHSLPELHALSCCLKAVATDEASEGIDRLRKACGGHGFLSSANFDSIYGMATAAYTYEGEYTVLMLQTARFLVRQYTDSLKRRVLPGSVTYLRNTARLSWGKDLAENAARALEISAMEQTRQAWQSQSMHRQRKLSEQQSNNLAGRQLTAAAVAHAHAFLTRNSLQELERLRRGPLSTQVSAVLGQLVELFVLDTFLRQAGPVLRWNSITGTQLRLVERRFEELLTKLRPNAVALVDGFDFHDRTLGSTLGSYDGRVYERLMAEARRNPLNQEPVNATFRSHLQPMMRGKL

SEQ ID NO: 2803 - protein, 677 aa, Drosophila pseudoobscura
MSHIKKLIPKTVNPDLLKERTGAEFNVEEFAAWWQGGQEKLNTKREVERAIFSDLEDGYGLNHEYMSHEDVYNSSVKKVAEAAVKLKALQNKINPGGNDIWPGLLYNVESHGLFPANHPLATHITMFVDVINGQGTPEQVEKWGKAAENCNIIGTYAQTELAHGTNVRGIATRADFDPKTDEFVLHTPNLEAYKWWPGGLGHTANHAMVVAQLYIADVHHGVQMFIVPVRDAETHMPLPGVDIGEVGKKLGMVAVNQGFLGLDNVRIPRTNMLMKFAKVERDGTFKASPASRVNYLTMVYTRCLIVNLTSTLLLEAATIATRYSAVRRQSPFEANQPEPQIIDHVTQRLKLFPEIANGMAYHLAAEHMWEIYAQTVEEANSGKFDRLPDMHILSCALKVLATTDGCAGIERLRLSTGGHGYLTAANMSNIYGNAVAAYTYEGENTVLLLQIGRALVKAWATFVEKKPVSASYGYFATSMQLKQSPKWDNSRQCIIQALQYTAAQKTRIAFENLAERMASGQSQGVAANNTGIELARAAELHGRQFVCQTFLEQVTGPKAQKRSAALNKILENVLELFLVQTVLNNMNDVLRFISLTDADLKSLQKRLEVALEKFRPNAVAVCDGFGFHDRVLNSVLGSYDGNVYPRLFDSAKRSTMNQKPVQKSFETYLKPLMKANL

SEQ ID NO: 2804 - protein, 748 aa, Saccharomyces cerevisiae
  MOD_RES (262)..(262): Any amino acid
MTRRTTINPDSVVLNPQKFIQKERADSKIKVDQVNTFLESSPERRTLTHALIDQIVNDPILKTDTDYYDATKLQEREITAKKIARLASYMEHDIKTVRKHFRNTDLMKELQANDPDKASPLTNKDLFIFDKRLSLVANIDPQLGTRVGVHLGLFGNCIKGNGTDEQIRYWLQERGATLMKGIYGCFAMTELGHGSNVAQLQTRAVYDKQNDTFIIDTPDLTATKWWIGGAAHSATHAAVYARLIVEGKDYGVKTFVVPLRDXSTFQLLAGVSIGDIGAKMGRDGIDNGWIQFRNVVIPREFMLSRFTKVVRSPDGSVTVKTEPQLDQISGYSALLSGRVNMVMDSFRFGSKFATIAVRYAVGRQQFAPRKGLSETQLIDYPLHQYRVLPQLCVPYLVSPVAFKLMDNYYSTLDELYNASSSADKAALVTVSKKLKNLFIDSASLKATNTWLIATLIDELRQTCGGHGYSQYNGFGKGYDDWVVQCTWEGDNNVLSLTSAKSILKKFIDSATKGRFDNTLDVDSFSYLKPQYIGSVVSGETKSSLKELGDYTEIWSITLIKLLAHIGTLVEKSRSIDSVSKLLVLVSKFHALRCMLKTYYDKLNSRDSHISDEITKESMWNVYKLFSLYFIDKHSGEFQQFKIFTPDQISKVVQPQLLALLPIVRKDCIGLTDSFELPDAMLNSPIGYFDGDIYHNYFNEVCRNNPVEADGAGKPSYHALLSSMLGRGFEFDQKLGGAANAEILSKINK

SEQ ID NO: 2805 - protein, 749 aa, Saccharomyces cerevisiae
MTRRTTIDPDSVVLNPQKFIQKERANSKIKVDQVNTFLESSPERRALTHTLIDQIVNDPVLKTDTDYYDATKLQEREVTAKKIARLASYMEHDIKTVRKHFRGTDLMEDLQANDPDKAAPLTNKDISIFDKRLSLVANIDPQLGTRVGVHLGLFGNCIKGNGTDEQIRYWLQERGATLMKGIYGCFAMTELGHGSNVAQLQTKAVYDKQTDAFIIDTPDLTATKWWIGGAAHSATHATVYARLIVEGKDYGVKTFVIPLRDPSTFQLLPGISIGDIGAKMGRDGIDNGWIQFRNVVIPREFMLSRFTKVIRSPDGSVTVKTEPQLDQISGYSALLSGRVNMVMDSFRFGSKFATIAVRYAVGRQQFAPKKGMSETQLIDYPLHQYRVLPQLCVPYLVSPVAFKLMDSYYSTLDELYKASSSADKAALITVSKKLKNLFIDSASLKATNTWLIATLIDELRQTCGGHGYSQYNGFGKGYDDWVVQCTWEGDNNVLSLTSAKSILKKFVDSATKGRFDAQLDVDSFSYLKPRYIGSVISGETKSSLQELGDYTEVWSITLVKLLAHIGTLVEKSRSIDSVSKLLVLVSKFHALRCMLKTYYEKLNSSSDSHISDEITRESLWNVYKLFSLYFIDKHSGEFQQFKIFTADQISRVVQPQLLALLPIVRRDCISLTDSFELPDAMLNAPIGYFDGDIYHNYFNEVCRNNPAEADGAGKPPYHAELSTMLDRGFEFDQKLGGAATTETLSKLNK

SEQ ID NO: 2806 - protein, 752 aa, Torulaspora delbrueckii
MTRSSTIKQESPVLNPQRLIAQERAKSKINIDQINTFLESSPDRRELTHRLIDEVVNDPVLKTETSYYDQTKNEQRENTAKKIARLALYMEHDVKTVRKHFKGTDLIKDLQNDKECKLEPLSNKDLFIFDKRLSLVANIDPQLGTRVGVHLGLFGNCIKGNGTDEQIHYWLQERGALFIKGIYGCFAMTELGHGSNVAQLQTRAVYDSDSDTIVINTPDLTATKWWIGGAAHSATHSAVYARLIVSGKDYGVKTFVVPLRDPATFQLLPGISIGDIGAKMGRDGIDNGWIQFRNVVIPREFMLSRFTKIVRARDGCATVKTEPQLDQISGYSALLNGRVNMVMDSFRFGSKFATIATRYAVGRQQFAEKKGQPESQLIDYPLHQYRVLPQLAVAYLISPAAFKLMDVYYSTLDELYQASSPASSTDPNALKVVSQKLKNLFIDSASLKATNTWLVAQLIDELRQTCGGLGYSQYNAFGKGYNDWVVQCTWEGDNSILSLTSAKSILKKFVEAGTKGRFDEKLDSDSFNYLEPSFLMSVLSGQQSAEFEDLKDYTRVWAVALVKILNHTARLIEKTKKVDGVSKLLIMISKFHALHSMLKVYHDKLHSMKDSHVTDPKSKDALWNIYKLFSVYFIDKHAGEFLQFKIFTPDQISKVIQPQLSQLLPEVRKDCIPLTDAFELPDAMLNAPIGYYDGDIYNNYYNEVLKNNPVEPDGAGKPRYHELLTTMLKRGHDFDERLGGAANADILSRLAK

SEQ ID NO: 2807 - protein, 758 aa, Tetrapisispora phaffii
MTRGSTLDRKSRVLNPQRFIRNERDSSKLNIDEINLFLESDPKRSKLTHSLIDQLVNDPVLKTGMDYYEMTKNEEREVTAKKIARMAQYMENDIKTQRNFFRNEDLIKKLQNDPNSIEPLSNNDVEIFDKRLSLVANIDPQLSTRIGVHLGLFGNCIKGNGTDEQIKYWLQERGATFMKGIYGCFAMTELGHGSNVSGLQTTAVYDPVSDTFTLNTPDITATKWWIGGAASSATHAAVYARLLVNNKDYEVKTFVVPLRNPETFQLLAGVAIGDIGAKMGRHGIDNGWIQFRNVVIPREYMLSRFTKINRKTDNEGGIEVTVKTEPQLDQISGYSALLSGRVNMVMDSFRFGSKFVTIATRYAVGRQQFANSPNEEENQLMNYPLHQYRILPQLALVYLLSPAAFKLMDTYYNTLNELYRVSAKADAIDPAALQTVTKKLKNLFIDSASLKATNTWLVATLIDELRQTCGGHGYSQYNGFGRGYNDWVVQCTWEGDNTILSLTSAKSILKKFGDVVSKGKFNEKFDSDSFNYLNPRFVQSVLTNQVKANLTDDPKDAYNYTEVWEVCLVKLLAHIGKTIKKTKKVDDVSKLLVVVSKFHAIHYMLKTYYLKISSQKDSHINDKDSNETLWKLYKLFSLYFIDKHAAEFQQFKIFTPDEISVTVQPNLFALLPEIRKDCIVLTDSFKLPDAMLNAPIGYYDGDIYNNYFNEVKKSNPIEIDGAGKPPYHELLSTMLGRNFEVDSLGGSATSEILARLSL

SEQ ID NO: 2808 - protein, 673 aa, Ruegeria pomeroyi; identical to SEQ ID NO: 2239

SEQ ID NO: 2809 - protein, 719 aa, Leishmania mexicana
MPARLSAHLAPRRHFARPTEPRLFEVNPARERYVIETAFEEPTFRFICEGVDVDFKEDVREALAKLLPPPPSNFTQREEDTGLQLPQILQTLRSLCRQELVSFAQVRSTPRRLASYYEVLAAVNPVLAVLAAEHYTFAGLVATHAKKSVRDAVLAGVDSAATIGCIADQELIAEGTPLNTEARYDVHERCFVLRGTGKFGVVAAACAQWALVSATLTLNKKEHNGTHLFLVQLREGDLLSASGQLRRGVSVRPITGENTTMAGCGVAVLHFEDVRIPCDHLLDPYCITSESKVGYVAGQETQEPATEVLRTRRRIATGAIYIGVTKKFLTDVVTYTADKCVVGPDYRRNYPFLGLQHIQSPLVSMLAKSYVHLVAWQRLLPVFTDPSGSPSYEDHMRLAGTVHFLQENLLDLQTFADKTMGLHGSFASTGKDAAVTLVHLRQEGLDTSALIREVAFQSVTKNIGTTHWGWWLTSLLQPAFPALNRFLKNPLYSPRIADLGRHLIFFSHKHYSLKKRLQQSRELERRKGGSEHEWYDWVMFRHRTVVHCGEAFMEVYYLDVMMKETEKCSDPRGRKILRDIAWIYALTRQMDRLDFLLSSKMLSPGKAETLASHIDNIVTVLAPQCVHLVEAMQVPEFARAPCRSATYMEAYWTIPGTNTHIERGDRLTLHDATNASSSKGRRGAENAKAAQEAIRESPEEFDLFHGLADEPSYALRKSP

SEQ ID NO: 2810 - protein, 681 aa, Niastella koreensis; identical to SEQ ID NO: 2761

SEQ ID NO: 2811 - protein, 679 aa, Saccharomonospora azurea
MSTRLLRSYVGGEWRTAADEGTPLHDAVTGEEVARVSSTGIDMGAALEYGRRVGGPALRELTFHQRAALLKALASHLREHRDELYALSARTGATRGDSMFDVDGGIGVLFSYSSKGRRELPNDTVYLDGAVEPLGKAGTFVGRHIATPLRGVAVQINAFNFPVWGPLEKFAPAFLAGVPSLVKPASQTAYLTEKLVELMLASELLPEGSLQLVCGSAGDLLDHVTEQDLVSFTGSAATARRLRAHSAVVRNAVRFNAEADSLNCSILGPDATPGTAEFDLYVKQLVTEMTVKAGQKCTAIRRAFVPAELLDDVQEAVCERLARISVGDPSNPDVRMGALASLEQREEVRRSLKALSDAGRIVFGDPDHVEVVGADAERGAFLSPVLLRADDPQRAEPHEVEAFGAVSTLLPYTSAEQVVELAARGQGSLVGSVVTGDAEFARDVVLGAAPWHGRMLVLDADDAKESTGHGSPLPMLVHGGPGRAGGGEELGGIRAVLHHMQRTAVQASPKVLTAVGNSWVPGAPRSEGVHPFRKSLAELRIGDSVVAGPRIVTDSDVAHFAEFTGDTFYAHTDEAAAAANPLFGGIVAHGYLVVSFAAGLFVSPEPGPVLANYGLENLRFLTPVKPGDELTVTLTCKQITPRENADYGEVRWDADVTNAAGDSVAKYDVLTLVAKEAAR

SEQ ID NO: 2812 - protein, 752 aa, Torulaspora delbrueckii; identical to SEQ ID NO: 2806

SEQ ID NO: 2813 - protein, 680 aa, Gordonia amarae; identical to SEQ ID NO: 2750

SEQ ID NO: 2814 - protein, 758 aa, Tetrapisispora phaffii; identical to SEQ ID NO: 2807

SEQ ID NO: 2815 - protein, 653 aa, Gordonia alkanivorans; identical to SEQ ID NO: 2751

SEQ ID NO: 2816 - protein, 406 aa, Arthrobacter globiformis; identical to SEQ ID NO: 2654

SEQ ID NO: 2817 - protein, 404 aa, Arthrobacter globiformis; identical to SEQ ID NO: 2653

SEQ ID NO: 2818 - protein, 703 aa, Arthrobacter globiformis; identical to SEQ ID NO: 2652

SEQ ID NO: 2819 - protein, 679 aa, Gordonia polyisoprenivorans
MSRLLESWTQGRWYAAPDEGTPLLDAVDGSEVARISATGVDRAAMVEYARTVGGEALATLTFHERAGLLKQLGLTLMAGKDEFYELSRKTGATDRDSAVDIDGGFGTVLSYASKARRELPNDTVYLDGPVEPLGKKGTFLGQHLYTSRRGVAVQINAFNFPVWGFLEKLAPAFIAGVPTIVKPASATAYLTELVVRRIVESGILPEGSVQLLCGSAGDLLDHLDGQDSMAFTGSADTAAVLRAHPTVVASGLHFTAEADSLNASILGADIGVGDPEFDLYVRQLVTEMTVKAGQKCTAIRRALVPEPLVDAVVEAASARLATIRVGNPAAPDVRMGALASIEQRDEVLKSLRGLTKSADIVFGDPDHVELVDAERSKGAFLSPILLRANDSWAPEIHDIEAFGPVSTVIGYRDTDDAIALAARGRGSLVASLVTADTDVAATVVRGIAAYHGRILVLNAEDAAESTGHGSPLPVLVHGGPGRAGGGEELGGIRGVLHHMQRTAVQGTPNILTAIGRRWVSGADRVHTDVHPFRKNLSQLQIGDTIVGGPRQVTRADIDHFAEFTGDTFYAHTDPEAAAANPLFGGIVAHGYLVVSLAAGLFVDPAPGPVLANFGVDGLRFLTPVKAEDSLTVTLTAKQITPRQSADYGEVRWDAVVTNQNDDPVATYDVLTLVAKAEKE

SEQ ID NO: 2820 - protein, 676 aa, Drosophila grimshawi
MLSKSIIPSTVNADLQKERDGASFNSEEFAAWWAGGPEQLKFKRSVKEYMYKDINLDERANFHYLSHEDICEFAMKSSINVAKKLRQLQAERNPGGSEYWPTLYEEPELAGLHLAGNPFGVMCLMVVKALKAQCTAEQYEEFGKRLEQFEVCAAYAQTELGHGTYLRGLETRADFDRDTDEFVLNTPTISAYKWWPGGLGHSANYSLVMAQLYIDNQLKGPHLFYVQVREEETHEPRPGVHIGEIGKKMDFLGVNNGFLGMKDVRIPRNRLLMRHVQVHRDGTYVKSPVDVLTYFAMVSSRCLIARIAYVALAVTATIATRYSAVRRQSPIDPKLPEVQIIDHVTQQLKVFPEIATSMAHRLCFDYLWDLFNVTSKDIDQGRYERLPELHALSCALKVLSSTDATRGTERLRLACGGHGYLTSSNLGNIYANISASSTYEGENTVLLLQIGRFLIKSWRAAQKGDPLPPTARYLAEVQRNPEFGAWTGSWENMTKAMQFAAANKTRLAFQSLSKRLDKGESEEVAASHTGIELTQAAELHGRAFIFHCFITEITGPKSKTRSPSLNRVLEQLLELYLVNVTLNNMSDILRVVSLTDGDLSKLQTRLETALTKLRPDAVAIVDGFDFIDGQLNSTLGSFDGNALERIFDAALKAPMNQKSVPKSFHEYLGPFMKSNL

SEQ ID NO: 2821 - protein, 676 aa, Drosophila grimshawi
MLSKSIIPSTVNADLQKEREGASFNSEEFAAWWAGGPEQLKFKRSVKEYMYKDINLDERANFHYLSHEDICEFAVKNSINVAKKLRQLQAERNPGGSEYWPTLYEEPDLAGLHLAGNPFGVMYVMVVKALKAQCTAEQYEEFGKRLEQFEVCAAYAQTELGHGTYLRGLETRADFDRDTDEFVLNTPTISAYKWWPGGLGHSANYSLVMAQLYIDNQLKGPHLFYVQVREEGTHEPRPGVHIGEIGKKMGFLGVNNGFLGMKDVRIPRNRLLMRHVQVHRDGTYVKSPVDVLTYFAMVSTRCIIARIAYVALAVTATIATRYSAVRRQSPIDPKLPEVQIIDHVTQQLKVFPEIATSMAHRLCFDYLWDLFNVTSKDIDQGRYERLPELHALSCALKVISSTDATRGTERLRLACGGHGYLTSSNLGNIYAHMSASCTYEGENTVLLLQIGRFLIKSWRAAQKGDPLPPTARYLAEVQRNPEFGAWTGSWENMTKAMQFAAANKTRLAFQSLSKRLDKGESEEVAASHTGIELTQAAELHGRAFIFHCFITEITGPKSKTRSPSLNRVLEQLLELYLVNMTLNNMSDILRVVSLTDGDLSKLQTRLETALTKLRPDAVAIVDGFDFIDGQLNSTLGSFDGNALERIFDAALKAPMNQKSVPKSFHEYLGPFMKSNL

SEQ ID NO: 2822 - protein, 676 aa, Novosphingobium pentaromativorans
MVLTLSNYAKDEWYQAGTGLAEIHSAVDDSIVAQTGTDGLDYAAILDHARKVGGSALRAMTFHERAQILKSLASAIMERKEELYALSTATGATRSDSWIDIEGGASTLFVMSSKGRRELPEDTILIDGDFEPIGRKGTFAGQHVYTTLQGAAIHINAFNFPVWGMLEKLGPTLLAGVPAIVKPAMQGSQLTEACVRILIESGVLPEGALQLIVGGVGDLFDHLTAQDVVSFTGSAATAGKLKNHPVIQANSVRFIAEQDSLNASILAPDATPDSPEFDLFVKEVVREMTTKAGQKCTAIRRTFVPETLLGAAEEALKARLAKVVVGDPAAEGVTMGALASMKQLEDVRAKAREIATEAELVFGDIDLVDAVGVEPGTGAFISPLLFRADKPWDAQRIHDVEAFGPVSTLMPYKDIEDAIALANRGLGSLALSIFTYDPATARQFVAGVGAWHGRIVFIDRDSARESTGHGSPLPMLIHGGPGRAGGGEEMGGVRGVKHYMQRSAIQGHPRTLSGIVRQWLPGAPQPTGEVHPFRMAFGELDIGYTFNTDSRTITLDDIQHFAEFTGDTFYAHMDEEAAAANPFFPGRVAHGYLILSFAAGLFVEPSPGPVLANYGLESLRFLEPVTPGTAIKVALTVKSKKMRKAREYGEVVWAVTVTNQDDATVATYNLLTMNEV

SEQ ID NO: 2823 - protein, 683 aa, Owenweeksia hongkongensis; identical to SEQ ID NO: 2764

SEQ ID NO: 2824 - protein, 679 aa, Gordonia polyisoprenivorans; identical to SEQ ID NO: 2819

SEQ ID NO: 2825 - protein, 693 aa, Corynebacterium casei
MTTSLIDTIVPSFLSGKWLTPDNPTRITEVTDPSTGEIVARVSAEGLDIAAAVNYARDIGRKNLQELTIHERSLKVKELAMYLQEHRDELNALAHKTGANKRDNFVDVDGGISTMFTISSKGRREMPNSHVVTDGEPEVFSKDGSFIGRHIYTTIPGIAVQINAFNFPVWGMLEKFAPSFIAGVPSIVKPATPTGFVTQACVRLMLESGILPEGSLQFISGSARDLLDHLDFRDHVAFTGSAQTANALRAHENVLEGGIQFSAEADSLNAAILGTDVTEDAPEFEAYTKAVFNEMTSKAGQKCTAIRRAIVPNELVEPFIAALSQRLESKVVPGDPRDENATMGPLVSLEQRDDVASAVHKLIDAGGEVVYGGADKLEGAFFAPTILRFDDAKAEAVHSTEAFGPVISVIGYDEPTDAVQLAAKGSGSLVASVITHDDELAALYGRGIAAYHGRVHFLDRVDAKTSTGHGSPLPHLVHGGPGRAGGGEELGGIRGILHYMQRTAIQGSPDHLTAVTGQWHRGAAVNRVTREDVINSTGVHPFRKDLATLKIGDQFASDLRKVTLEEILAFAKDTGDTFYAHTDEEAAMANPFFPRRVAHGYLLVSWAAGLFVEPAPGPVLANYGLENLRFIEPVTYDDSVRIELTAKRITPRVTDDYGEVCWDAALYNQDDVLVASYDVLTLVEKEDTIYAQK

SEQ ID NO: 2826 - protein, 402 aa, Corynebacterium casei
MPPIINLEDMTQHSFHDIPFPHADILGVADQLNVEEAERLQKLHEFLQTEIRPAVGEYWDREEFPFELLPRLAEFGLGEIALSGTSRLYRGLAYAEVTRADVSISALVGIHNELVVALIDALASDAQREKWLEGLRSFEKLGCFALTEPDHGSDIAGGLATTAQRTKDGWVINGEKRWIGGGTFADFAICFARDTEDNAVKGFIVEMDRDGVSAEKISRKMGLRIMQNANIHFEDVVIPHDNLIPGAESFANTNDFLCSSRAWVAWQGAGLQLGIFDKAREYAVSRDQFGRPIAKFQLIQEALSRILGNATVSLSMMAQIARKQEAGELEMPHAALAKATTTRLARESAAAGRNIGGGNGILTDYELSKMMNDAEILYTYEGTYEINSLIVGRAITGVSAFV

SEQ ID NO: 2827 - protein, 701 aa, Mixia osmundae
MSSSWMQPGKTSAIPPHIELPNSLKETIGSSGGKLLASERAKASFSSNDLSVYLYGQAHIDRLNRILAVIESEEAFDKTRIPYMSRGEKFRHALRKEKRLVQIVKDLNWSKEDEDMAEVLIDMPGPYGLHKSMFIKTLTEQGTDEQHELFLKPALDYKILGCYAQTEMRHGSNVAGLETTATFDNETKEFIINTPSLASAKYWIGSLGRTADHAVVMAQLYSNGEHRGIHPFVVPIRDMKTRQPFEGVTIGDIGPKAGYNSMDNGFMIFQNHRVPFVSLLSKFSAVNGDTGDYKKPANSRLAYQTMVYIRVGIVKQAYQALTRAATISVRYCSIRRQFVDRDASGSDEFTRKPSENQVLDYRTVQYRLFPVIATAFAFHYTAEAMLRLYEDNQARMKQGDFSLLADTHAASSGLKSICTLTAGNAIEECRRACGGHGFSLAGGLASQYADYLPQLTWEGDSWLLPQQTARYLFKTFRQIWEDRDVEMPPTNEAAIYIKHYLSHVDAKAPIRFSGDFRNLQMWISAFGHRAAYQIGITVRKRDVERRSWNAILVDINRCSVAHSQYLLVKNFADAIAHDEKLQSNPALHAIMTTCFELYACYTMETYAADFMSSGYINPEQLNLLRNEVDLLLGAIRPQAVPLVDSFNVPDYLLASALGRSDGEVYPSLFAFALQEPLNSVTTNPDYTSPELVFGEPPLAKL

SEQ ID NO: 2828 - protein, 718 aa, Mixia osmundae
MAAASTPSSTVAHAPDSIGPKAQPHDVNEQTAIDMKRFRARCTFDIAKMHNMIDEGSRDTEMRQKVHDIIANDALITEAKRTRPFLSRADRLYTGQALMKRLFDLVDEHDLDYMEFLECLFLVDEQTSYYLHHVAFLPVINAQGSDEQQAEWMAKAQNHAWLGCYLQTELGHGSNVRRLETTATFCKDTDEFEIHSPSLTATKWWIGGLGVVSTHGVVQAQLIIDGTNHGPHLFLVQLRDIQNHKLLPGIIAGEIGPKAHGGFAALDNGYARFNHVRIPRFNMLARFSQVTREGNFIKPPSDKLSFGGMVFIRAQMISAVSMSLTKATTIATRYLHVRRQFADPEAKGERAEEELNVIFYPSVYMRLLPLIAKSYVFGAMGKDMAELYGTMASQLASGNTEMLAEVHAVSSGLKSYVTAEVVEGIEIARRSLGGHGFMESAGVARIYSKELPSVTYEGDNYVLAQQTCRGGLKTYRGLLKDASKRKLLTASTDYLAHLADKKQIKLPHSIEEWRNLQVQTDLLDARAAFHVKRLEILMRSKAEGGQGKTMGQLSWQCQMISKAIVESFIGRRVAAALAPEGLLVNGLDDAGVKVIKNLMNFYLLNTIDGALSELLEFGVIPAHSTDSGAMQSPIETLRLAIANAAQEVLPETIGLTDAFGFSDWDLNSALGRYDGRCYEDLLHRAESQAELNLGGKIKDIFEKSIKPVLERGDRLAKL

SEQ ID NO: 2829 - protein, 797 aa, Mixia osmundae
MSCRTDLASVASSSQQPVTFEGGGSIESLASLDRRASDQRPALDDRQEQITRIGGHSKMASSENATKQQPMEDKGPGAPANKTPPTPSETIAMEREFCPFDLRRMTYALHGGQKATELKEKFMIELERDPAFKLDDIHDLTKDQLRERTMAKFANMVHYVTTETIDVFTQRMELIGIADPGFWTRFGVHYGLFLGAIRSGATANQFSYWMEKGLLGLNGLIGCFAMTELAHGSNVAGLETTATLDTRTDEWVIHTPSLSATKWWIGGAASTATHSSVFAQMVIDGKRYGTKTFIVPLRDPKTFALLPGILIGDIGKKMGRDGIDNGYIQFTNVRIPRAYMLMKHTQVTREGHVQEPPLAQLTYGALLQGRTAMVADAASVSKKALTIGIRYAAVRRQFKTGDSEFETQVLSYPIHQRRLIPLVAQAIAMGFTSLRMTALFEEMTQTLESLDPNSDEAHMQDVLEKLKETHATSAGLKAFCTWNGLETIDKCRQSCGGHGYSAYNGLAGMYADQAVQCTWEGDNTILSLQAGRSLIASYIEARQGDKKMASGVAYLNNLEHVLTDKCPSDKDVVSLDTLDKAWATIAANTVKRAAEAYEGWTKKGKGRDLAFELCSQERFVAAKVHTTGYIFRQFVDALRELKKVEDPKSGVVEHLEKVALLYGLFQAEEQGIFFLKYKFYTPEQMDIISNKISGLCNELRKSIVSLVDAFNFSDFIVNSPFGRYDGDVYTSYFRQVRAANPPQPVHPYFERLIKPLLERKEADYEDFDEIGLDEEIDEIREEREEAEAGAAAEEDDD

SEQ ID NO: 2830 - protein, 678 aa, Sphingomonas sp.
MDMRIRGLQAFAQNHWRSRAGNPAPVRSATTGDVIAEIGSDALDYGEMLEYARNIGGPALRGMTFHERALMLKGLGQAIMARKEELYELAFSTGGTRADNWIDIEGGAGTFFAYAGKGRRELPNGHILIDGDTEILGKTGTFVGQHVYTPLQGAALHINAFNFPVWGMLEKLAPALLAGVPAIVKPASATAYVAEAAMRILVDSGLLPAGAVQFIPGAIGDLFDHLTGQDIVAFTGSAATAAALQQHPVIAREAVRFTAERDSLNASILGPDAAPDRPEFDLFVREVAKEMTVKAGQKCTAIRRAMVPAHLLDAVQAALVARLATVKVGDPRREDVRMGALASREQRIDVRAKIAEISRVAPIVFGDPDHVDTMGDGLQGGAFIGPILMRSEDPWSADAIHDVEAFGPVATLLPYRDLDDAIALANRGRGSLVLSIFTHDSSVARDMMLGAAPLHGRMVIIDRDCARESTGHGSPLPALVHGGPGRAGGGEELGGIRGVKHYMQRTALQGSPAMLSRMVGEQLPGAPTMDGDRHPFRLRFGELVPGYSLRTGARTVTLEDIEHFAHFTGDTFYAHMDEEAAKASPIFGGRVAHGYLILSFAAGLFVDPAPGPVLANYGLENLRFVKPLKPGESMKAMITVRSKSMRTPEMGEVRWIVRVTNQDDDLVATYDLLTMNEV

SEQ ID NO: 2831 - protein, 676 aa, Novosphingobium pentaromativorans; identical to SEQ ID NO: 2822

SEQ ID NO: 2832 - protein, 675 aa, Amycolatopsis mediterranei; identical to SEQ ID NO: 2676

SEQ ID NO: 2833 - protein, 454 aa, Zunongwangia profunda
MSFFKKVRNTVNLLKSVDMDQLAKINQQIDLSEAMKTLGKLDERQLAGLMKMLKTKRHKSQSDLPPIDGDFYNLDYKLTKEQRELQMKVRHLMEDEIRPLVNDHWNRAKFPFEIIEKFKKLNIAGIPYEGYGCPNLPFLMEGIIAQEIARVDVSTSTFFGVHSGLAMGSIYLCGSEEQKQKWLPQMQKLEKIGAFGLTEPNVGSGVAGGLETTCKFDGENWILNGQKKWIGNATFADVTIIWARDEDSNQVKGFLVEKDNPGFKAEKMEDKMALRIVQNAIITLTDCKVAESDRLQNANSFKDTANVLRMTRAGVAWQAVGCARGAYESALKYTRKREQFGRPIASYQLVQNHLVEMVSNLTAMQTLCFRLSEMQDQDMLTDEHASLAKVYCSMRMRDVVSRAREVMGGNGILLEHDVARFVADAEAIYSYEGTKEINSLIVGRAITGYSAFVS

SEQ ID NO: 2834 - protein, 665 aa, Zea mays
MAEVDHLAAERATARFDVEEMKVAWAGSRHAVHVADRMARLVASDPVFRKDNRTMLSRKELFKDTLRKAAHAWKRIVELRLTEEEADLLRQYVDQPGYVDLHWGMFVPAIKGQGTEEQQHKWLPLAYKFQIIGCYAQTELGHGSNVQGLETTATFDPKTDEFVIHSPTLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTREGKYVHSNVPKQLLYGTMVYVRQSIVADASKALSRAVCIAVRYSAVRKQFGSQDGGPETQVLNYKTQQSRLFPLLASAYAFRFVGDWLNWLYTDVTQKLEAKDFSTLQEAHACTAGLKAVTTSVTADAIEECRKLCGGHGYLNSSGLPELFAVYVPACTYEGDNVVLLLQVARILMKTVSQLASGKQPVGTMAYMGKVQYLMQCKSAVSSAEDWLNPDAIQEAFEARALRMAVNCAQNISQAASQEEGFYERSPDLLEAAVAHIQLIIVTKFIEKVHQEIPGHGVKEQLQALCNVYALYILHKHLGDFLATGCITPRQGALANEQLGKLYAQVRPNAVALVDAFNYTDHYLGSVLGRYDGDVYPALYEEAWKDPLNETVVPEGYHEYLRPLIKQQQLKLSRL

SEQ ID NO: 2835 - protein, 676 aa, Roseobacter sp.
MTLLEVSSFAAGEWVAPGSGARSIASAITGAPLAQAGNDALDVQAMLSFARDKGGPALRALTFHDRARMLKALAAHLNSHKQSLYDISFDTGATQSDHMIDIDGGIGTMFVFASKGRREMPDGHVYLDGDVEQLSRNGSFLGQHICTPLQGVAVHINAFNFPVWGMLEKLAPTLLAGVPAIVKPATATCYVTELAVRLMLESGILPEGALQLVSGGLGDMLDHLTMQDVVSFTGSAHTALKLRQTPAILENSVRFVAEQDSLNASILGPDAVSGTPEFDLFIKEVSREMTTKAGQKCTAVRRIITPESQTEAVIEALSARLAKVQIGDPRLESTRMGALVSASQKRDVLEKAAILAGEATRVFGNPEGFAVEGADAEKGAFVPPMLFHCETPDSAQRVHDTEAFGPVSTVMSYRDLDHAITLANRGEGSLVASVITHDAEVARAVALGSGAFHGRLYFNNRDSMKESTGHGSPLPHMVHGGPGRAGGGEELGGVRGVKHYMQRTAIQGSPEILSAIGEKWVPGGKEVASPAHPFSRKFGELSIGETLHTDPRTVTLQDIETFAHFTGDTFYAHMDDEAAKRNPFFPGRVAHGYLLLSFAAGLFVQPDEGPVLANTGLDSLRFMKPVEAGDSIKVRLTVKKKTPRNEEYGEVRWHVTLTNQEDEMVAEYELLTMNAF

SEQ ID NO: 2836 - protein, 846 aa, Flavobacteria bacterium
MILESYINGQWQAGEEKSTRNMYDAITGDIIGLTSTEGLDIASALQYGRDHGKVLRDMTFQQRGNMIKKLALYLNKRKKAFYDISYKTGATRADSWVDIEGGFGNLFANASLRKLFPDQSYAVEGDPIDLSRGGRFMAHHILVPRKGVAVHINAFNFPVWGMLEKCAVNWMAGMPAVVLPAPQTAFLTEAVVREIINSGILPEGSLQLLSGLTTSILDTVNSQDVVTFTGSAHTGRKLKAHPRLLEESVPFTMEADSLNSSVLGPDAVPGTPEFDIFVKEVRKEMTSKAGQKCTAIRRILVPENLMEDVQIALGKQLSKTVIGDPLLRETRMGALINNDQRETTKSQISKIAQTAQIVYGNLDEVEILGDRAQKGAFMSPILMREDQPFKNTAAHEVECFGPVSTLMPYKNLDEAIELAHMGKGSLVSSVVTGDDAFAKAYTINAASSHGRILTLNRDSAPQSTGHGSPLPLLVHGGPGRAGGGEEMGGLRGIKHYMQRCAVQGSPTSLTEITGIYQPNGAYKKAEKHPFAYHYEDIKPGMSLETHKRTLTDNDIQNFANLTWDHFYAHTDITSLDGSIFKKRTAHGYFIISAAAGLFVYPNKGPVSANYGLEDIRFLRPLYHNDTIYVRLTCKEKRERDVAGREHPSGIVKWYVEVFDAEPVDYENGKTDEEATALVAVATILTMVEKKQTVFPEITESYIKSTFAKLEANAKPNWGTMTPQHMVEHLEMSYRIASGEIQDFEVATSNEYLEKVAATLWNYDKMPQNHKMPLMKQDGTLEDLIHEDLETAKTKMLEARNEYLDFYKKNPKATTKNAVFGPLSKYEWTLLERKHLSHHFEQFSISA

SEQ ID NO: 2837 - protein, 676 aa, Roseobacter sp.
MSLLDVSSFAAGEWIAPGAGARNIASAVTGAPLAQAGNDALDVQAMLSYARDVGGPALRALTFHDRARMLKALSAHLNEHKQALYDLSFDTGATQSDHMIDIDGGIGTMFVFASKGRREMPDAKVYLDGEVEQLSRNGTFLGQHICTPLQGVAVHINAFNFPVWGMLEKLAPTLLAGVPAIVKPATATCYVTELAVRLMLDSGILPAGALQLVSGGLGDMLDHLTMQDVVSFTGSAQTALKLRQNPVILEKSIRFVAEQDSLNASILGPDATPGTPEFDLFIKEVSREMTTKAGQKCTAVRRIITPISQTEAVIEALSARLAKTQIGDPRLESTRMGALVSNGQKRDVLEKAAILATEATRVYGDPEDFTVEGADAEKGAFVPPMLFHCENPDAARRVHDTEAFGPISTVMGYRDLDHAVALANRGEGSLVASCITNDAEVAREVALGSGAYHGRIYFNNRTSMKESTGHGSPLPHMVHGGPGRAGGGEELGGVRGVKHYMQRTAIQGSPDILAAIGEQWVPGGTEIAGPAHPFTRKYGALAIGETLNSPAREVTLEDIEHFAKFTGDTFYAHMDDAAAKRNPFFPGRVAHGYLLLSFAAGLFVEPNEGPVLANTGLDNLRFMKPVSAGDSIKVRLSVKKKTPRNEEYGEVRWHVTLTNQDDEKVAEYELLTMNAF

SEQ ID NO: 2838 - protein, 403 aa, Oceanicaulis sp.
MSDLSQASTAQAGADEVYVDKKRYFWILSVFWPATPLIGLYLVSVTGWSIWYGTVLILWYLAVPMLDAMFGEDFSNPPESAVPDLERDRYYRVLTYLTVPMHYAALIGSCWWVATHSLNALEFVALALSLGVVNGLALNTGHELGHKKEAFDRWMAKLVLAVVGYGHFFIEHNKGHHRDVATPKDPATSRMGENIYSFATREIPGAFKRAWELEEVRLERSGKSVWSLDNEILQPLIITVVLYAGLLAFFGPIMLVFLPIQMAYGWWQLTSANYIEHYGLLREKLPNGKYEHQKPHHSWNSNHIMSNLILFHLQRHSDHHAHPTRSYQSLRDFKDLPALPSGYPGMFFAALIPSWFRSIMDHRVLDWAKGDLNKIQIEPGMRDYYDRKFGSVAPAQPAAMPAE

SEQ ID NO: 2839 - protein, 674 aa, Sulfitobacter sp.
MRDIQSFAAGQWINPGAGARNIASAITGDVIAQAGNDALQVQTMLAYARDIGGPALRKLTFHDRARMLKAVALYLNDHKQSLYELSFDTGGTQADHMIDVDGGIGTMQVYAAKGRREMPDDQVYLDGPVEQLGRAGQFMGRHICTPLQGVAVHINAFNFPVWGMLEKLAPTLLAGVPAIVKPATATCQVTEACFRLMIQSGILPDGAIQLVTGGLGDMLDHLDCQDVVSFTGSAETALKLRSNPVLVERSVRFASEQDSLNASVLGSDAGPGTPEFDLFVKEVQREMTAKAGQKCTAIRRIMVPQPHVDALIATLSDRLTKVTIGDPRLEGTKMGALVSQSQRRDVLEKAALIGTEAARVFGDPDAFAVEGADAQKGAFVPPMLFHCADPDAATHVHDTEAFGPVSTIMPYRDTDHAIALLNKGKGSLVASIITRDGETARDMVMGAGAFHGRLYFNNRDSMAEATGHGAPLPHMVHGGPGRAGGGEELGGVRGVMHYMQRTAIQGSPDILTAMGKQWVPGATEISDRDHPFTRRFGALDLGETFNSASRTVSLEDIETFAHFTGDTFYAHMDDAAAKANPFFPGRVAHGYLLLSFAAGLFVQPDPGPVLANTGLDNLRFMAPVQAGDSIKVRLSVKAKTPRNDEYGEVRWHVTLTNQDDAAVAEYELLTMNAY

SEQ ID NO: 2840 - protein, 674 aa, Sulfitobacter sp.
MRDIQSFAAGQWINPGAGARNIASAITGDVIAQAGNDALQVQTMLAYARDVGGPALRKLTFHDRARMLKAVALYLNDHKQSLYELSFDTGGTQADHMIDVDGGIGTMQVYAAKGRREMPDDQVYLDGPVEQLGRAGQFMGRHICTPLQGVAVHINAFNFPVWGMLEKLAPTLLAGVPAIVKPATATCQVTEACFRLMIQSGILPDGAIQLVTGGLGDMLDHLDCQDVVSFTGSAETALKLRSNPVLVERSVRFASEQDSLNASVLGSDAGPGTPEFDLFVKEVQREMTAKAGQKCTAIRRIMVPQSHVDALIAALSDRLAKVAIGDPRLEGTKMGALVSQSQRRDVLEKAALIGSEATRVFGDPDAFAVEGADAQKGAFVPPMLFHCADPDAATHVHDTEAFGPVSTIMPYRDTDHAIALLNKGKGSLVASIITRDGETARNMVMGAGAFHGRLYFNNRDSMAEATGHGAPLPHMVHGGPGRAGGGEELGGVRGVMHYMQRTAIQGSPDILTAIGKQWVPGATEISDRDHPFTRRFDALDLGETFNSASRTVSLEDIETFAHFTGDTFYAHMDDAAAKANPFFPGRVAHGYLLLSFAAGLFVQPDPGPVLANTGLDSLRFMAPVQAGDSIKVRLSVKAKTPRNDEYGEVRWHVTLTNQDDAAVAEYELLTMNAY

SEQ ID NO: 2841 - protein, 720 aa, Corynebacterium nuruki
MTATAPGHTAQHADQTDVTILASYIADRWTTPDPTAPGATVTDITDASTGEVTAQTISGSPAATGFTTAAAVDHARTVGHRSLAAMTTHERALILKNLALFLNDHRDELYDLSYATGTTSRDNLIDIDGGIGTLFAFSSKGRREMPNANVIPDGPVEVLSRDGSFVARHIRTAIPGVAAQINAFNFPVWGMLEKFAPAFVAGVPSIVKPATQTAPVAVACVRLMTESGLLPAGSLQIIAGAGRDLIDQLDERDHLAFTGSADTARGLRGSDAVQVEGLRFSAEADSLNAALLAPDAAPGTPEFDAYIRILFTELTAKAGQKCTAVRRAIVPASHVEDVVAALTAKITDKVTVGDPRTDGTTMGPLVSKNQQRDVAAAVQTLVDAGATVRLGGGPLDDTEHSAGAFFAPTVLTVDDPRTPAVHDTEAFGPVVTVLGYDGIDEAIELANLGRGSLVASLVTHDTDTASRVATGIAALHGRLHLVDRDDAKTSTGHGSPLPTLVHGGPGRAGGGEELGGVRGIHHYMQRTAVQGSPDLLTAVTGEWVRGAATRTVTRADVEAGTGVHPFRKSLAELRIGDQLVSEPREITLEEIQAFADSTGDTFYAHTDEEAATANPFFPRRVAHGYLLVSWAAGLFVEPAPGPVLANYGLENLRFITPATYGDTIRVTLTAKRITPRVTDDYGEVCWDALITNQNDETVASYDVLTLVEKENTTYANWGDR

SEQ ID NO: 2842 - protein, 667 aa, Zea mays
MDASAEVDHLAAERSAARFDVEAMKVAWAGSRHAVEVGDRMARLVASDPVFRKDNRTMLSRKDLFKDTLRKAAHAWKRIVELRLTEEEAGMLRLYVDQPGYVDLHWGMFVPAIKGQGTEEQQKKWLPMAYKFQIIGCYAQTELGHGSNVQGLETTATFDPKTDEFVIHSPTLTSSKWWPGGLGKASTHAVVYARLITEGKDYGIHGFIVQLRSLEDHSPLPGITLGDIGGKFGSGAYNSMDNGVLRFDHVRIPRDQMLMRLSQVTREGKYVHSDVPKQLLYGTMVFVRQTIVADASKALSRAVCIAVRYSAIRKQFGSQDGGPETKVLDYKTQQSRLFPLLASAYAFRFVGDWLKWLYMDVTQKLEAKDYSTLQEAHACTAGLKAVTTSATADAIEECRKLCGGHGYLNSSGLPELFAVYVPACTYEGDNIVLLLQVARILMKTLSQLTSGKQPVGTMAYMGNVQYLMQCKCAVNTAEDWLNPVAIQEAFEARALRMAVNCAQNIGQAANQEEGFYERSPDLLEAAVAHIQLVIVTKFISKVQQDIPGPGVKEQLQNLCNVYALYILHKHLGDFLATGCITPKQGALANEQLGKLYAQVRPNAVALVDAFNYTDHYLGSVLGRYDGNVYPALYEEAWKDPLNETVVPEGYHEYLRPLLKQQLKLSRL

SEQ ID NO: 2843 - protein, 405 aa, Streptococcus parauberis
MVKESRADKLFNEGEMYFSDLYNFADGLAAGEKEVLKELEEVLKNDLKPVLAENWHNATFPLEQFKKVIDLHLMDDPRLLEGREDGRISELFRGFRAYTLAKTDPVLGTFYTANGGLFHECVRIGGSQEQIDKLMPGVYSWEGLGVLAMTEPEHGSDIAGGMAATAKRDGDYWILNGHKKWIGAGTLAKWHAFFARDVDDNQVKLFYVERESEGVETFVTPEKAFFRSMPNAEIIYKDVRVHESQRAQNVNSWKDCASILRNTRSDVAWLLAGATAGAFEAALAYTRERLQFGKPIASFQLIQEKLARMAMNAQATLAIAVRLAEQQEQGIYREEASSMAKLHNGFRARETAALAREVGGGNGILLKYDIPRFFADIEGMYTYEGTHEVNSLIIGRHYTGISAFI

SEQ ID NO: 2844 - protein, 401 aa, Streptococcus parauberis
MSTKQEMLKALYPEDVMGFAQELTEGEIKKLTQIRELLETKYRPLVNNCWMKAEVPEDFFKDMGKMNYLNDPLLFEGRDGAKRRSEMYFAFMCYELSRFDISMNTFVGVHIGLGHNTFLFGGSEEQVKYYIPKLQSHELMTCFALTEPEHGSDVAGGLTTTAKYDGENWILNGEKRWIGGGAMADVVPVFARDVDTDQVKCFIVEKGQEGFTADVIENKIALRIVPNANLHLKDVKVPESKRLQNINGFKDVAKILYSTRAGVAAMAAGGMGGALQATLKYVTQRKQFGKEISNYQLVQEKLAMMQANTMSGLAYSTQLARMQESGQYSEIATSMAKMFNALRLRETVAMGRGICGGNGITVDYDIARFFCDAEAIYTYEGTHEINALVIGRALTGKQAFI

SEQ ID NO: 2845 - protein, 681 aa, Macaca fascicularis
MGSPVHRVSLGDTWSRQMHPDMESERYMQSFDVERLTNILDGGAQNTALRRKVESIIHSYPEFSRKDNYFMTQNERYKAAMRRAFHIRLIAQRLGWLEDGRELGYAYRALSGDVALNIHRVFLKALRSLGSEEQIAKWDPLCKNIQIIATYAQTELGHGTYLQGLETEATYDAATQEFVIHSPTLTATKWWPGDLGRSATHALVQAQLVCSGARRGMHAFIVPIRSLRDHTPLPGIIIGDIGPKMDFDQMDNGFLRLNHVRVPRENMLSRFAQVLPDGTYIKLGTAQSNYLPMVVVRVELLLGEVLPTLQKACVIATRYSVIRRQSQLRPSDPEAKVLDYQTQQQKLFPQLAISYAFHFLAVSLLEFFQHAYTAILNRDFSLLPELHALSTGMKAMMSEFCTQGAEMCRRACGGHGYSKLSGLPSLVTKLSASCTYEGENTVLYLQVARFLVKSYLQTQMSPGSTPQRSLPPSVAYLATPDLARCPAQRAADFLCPELYTTAWAHVAARLIKDSVHHLQTLTQSGADQHEAWNQTTVIHLQAAKAHCYYVTVKGFTEALEKLENESAIQQVLKRLCDLHAIHGILTNSGDFLHDAFLSGAQVDMARTAYLDLLRLIRKDAILLTDAFDFTDECLNSALGCYDGNVYERLFQWAQKSPTNTQENPAYEEYIRPLLQSWRSKL

SEQ ID NO: 2846 - protein, 681 aa, Macaca mulatta
MGSPVNRVSLGDTWSRQMHPDMESERYMQSFDVERLTNILDGGAQNTALRRKVESIIHSYPEFSRKDNYFMTQNERYKAAMRRAFHIRLIAQRLGWLEDGRELGYAYRALSGDVALNIHRVFLKALRSLGSEEQIAKWDPLCKNIQIIATYAQTELGHGTYLQGLETEATYDAATQEFVIHSPTLTATKWWPGDLGRSATHALVQAQLVCSGARRGMHAFIVPIRSLRDHTPLPGIIVGDIGPKMDFDQMDNGFLRLNHVRVPRENMLSRFAQVLPDGTYIKLGTAQSNYLPMVVVRVELLLGEVLPTLQKACVIATRYSVIRRQSQLRPSDPEAKVLDYQTQQQKLFPQLAISYAFHFLAVSLLEFFQHAYTAILNRDFSLLPELHALSTGMKAMMSEFCTQGAEMCRRACGGHGYSKLSGLPSLVTKLSASCTYEGENTVLYLQVARFLVKSYLQTQMSPGSTPQRSLPPSVAYLATPDLARCPAQRAADFLCPELYTTAWAHVAARLIKDSVHHLQTLTQSGADQHEAWNQTTVIHLQAAKAHCYYVTVKGFTEALQKLENESAIQQVLKRLCDLHAIHGILTNSGDFLHDAFLSGAQVDMARTAYLDLLRLIRKDAILLTDAFDFTDECLNSALGCYDGNVYERLFQWAQKSPTNTQENPAYEEYIRPLLQSWRSKL

SEQ ID NO: 2847 - protein, 706 aa, Anopheles gambiae
KCSISSTKNNTHNMPVDEERTVIPDVPRGPLCDYRSKAQFNWKDFRLVLEDKELVKIKYDIWRRLEREPLFAPVTSTLSVDQQKERAARQVNRIADLELAPPEIYSKPYKYRVRYLMSINEALHAVCPSLSVKIALGVGLFTNSLLAMGTDRHQEIYNQAWNREIITCLAITEVSHGSNTKRCRTTATYDPATQEFIIHTPDFEAAKCWVGNLGKTASMALLFAILYTADGENHGLQGFLVPIRDPKTLLPYPGVTVGDIGEKIGLNGIDNGFVMFNHYRIPRENLLNRTGDVTPEGVYESTFSEPGKILGAVLESFSAGRLGIMQESSNTLSHAAVIAVRYAALRKQFGTDRNGPEQSIIEYQLHQWRIFPYLAAACVLKVSVFAMTEIYLETVQKSQAESNGFELLTQIVSEIHALVSSSKPLVTWTARDAIQESREACGGHGYLRAANLGELRNNHDPSCTYEGDNNVLGQQASNWLIRQWKNAKVESPVGTASFITRRDAILSGDYDALLRTGVRLESTECNQCYEWLMCWLLKQSVAQMEEASKAGVDTFTARNNCQVYRARDLSRAYAEYYALESFRSRCARADVNADLKPVLFRVYLIYGMWCLDRHMTTFYAGSFAKGSAFADAVRGTLLRMCGELKDSAVAIADALAPPDWVLNSVIAKSDGRLYENIQSVFMTNPGALERASWWKDVIPSKLRAKL

SEQ ID NO: 2848 - protein, 420 aa, Rhodococcus opacus
MAQRLPGWRGGGDHDLPPGPRSKPMSPNPNTDTSDFYAFEQMLSDSERALLHSVHDFMTTEVDPIINTHWNAGTFPFEIVPGLRKLGIAGVPYQGFGCAGRSYLLDGMIAMELARTDSSIATFNGVHGGLAMGSIYLCGSDEQRERFLPSMAQYEKIGSFGLTEPDVGSGASGGLTTTAERDGDTWTLNGQKKWIGNATFGDLTVIWAKDVADGQVKGFVVENSSPGFTADKQERKIALRIVQNALIKLDNVQVPERNRLRGANTFKDTAEVLRLTRAGVAWMAVGCARGAYENALKYACAREQFGRPIGGFQLVQDLLVRMLGNITSSLALCARLSQLQDQGDAEDRHSSLAKAFCTVRMRETVGWARELMGGNGILLEHNVGRFVADADAEAIYSYEGTREMNTLIVGRSLTGHSAFV

SEQ ID NO: 2849 - protein, 679 aa, Rhodococcus opacus
MSKLLESYAAGRWHTAPDEGTPLLSAVDGSEVARISATGLDLGEMVTYAREVGGPALAKLTFHERAAALKALALTLMAGKDEFYALSTSTGATKRDSGVDIDGGFGTLLSYASKARRELPNDTVYLDGAFEQLGKKGTFLGQHVYTSRRGVAVQINAFNFPVWGFLEKLAPAFIAGVPSIVKPASQSAYLTELVFRRIIESGLLPEGSVQLLSGSARGLLDHLGGQDSVAFTGSADTAATLRAHPNVVGEGVHFNAEADSLNASILGSDVEPGSEEFDLYVKQLVTEMTVKAGQKCTAIRRAFVPTALMDDVIAAAEARLSRVVVGAPDAEGVTMGALASLEQRDEVLKSLRGLTKTAQIVVGDPENFEVVGADKATGAFLPPILLRSDDKDATEPHDIEAFGPVSTVIGYDSTDEVIELAARGKGSLVASLVTRDSALARDIVLGLAPFHGRVLVLNRDDAKESTGHGSPLPVLVHGGPGRAGGGEELGGIRGILHHMQRTAVQATPDILTAVGNKWVTGSQRNDDGIHPFRKNLAQLRIGDTIVGGPRQVTLADINHFAEFTGDTFYAHTDPEAAAANPLFGGIVAHGYLVVSLAAGLFVEPNPGPVLANFGVDNLRFLTPVKADDSLTVTLTAKLITPRSSADYGEVRWDAVVVNQDGDPVATYDVLTLVAKGENA

SEQ ID NO: 2850 - protein, 402 aa, Corynebacterium casei; identical to SEQ ID NO: 2826

SEQ ID NO: 2851 - protein, 693 aa, Corynebacterium casei; identical to SEQ ID NO: 2825

SEQ ID NO: 2852 - protein, 402 aa, Streptococcus intermedius
MATKEEILRELYPEDLFHYADGLTLGEAEVLQETRRLIEKHLRPVINEHWEKPDFPFEQFYTVAKGAQIMNNPKLFEGREGSYKPSELYIAFLYLELARFDTSMATFYTVHGGLCYNTILLGGDERQQKEFLPKLAAFDWQGCFALTEPLSGSDIAGGLATTAERVGDKWILNGEKRWIGGSDTADVIPVFARDVADGKVKCFIVRKGAPGYDVEVIQHKIALRCVRNGHITMTNVEVPDSDRLVNINGFADVARILTFTRADVAHIAMGITCGSFNAALKYATNRQQFKRPIAKFQIIQEKLARMQANAVAAIAYSVRIAEMQEAGNELMLNSALAKMHNSLVMRETVALARETCGGDGITLETDVARFFADAEAVYTYEGSHEVNALIVGREITGLGAFV

SEQ ID NO: 2853 - protein, 422 aa, Amblyomma maculatum
MLLRSVTVRTLLRGAATRQTSSSRAASSGKRFDHRDAFLLEEQLTEDERLVRDTVRDYCQARLMPRVLLANRHERFDRDIIRELGQLGVLGSTLQGYGCAGTSYVAYGLTAREVERVDSGYRSTMSVQSSLVMLPIYLFGTEEQKQRYLPRLAQGELLGCFGLTEPNHGSNPGGMETRARHDPAARIYTLNGSKTWITNSPEADVFVVWAKCEEDGVIRAFVLEKGTRGLTAPRIEGKFSLRASATGMILMDDVIVPEDALLPSSHGLKAAFQCLTSARYGISWGALGAAEFCLETARQYTLDRQQFGRPLASNQLMQKKMADMVTEISLGLQACLRVGRLFDQGSMCPEMVSLIKRNSCGKALDIARTARDMLGGNGISDEYHIIRHVMNLEAVNTYEGTHDVHALILGRAITGIQAFSAD

SEQ ID NO: 2854 - protein, 681 aa, Homo sapiens; identical to SEQ ID NO: 342

SEQ ID NO: 2855 - protein, 681 aa, Homo sapiens; identical to SEQ ID NO: 342

SEQ ID NO: 2856 - protein, 681 aa, Homo sapiens; identical to SEQ ID NO: 342

SEQ ID NO: 2857 - protein, 674 aa, Ruegeria sp.
MSLHQISSFAAGTWVAPGEGARTIASAITGAPFASAGNTALDVQAMLDYARNTGGPALRKLTFHDRARMLKALAQELSAHKQALYDLSFETGATQKDHLIDIDGGIGTMFVFASKGRREMPDAQVYLDGDIEQLSRNGTFLGQHICTPLQGVAVHINAFNFPVWGMLEKLAPTLLAGVPAIVKPATNSCYVTELAVRIILDSGILPAGALQLVSGGLGDMLDHLSCQDVVSFTGSANTALKLRQTPAILQNSVRFVAEQDSLNASILGRDAEPGTPEFDLFVKEVSREMTTKAGQKCTAIRRIIAPDSQVDAVISALSERLAKITIGDPRAETTRMGALVSNGQKADVLEKANLIGQEAERVYGNPDAFDLHGPETGAFVPPMLFHCADPDKAQRVHDTEAFGPVSTLMGYRDLDHAVALANRGQGSLVTSLITHDTEVARDVVMGAAAYNGRIYINDRNSMAESTGHGSPLPHMVHGGPGRAGGGEEMGGVRGVKHYMQRTAIQGSPRMLSSIGTKWVTGSPEIQGPAHPFTRKFGELQVGETLHTASRVITLEDIEHFANFTGDTFYAHMDEEAAARNPFFPGRVAHGYLLLSFAAGLFVEPNEGPVLANTGLDGLRFMKPVVAGDSIKVRLTVKQKTPRNDDYGEVRWHVSLTNQDDEPVAEYELLTMNAR

SEQ ID NO: 2858 - protein, 667 aa, Unknown
  Description of Unknown: Acyl-coenzyme A polypeptide
MDAAAEVDHHAAERAAVRFDVEAMKVAWAGSRHAVEVGDRMARLVASDPVFRKDNRTMLSRKDLFKDTLRKAAHAWKRIVELRLTEEEAGMLRLYVDQPGYVDLHWGMFVPAIKGQGTEEQQKKWLPMAYKFQIIGCYAQTELGHGSNVQGLETTATFDPKTDEFVIHSPTLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTREGKYVNSDVPKQLLYGTMVFVRQTIVADASKALSRAVCIAVRYSAIRKQFGSQDGGPETKVLDYKTQQSRLFPLLASAYAFRFVGDWLKWLYMDVTQKLEAKDYSTLQETHACTAGLKAVTTSATADAIEECRKLCGGHGYLNSSGLPELFAVYVPACTYEGDNIVLLLQVARILMKTVSQLASGKQPVGTMAYMGNVQYLMQCKCAVNTAEDWLNPVAIQEAFEARALRMAVNCAQNIGQAASQEEGFSERSPDLLEAAVAHIQLIIVTKFIAKVQQDIPGHGVKEQLQNLCNVYALYILHKHLGDFLATGCITPKQGALANEQLGKLYAQVRPNAVALVDAFNYTDHYLGSVLGRYDGNVYPALYEEAWKDPLNETVVPEGYHEYLRPLLKQQLKLSRL

SEQ ID NO: 2859 - protein, 677 aa, Drosophila melanogaster; identical to SEQ ID NO: 509

SEQ ID NO: 2860 - protein, 643 aa, Hordeum vulgare; identical to SEQ ID NO: 599

SEQ ID NO: 2861 - protein, 677 aa, Drosophila melanogaster; identical to SEQ ID NO: 509

SEQ ID NO: 2862 - protein, 643 aa, Hordeum vulgare; identical to SEQ ID NO: 599

SEQ ID NO: 2863 - protein, 677 aa, Drosophila melanogaster; identical to SEQ ID NO: 509

SEQ ID NO: 2864 - protein, 643 aa, Hordeum vulgare; identical to SEQ ID NO: 599

SEQ ID NO: 2865 - protein, 711 aa, Candida parapsilosis
MSSTFTGKNVSSAKGPDPKTSLETERAAQKFNPQAMQYFLEGSKEKAELINELIQQMERDPVLFTDGSVYDMSKEQLREATAAKINRVSRYLETDPIHIFSTRLSLIGVFDPAVFTRIGVNLGLFLSCVRGNGTSSQMLYWSLSKNTAYVRGIYGCFGMTELAHGSFVQGIETTATFDKDNDEFIINTPHVGATKWWIGGAAHSATHCSVYARLKIDGKDYGVKTFVVPLRDANHDLMPGVSVGDIGAKMGRDGIDNGWIQFSSVRIPRFFMLQKYCKVSRDGEVTMPPMEQLSYSALLGGRVTMVLDSYRMLARVATIALRYAIGRRQFRGDNVDPNDPNALETQLLDYPLHQKRLIPYLAAAYVISAGALKIEKTIEDTMEELDEAVDEEDKERIDNAITLMKALYVDSGSLKPTCTWLAAQAIDECRQACGGHGYSAYNGFGKAYNDWVVQCTWEGDNNVLCMNVAKPVIRNVIAIEDEGKVIKGGSEFLNNLKDYTGSGANKVILENTNDLSDINKVIKALEVAIIRFASATAKTVRTQKFDYVGADLVTLSKLNSHLFLLKAFVDRVNTHDDDSLKPYLWDLGKVYAATIVLDRFANIFLAFNVASSEAMIDLSRDVIPKLCKQVRPNVVGLTDSFQMPDMFINAAIGRYDGDIYENYYDLVKKLNPPRNDKAPYSAALQAMLNRPSLDVRERFEKTDETAEILSK

SEQ ID NO: 2866 - protein, 711 aa, Candida parapsilosis
MSVPFTAKNVNLSKGPDPQTSIQTERAAQKFNPQAMQYFLEGSRERAEVIKALTQQMERDPILFTDGSFYDMNKNQLREMTAVKINRIARYMEVDSPDVYAQRLSLIGVFDPSVCTRIAVNLGLFANCIKGNGTADQIKYWTLDKHTNYLRGIYGCFGMTELAHGSNVMGLETTATFDKENDEFIINTPHVGATKWWIGGAAHSATHCTVYARLKVDGEDYGVKTFVVPLRDSNHDLMPGVTVGDIGAKMGRDGIDNGWIQFSSVRIPRFFMLQKFCKVSRDGEVVLPPLEQLSYSALLGGRVMMVLESYRMLARVSTIALRYAIGRRQFKGDNVDPNDENALETQLLDYPLHQKRLFPYLAAAYVISAGALKVEKTIEDTLAFLDKAVANNDQKAIMQSIGAMKSLFVDSGSLKPTCTWLAAEGIDQCRQACGGHGYSAYNGFGRAYNDWVVQCTWEGDNNVLCMNTGKPFVKNVIGLEDNGKAVKGGSEFLNQLKDYTGSGASKVILENANDITDLKKFIKSLEVAIIRLSSETAKTVRKENFDFVGAELVNISKLNAHRYVLSTYVDRVDAHDDASLKPYLYDLGRVYAATVVLDKFSGIFLTFNVASTNAITDLAKIVIPKLCKQIRPNVVGLTDSFQMSDMMINAAIGRYDGDIYENYFDLVKTLNPPRNDKAPYSAALEGMLNRPSLEERERFEKSAETAEILSK

SEQ ID NO: 2867 - protein, 664 aa, Glycine max; identical to SEQ ID NO: 93

SEQ ID NO: 2868 - protein, 664 aa, Glycine max; identical to SEQ ID NO: 93

SEQ ID NO: 2869 - protein, 664 aa, Glycine max; identical to SEQ ID NO: 93

SEQ ID NO: 2870 - protein, 686 aa, Geodermatophilus obscurus; identical to SEQ ID NO: 2736

SEQ ID NO: 2871 - protein, 694 aa, Aspergillus niger
MPSSPPDWVKALKPADPQGSQLLQHERDQSNVAVDKLAELLHTKEALVRQDRLLSILQAEKVFDKSQNHTQGRTERIQRSLAKAKRLQQLSVEHKWSQEELHAANELLGEPTPYGLHASMFLVTLREQGTPEQHKLFLEPAQNYQILGCYAQTELGHGSNVRGLETTATWNPEDKTFTIHSPTLTASKWWIGSLGRTANHAVVMAQLFIGGKNYGPHPFVVQIRDMNTHQPLENVYVGDIGPKFGYNTMDNGFLLFNHVKIPHVNMLARFSRINKDTNEYMRPASPSLIYGTLTWVRSNIVLQAGGVLARGVTIATRYCAVRRQFQDRDATGNVGENQVLNYKMVQVRLLPLLASMYALHFTGRGMMRLYQENQNRMKAAAQAAQEKRGAGPEELRAGADLLADLHATSCGLKALASTTAGEGLEVCRRACGGHGYSSYSGIGPWYSDYLPTLTWEGDNYMLTQQVARYLLKSARAVLAGKASNNDTSRILQAYLSRRDKGASFDILGNDSDIVAAFAWRTAHLTFEALKHRDVEKRSWNSLLVDFWRLSTAHSQYLVVKNFYEAVTSSHVTGALDPETTGILHKLFRLYALHTLEREASEFFSSSAVTVRQIGLTQNTAVMKLLDEIRPHAVRLVDSWKIPDWQLDSSLGKYDGEVYPDLFRRASQENPVNDLVFDPYPWNAAVLKNERPSKL

SEQ ID NO: 2872 - protein, 914 aa, Leptosphaeria maculans
MDRRRGLKTQRVYNVSTRAAGADLKLTVRTIRPFRPTIPQHSPKPIGRALVLGEFAKSAAFRLSYPLNQSSSQKKMSSPLAVAFFVFSLPSPVFMRTSSLRKIQMTQKNDVTNLHGSSDRGNCQCVTSTSRTRTWASGHLGPMHQAENPHPPPSTNTTTTINQHPPNMCSRLTQDDIWRCDGRRAVRYLGTSSSASTRLTTTNICSFFPSSIPITRTHSKMPRTPDWVKQLKPSGVQGHEMLKQERANSNVPSQELEVLLHTQGSIDRRNKITALLKSEKVFDKSQNYFMGRTDRFERALAREKRLRNLKKQHNWTYDEFRTATELVGEPGPYGLHDSMFMVTLEGQGTPEQQDRWLKPAREYKIIGCYAQTELGHGSNVRGLETTATWNADDKTFTLHSPHLTASKWWIGSLGRTANYAVVMAQLMIDGKSYGPTPFCVQIRDLKTHEPLENIHVGDIGPKFGYNTMDNGFLLFNKVKVPHISMLARYTHVDPKTNKFGRRGAPSLVYGTLTWVRSTIVMQAGSVLARGVTIATRYCAVRRQFQDRDAPAGEGETPVLNYTLVQIRILPLLAATFALHFTGKAMMEMYQENQKKIAQGAASNAPSSRGAGPEEVMPGSDMLADLHASSCALKSLSSTIAAEGLEVCRRACGGHGYSSFSGIGPWYSDYLPTTTWEGDNYMLSGQVARYLLKSARSVLKGDKPVNETTTILTEFHSRRDIGCAFDVIGSDEDLVAAFAWRVSFLTFEASKHRDEQKRAWNDLLVNFYKLSKAHAQYMIVKNNLDAIKAIQKDGKTDPAIHDVLLKLFRLFALHTLEQEASEFYVSGACSKHQISLARNTTVMQLLKEIRPHAVRLVDAWGFDDWVLDSSLGRKDGKVYEDMFYRASELNPLNDITVDPYPDNDVLFKRIEKSKL

SEQ ID NO: 2873 - protein, 705 aa, Phytophthora sojae
MSDKSSASAPARRLAALSRQLQPAPCAASTRDQTVAELAAERARCSFSPRAMADFLFGGEKQTALRLEAMRLLEGHAEFRNDAGVFDRSLAQRREHTLQRVRRLYTLFMEHGADVEKRETLADIVGVFDLSLWTRNGVHFGLFLGAIMGQGDQEQQDEWMLPTMMLELFGCYGMTELGHGSFTRGFETTATFDEETDEFVIHTRTDRATKWWIGGAGQTATHTVCFARLVLPKDGGADHGVQSFIVPLRDVETHEPLPGVSIGDMGSKMGLQGVDNGWIQFDHVRIPRANMLRRYAQVSRDGVFSQTQHKAQLAYAALLVNRGKIVTLSVGILEKALTIAVRYAAVRRQGLQVNSEDLHAETRLLDYQTHQYRLMPVLARAYAYRLQTRYITRLLQQFDTHGSDISEALLADIHGTMSGFKAFCTWDVQEGIDACRQSCGGNGYSKYTGLAELLADFSVMVTFEGDNTVMAQQTAHYLIRSVVKLRRGEKLAGSVQYLEREQASSRHRQWGVEGPADLRNSTLLRDALDVYTGRQVLQVAAKLAAAPGNTDAERINSCQVDLVEIARVHVFYNVATAFFQHIEELKLEVSEDNVKLVPVLEALCQLYICQELDRGAAFLLKEKFMTPYQSNLVRSRLMESCARVRADAVALVDAFMFSDTVLNSSVGRADGSIYEGALDAVRHRTGPTPYFASVIKPIFESEPLD

SEQ ID NO: 2874 - protein, 676 aa, Phytophthora sojae
MTSPLDAERRKSRVPARALAYVLHQSKSNVEKLEWLEQLLVQDPVFNHEKMNYLTRGEQYKRATQMAGRAEIIAHRNKLSEEDTALLHVVLQGFTSCPSSTALHTGMFFKNLGLLFTDEQQARWMDMAKQWRMIGCYAQTELGHGSNVRGLETTATYIPATDEFEIHSPTLTSMKWWPGALARTANFGVVYARLLLGGKDYGVHNFMVQLRDLETHDAMPGVTLGDIGPKIGFNNVDNGYCTFDHVRIPREQMGMRVATVTRDGKYVKNSGVPQEVLYFTMLQTRMSYIRSSGLALAKACTITIRYSAVRQQGYDANKPDSKEELSVLDYQTQQYRLFPLLAAAYAITLTGNQVDAFSLQLADQIKHGDLSMLLVGHAMSCGLKVLTSEMACGGIETCRRACGGHGYLLSSGLPVLLGDILQMVTAEGENFVICQQTARALLKVHGQFQSSGRLPAAMQFIANIGKPSRAQPRGKDQWLELDTYIDVFQQRFLYSLRGLVTKVASEPSVAAGIQNNSMHCYKLSNAYTYLVLVDNFVEAVRSSSTLTKERLSNPEIVPVLQMLCRLFALTQLEATAGEFMEGGCVFPSEMPIIRANIEELLALIRPHAVTLVDGFNFSDHTLNSTLGRYDGNVYEALYESAQHDPLNHSSDKVALHELLRPIRDEIARESGAKSRL

SEQ ID NO: 2875 - protein, 659 aa, Phytophthora sojae
MSVELKDLAPLLLKKERASGDVDPAVLTNMLRGGKTANDRRKQLVKVIEQHPVLSDRDMVYRNHSERYLFGLKKAFHYVKMVQDGSYTAEEQATLLNALGEQVPFDLHREMFIPTIESQGTDEQRAKWLPLASSYRIIGAYAQTELGHGSNVQGIETTATYDKSTQEFVIHSPTLTSRKWWPGGLGKTATHAIVIARLLPDGKDAGVQSFIVQIRSLDDHKPMPGIKVRDIGPKIGFNAVDNGDCSFHNVRIPRENMMMRYAKVLPDGTFVKPKSDKLVYLTMVRVRAVLIKKLGERLAMATTIATRFSAARIQGRKSDGKGEFQVLGYQNQQYALFPLIAISYASQFAGSVVLKMHDAALESIKSGDAGFGAMLAELHAVTSGLKAWVADKAIEGVETCRRLCGGHGFSQSSNLGHLFAEIAGANTFEGTSDVLVQQHAHYLLKTLASQLCSGASTQFLNDKKKFANVALRCKAQSSEDFGNFNVFLEAFRVRATRSLLSLAGIMKATKNDSNACMILMTKASTAHTEMILLEHFVRAVEKLHIGPEKQALSDLASLLGVWLITKSLGDFRQHDYLSSSQVNLVLKQLMRLLPIIRRNCVLLTDAWDFTDFELNSTIGQYDGGIYRALVKRVEDEPLNQHEVTIGYEEYLKPLIRSGL

SEQ ID NO: 2876 - protein, 661 aa, Phytophthora sojae
MTSQHTHFPANQFQIKIISYLKPQHQKQHIRSNTSQSNLLAHTHVKASLIMELKDLAPLLLKTERANGDIDPTVLTDVLRDGKAANDRRKQLVAMVERHPVLSDRDMMFRNHTQRYTFGLKKVAHFVQFLKDEQIVDRTEQNIMYGALGEPLCIDVHNSMFVPTLENQGDDAQRANRKWWPGGLGKTANHAIVHARLFLDGKDVGVQAFLVQLRSLEDHQPLPGIEVGDIGPKVGFNAIDNGYCAFHKVRVPRENMLMRYAKVLPDGTFVKPKSDKLVYLTMVHVRANLVESFALTMAKAAAITTRFSSARIQGRTPDNKGEFQVLDYQNQQHKLFPFIAISYAAKFAARDMMARHDEAVEIVKSGDAGFGAKLAALHAVSSGLKAWLAERVSDGVESCRRLCGGHGFTQSGNLAHLFNEIVGANTFEGTFDVLVQQHARYLLKALAGAKTLDASEPATRFLSKVKVLADLKLRFSGQTPEAFGDLNLLVEAFEVRAARILLALARQMKATNNNGNACMVLMSRVSTAHAELMLLEALVNGVSTIPAGPEQRAVVELCSLFGAWLITKSLGDFRQHDYLSSSQADLVREQVVRLLPSIRKNSVLLTDAWDFSDFELGSTIGRYDGDIYRALVNRAADEPLNKTQVPEGYEKYLKPLIQSDL

SEQ ID NO: 2877 - protein, 640 aa, Phytophthora sojae
MAMELKDLAPLLLKTERANGDIDPTVLTNILRGGKATNDRRKELLQVIERHPVLSDRDMMYRNHDERYNFGIKKAFNYIKLLQEGGYTDSADQQILYSAMGEPTAIEVHRSMFVPTLENQGDDAQRAKWLPLAKSYKILGAYAQTELGHGSNVQGIETVATYDKATQEFVIDSPTLTSRKWWPGGLGKTANHAIVHARLFLDGEDVGVQAFLVQLRSLEDHQPLPGIEVGDIGPKVGFQPIDNGYCAFHKVRVPRENMMMRYAKVLPDGTFVKPKSDKLVYLTMVQIRAYLIRSLGQGMGMATTITTRYSAARVQGRKAPGAAKGEFQVLDYQNQQHALFPYIAISYAGFFAGTGLIGMHDSALAIAWLANHVSDGIENCRRLCGGHGFTHSSNLGHLFAETVGACTYEGTFDVLVNQHGRYLLKALLSGNHLPDSPTAFLADAKAHANPSLRCKAQSPQDFANLELLLEAFRVRASRAVLTLASEMKANKNDANACMVQLTRASTAHAELLLLEAFVNGLSSIPAGKERQAVTHLCELFGAWLITKTLGDFREDDYISSKQAAMARRQLVSLLPVIRKNCVLLTDAWDFTDFELNSTIGRYDGDVYRALVRRAQDEPLNKTQVPECYEQFLKPLLQSTL

SEQ ID NO: 2878 - protein, 721 aa, Phytophthora sojae
MAMLDKRASLPLQLEVSMTSKHVKVAPPCSASSRSLHCTTYPLTPSINSNLRSTMAMELKDLAPLLLQRERESSQEIDVELLTNTLRGGHAANVRRKNAEAAISQHVELSKRDAAFQNHSQRYNTALEKTFHYVKLIQSSKVDSDDQQIMYDAIGEKLPIQVHRSMFIPTLENQADDEQQAHWLPLANSYRILGAYAQTELGHGSNVQGLETTAAYDKNAQEFIINSPTLTSRKWWPGGLGKTATHAVVHAQLRIDGEHKGVQAFIVPLRSLKDHKPLRGVEVGDIGPKVGFNSLDNGYAVFHNVRVPRRNMLMRYAKVLPNGTFIKPPSSKLVYLTMTQIRAYLILKLGLALGAATTITTRFSAVRVQGRKANGKELELTRENPVLDYQNQQHALLPLVALSYAANFAGRSMVDMHDKVLAMVTSGKADFAAQSSELHAISSGLKGWLADRVNDGIEHCRRLCGGHGFLQSSNLAHIFAETVGSCTYEGTADVLVQQHARYLLKELGSWKPSNAEGPTAFLSRSDFYSDPKLRCSASNAAEFGSFKVLIEAFEVRAARSVRKLAHAMKASGNNANACMMLMTAASTHHTELLLLKLFISGVSLLPVGSTKAAVTQLCQLFGVWLLVNGLGDFRHDDYISSSQADLAHQQLASLLPLVRRNVVRLTDGWDFSDFELNSTLGRFDGDIYRALVEHAEREPLNASQVPEGYDKYLRPLIKSAL

SEQ ID NO: 2879 - protein, 680 aa, Saccharopolyspora spinosa
MAALRSYVNGDWHAPSDNGVPLHDAVTGEEVARVSSAGIDMGAVLAHGRSRGGPALAELTFHQRAALLKSLASHLREHREELYALSARTGATLGDSKFDIDGGIGVLFGYSSKGRRELPNSTVYVDGALEPLSKGGTFVGQHICTPLTGVAVQINAFNFPVWGPLEKFAPAFLAGVPSLIKPASQTAYLTHRLVELMVASGLLPDGSLQLVCGSVGDLFEHLTDQDLVSFTGSASTGQRLRAHPVVAANSVRFNVEADSLNCSILGPDAAPGTDEFALFVKQLVTEMTVKAGQKCTAIRRALVPANLIDEVVAAAKERLAKVVVGNPASPEVRMGALASLEQREEVRRSLKALLEAGTLVHGDPGRVDVVDADAERGAFLPPLLVRCDDPDQPQPHEVEAFGPVSTVMPYETAAQAVELARRGKGSLAGSVVTADAEFAREVVLGAASRHGRMLVLNRHNAGENTGHGSPLPALVHGGPGRAGGGEEMGGVRGVLHHMQRTAVQADPATLTAITGQWVTGTPRNITEKHPFRKHLGELRIGDTVVAGPRTVTLDDVEHFAEFTGDTFYAHTDEEAARANPFFDGRVAHGYLVVSFAAGLFVDPGPGPVLANYGLENLRFLTPTYPGDEITVTMTAKQITPRVGAEHGEVRWDVDVTNQDGASVAKYDVLTLVAKRPEEQG

SEQ ID NO: 2880 - protein, 690 aa, Rhodothermus marinus; identical to SEQ ID NO: 2771

SEQ ID NO: 2881 - protein, 402 aa, Gemmatimonas aurantiaca
MPALPSVDLKAHAADLFNIDAALTEEERAIRDTIRQFVDEKLIPVMGDCYVEGRFPDELIPELAELGVLGANLPEEYGCAGLSSVAYGLIMQELERGDSGIRSFASVQGALVMYPIFAFGSEEQKRHYLPKLAKAEYIGCFGLTEPDFGSNPSGMITRARQQADGSWILNGAKMWITNGSKAHVAVVWAKTGDSTDDSSIRGFIVPTDTPGFQARDQKGKLSLRASDTSELVLSDVHLPADAILPHSNGLKSPLMCLTQARYGISWGVLGAAMACLEEAVSYSKSRVMFDKPIGGFQIQQVRLADMFTELVKGQLVSLHLGRLKDAGNFTPVQVSLAKRNNCDIATNIARETRRLLGANGILAEYSAMRHMANLESVYTYEGTHDVHSLILGQALTGLSAFK

SEQ ID NO: 2882 - protein, 675 aa, Anopheles gambiae
TPVHKMPASTVNKDLQAERDKGSFDRNEFTLWWVGGKEKLKEKQDLEDFFLNDPELQEKVPLHFLSHKELYEESVRKATVAFRKVRKMNEMGQDGVDNYSALLGGLLGTGILKQGNPLTVHYVMFLPAILGHGTPEQQAEWFGRAWNCEIIGTYAQTELGHGTFLRGLETTATYDERTKEFVLHSPTLTAYKWWPGGLAQTANYCVVMAQLYSKGQCHGIQPFIVQLRDEESHVPMKGITIGDIGNKLGMNGVNNGFLGFDHVRIPRKNMLMKNAKLLEDGTFVKPPSQALTYGTMMFVRVVICRDMAAYLSKAVTIAVRYSAVRRQSHINPDQPEVQVIDHLTQQYKLFPALAKSIIFKLTSDNLWDMYNQVTSELDKGDLERLPELHAIACCLKAITTADAAAGVELCRMACGGHGYMTCSNFYGTYGMVTAACTYEGENTVLLLQTARYLMKAWQQAQRGQELVPTVQYLARFLSSKNRRMDWDESIGGIVRALQTVAAGKLRLAAEHIEQRQKRGATLEEATNQTSIELARTADAHCRAFLVQSGCEMIEKGCATASPELAKVLRTIYHLYAYDEALKSLGDLLRFTTISESDINRLQAKLEDALTELRPNAVGIVDSFDLPDDVLGSPLGAYDGNVYERLYEEAKKSPLNQEPVNQSFHMYLKPFMKSSL

SEQ ID NO: 2883 - protein, 401 aa, Streptomyces sviceus
MTTRTVGPLTDELTADFYHFESLLPDEERKILLKARAFMRDEVKPLVNDNWAKGVFPKELITLFRDSGLAGLPYEGYGEHKPAASNLLSGMLALEMTRTDASVSTFFGVHNGLAMYSIHSGGDEEQRDRWLPAMAAMDKIGAFAMTEPLGGSDVAGGMRTTARREGDTWILNGAKKWIGNATFADYVVVWARDVDDNHVKGFVVEKGTPGFDPVKIQNKLAFRIVENAEITLTDVPVPEANRLQNINSFRDVAEILRATRAGVAWQALGVMTGAYELALDYAREREQFGRPIGGFQLVQDLLVRSLGNITASWGMLVQLARLQDAGIFRDEHSSLAKAFVTSRMREVVGWSREIFGGNGILLDHDIPRFFADAEAIYSFEGTREMNTLIVGKSITGQSAFV

SEQ ID NO: 2884 - protein, 676 aa, Silicibacter sp.
MCPKDVASFAAGEWIAPDNSAREIASAITGEVIARAGNATLDVQAMLDYARDTGGPALRAMTFHDRARMLKALAQHLDAHKQKLYDLSFDTGATQKDHLIDVDGGIGTVFVFASKGRREMPDSTVYADGAVEQLSRHGSFMGQHICTSLPGVAVHINAFNFPVWGMLEKLAPTLLAGVPAIVKPATATCYVTEAAVRLMLDSGLLPEGALQLVSGGIGDMLDRLTCQDVVSFTGSAATALKLRQTPAIVENSVRFVAEQDSLNASILGPDAAPGSAEFDLFLKEVQREMTTKAGQKCTAIRRIIVPDAQVDAVIEGLSAALAKITIGDPRADSTRMGALVSAAQKRDVLEQAAKIATEATRVFGDPDNFTVEGADRDKGAFVPPMLFHCADPDAARHVHDTEAFGPVSTVMGYRDLAHAAELANRGQGSLVASLITADPAVAREVTLNIAAFHGRVYINNATSMKESTGHGSPLPHMVHGGPGRAGGGEELGGVRAVKHYMQRTAVQGSPEILSAITGKWVPGSPEATGPAHPFTRRFGDLAIGETLHTAPRTVTSDDIAHFAQFTGDTFYAHMDDAAAERNPFFPGRVAHGYLLLSFAAGMFVQPDEGPVLANTGLDNLRFMKPVVPGDSIKVRLTVKAKTPRNEEYGEIRWHVTLTNQDDELVAEYELLTMVAF

SEQ ID NO: 2885 - protein, 657 aa, Caenorhabditis angaria
MPLNKLIRDGDNQDLTNERFKSTFDTDLMASELRGGPEKLARVRELRDEITKRGHLFEVIPSAHRTRIERIEDVSKLTKNMMEILPEIADVTSNFEMITVLRDVIGIEGFPLAIHSLMFVPTIQNQADEEQIELWLMDAIQGKIIGTYAQTELGHGTNLSAIETTATFDPSTDQFIIHTPTTTANKWWPGGLGSCCTHVILVANLIIDNKNYGPHPFFMPIRNTQTYLPIPGVRVGDIGTKMGINCVDNGFLGFDNYRIPRRNMLMKHSKVSKNGVYTAPSHPKVGYTTMLYMRSEMIYHQSQYLAMALIIAIRYSAVRRQGEIQAGQPEVQIIDYQTQQYRLLPGLARCIAFITAAETVRSMTENCFKGLAHGNSELLADLHNLSCGLKAVVTNQSSQSIDQARQACGGHGYSDASYMPTLFTSAIAACTYEGENIVMLLQLAKYLMKAMAKIDGSSEELGVLMQYLKNEKSSKDNELICHFEHIARQRVHHAYRQMKSLETSGINKDVAFTSCSVDMAKAARAHTKLFIANGFVERCQQVKEPEIRKVFDDLLELYLCYELSEMALDLSLDGYLSSEGVYDLRHRIYEAMRRLRPNAVSIVDSFDICDRELRSVLGRRDGHVYENLIKWAQMSPLNQKGLPHVEKYLKPMTNSKL

SEQ ID NO: 2886 - protein, 833 aa, Bizionia argentinensis
MKKTQNYVTGQWIEGKGEGVPMFDAITGEIVALSDTEGLDFGEILHYGRTTGGEKLRKMTFQERGNMLKSLALYLMKKKAAFYELSYRTGATKVDSWIDIEGGFGNLFANASLRKLFPNQSYHVEGDPIDLSRGGRFMAHHIMVPKRGVAVHINAFNFPVWGMLEKCASNWMAGVPAVVKPATNTSFLTEAVVREIVASGILPEGALQVITGSARSILDTVESQDVVTFTGSATTGRLLKSHKRILEESVPFNMEADSLNASILGEDAVPGTPEFDLFIKEVRNEMTVKCGQKCTAIRRIIVPQNLVEDVQISLGKALDKVTIGDPRLKEVRMGALVSKDQVTEVRDRVQELAKTARIVYGDLDKIETIGADAKKGAFLAPIVLLEENPFSNLAVHETEAFGPVSTIMPYKNLDEAITLAQMGKGSLVSSIATYDNKIAKDYVINAASHHGRIMVINRDMAKESTGHGSPLPNLVHGGPGRAGGGEEMGGMRGIKHYLQRTAIQGSPTTLTEITGIYQQNAEYKEADQHPFKYHWEDIEPGMSLKTHRRTLTDTDIINFSNLTWDHFYAHTDITSLDGSIFEKRTAHGYLIIAAAAGLFVYPHKGPVAANYGLEECRFLRPLYHNDTIYVRLTCQQKVDRDVASAEHPSGIVKWYVEIFDALTDEKVGFATVLTMVQKKQEVFVEMTSDKVDDYLSKLTADMTPKWGVMTPQHMLEHMEFTYKIASGEIQDFEVATPEKILEKVHASLYNYDKFPMGTNFPLLEKDKLEPLKHPDLATAIEKFKGQREKYLAFYEENPEAKLKNLVFGELNKYEAYLLDRKHLNHHFEQFNLF

SEQ ID NO: 2887 - protein, 678 aa, Nocardiopsis dassonvillei; identical to SEQ ID NO: 2743

SEQ ID NO: 2888 - protein, 833 aa, Bizionia argentinensis; identical to SEQ ID NO: 2886

SEQ ID NO: 2889 - protein, 698 aa, Corynebacterium glutamicum
MSNHVDIVPSYLQGQWVRPENPSRIVDVADASTGEIVARVSSEGLDIHGALDYARTVGQKNLKALTFHERALKIKELALYLNEHKDVLYQLAMCSGANKRDNFVDIDGGISTMFTFSSKGRRELPNTNVIVDGPPEVFAKDSSFQGQHIYTTLTGVAVQINAFNFPVWGMLEKFAPSFIAGMPTIVKPATPTGYITAEAVRLMVESGILPEGSLQLISGSVGDLLDHLDYNDHVAFTGSAKTADTLRNLPKVRENGVRFSAEADSLNAAILGPDASVDTPEFEAYTKMLFAEMTSKAGQKCTAIRRAIVPHGLIDNVAQALKQRLDDKVTVGDPRDASATMGPLVSVEQAEDVEGAVEKLIAAGGQVVTGGTVEGAFFAPTILTFADAYAERIHDTEAFGPVVSLIGYGDIDEAIELAALGKGSLVASVATHDPATTARVAAGIAAHHGRLHFIDREDAKTSTGHGSPLPHLIHGGPGRAGGGEELGGVRGIKHYMQRTAIQGSPNHLTAITGEWHTGATTNRVTRAEVEAGTAEHPFRKDLATLKIGDQFASELREVTMGEIQAFAEETGDTFYAHVNEEAAMRNPFFPRRVAHGYLLVSWAAGLFVEPAPGPVLANYGLENLRFIQPVTYGDSIRVELTAKRITPRVTDEYGEVAWDTVLYNQDDEIVAAYDVLTLVEKVNTTYANDQKAEELAGV

SEQ ID NO: 2890 - protein, 707 aa, Arthrobacter arilaitensis
MSTKQISVVPSFIAGEWRTPQSEGGTEVRDANTGELLATVTNDKLDVAAAVDYGRGTGHQELAKLSLHERALKLKELALYLNERRKDLYEISFKTGATKIDSMVDIDGGIGVLFTFSSKGRRELPNSNVILDGPTEPLSKDGSFIGTHIYTAMSGVVVQVNAFNFPVWGMLEKFAPAFIAGVPTIVKPATPTGYLTEAAVRMMLESGILPEGSLQLLSGSARDLMDHLDYRDMFAFTGSAATASKLKSHPNVIDGGVRFAAETDSLNAAILGPDAEEGTAEFEAFVKVVVTEMTSKAGQKCTAIRRNIVPSHLVEPVIAAIGQRIEQRVVIGDPRVEGVTMGALASLEQLADVRAAVQDMIDAGGELAFGRLDAPAVRVAPERDAVAEFGAFMSPVVLRWADARNPLVHSREAFGPVSSVIGYDNLDEAVRLAAMGAGSLVATVCSNDTDTVRSLALGIAAHHGRVHILNRETARSTTGHGSPVPHLVHGGPGRAGGGEELGGIRSVKHHMQRTAVQGSPNMLTALSGVWHAGAEQRLAGCEKFGGQEQYTHPFRKSLAELQVGDGFASDLRVVNLEEISEFAKKTGDTFYAHTDAKAAEANPFFPGIVAHGYLLVSWAAGLFVEPAPGPVLANYGLESLRFITPVAAGDSIRVTLTAKKITPRVTDEYGEVAWDAILHNQNDEIVATYDVLTLVEKENLTYANFEG

SEQ ID NO: 2891 - protein, 438 aa, Pongo abelii; identical to SEQ ID NO: 2310

SEQ ID NO: 2892 - protein, 402 aa, Streptococcus constellatus
MATKEEILRELYPEDLFHYADGLTLGEAEVLQETRRLIEKHLRPVINEHWEKPDFPFEQFYAVAKGAQIMNNPKLFEGREGSYKPSELYIAFLYLELARFDTSMATFYTVHGGLCYNTILLGGDERQQKEFLPKLAAFDWQGCFALTEPLSGSDIAGGLATTAERVGDKWIINGEKRWIGGSDTADVIPVFARDVADGKIKCFIVRKGAPGYDVEVIQHKIALRCVRNGHITMTNVEVPDSDRLVNINGFEDVARILTFTRADVAHIAMGITCGSFVAALKYTTNRQQFKRPVAKFQIIQEKLARMQANAVAAIAYSVRLAEMQEAGNELMLNSALAKMHNSLVMRETVALAREVGGGDGITLETDVARFFADAEAVYTYEGSHEVNALFVGREITGLGAFV

SEQ ID NO: 2893 - protein, 402 aa, Streptococcus constellatus; identical to SEQ ID NO: 2892

SEQ ID NO: 2894 - protein, 402 aa, Streptococcus infantis
MATKEEILRELYPEDLFHYADGLTLGEAEVLQETRRLIEKHLRPVINEYWEAPDFPFEQFYAVAKGAQIMNNPKLFEGREGNYKPSELYIAFLYLELGRFDASMATFFTVHGGLCYNTILLGGDERQQKEFLPKLAAFDWQGCFALTEPLSGSDIAGGLATTAERVGDKWILNGEKRWIGGSDTADVVPVFARDVEDGRVKCFIVRKGAPGYHAEPIPHKVSLRCVRNGHITMKNVEVPDSDRLVNINGFGDVARILTFTRADVAHIATAITCGSFVAALKYAKDRQQFKRPIASFQIVQEKLARMQANAVAALAYSARIAEMQEAGNELMLNSALAKMHNSLVMRETVALARETCGGNGITLETDVARFFADAEAIYTYEGSHEVNALIVGRELTGVGAFV

SEQ ID NO: 2895 - protein, 402 aa, Streptococcus oralis
MATKEEILRELYPEDLFHYADGLTLGEAEVLQETRRLIEKHLRPVINEYWEKPDFPFEEFYAVAKGAQIMNNPKLFEGREGSWKPSELYIAFLYLELARFDASMATFYTVHGGLCYNTILLGGDERQQKEFLPKLAAFDWQGCFALTEPLSGSDIAGGLATTAERVGDKWILNGEKRWIGGSDTADVVPVFARDVADGKVKCFIVRKGAPGYHAEPIPHKIALRCVRNGHITMKNVEVPDSDRLVNINGFGDVARILTFTRADVAHIAMGVTCGSYVAALKYAKDREQFKRPIAKFQIVQEKLARMQANAVAVIAYSTRIAEMQEKGNELMLNSALAKMHNSLVMRETVALARETCGGNGITLETDVARFFADAESIYTYEGSHEVNALIVGREITGLGAFV

SEQ ID NO: 2896 - protein, 698 aa, Fusarium oxysporum
MPPPNPDWVKALKPSGPQGSELLAQERANSDINVDQLSTFLFTKEVLERNDKILKILQADPVFDKEQNYFRGRTDRLEAALARAKALRRLSVKHNWNDEEHHAANDLISEPTPYGLHATMFLKTLEEQGTPAQHKLFLERARNYEIIGCYAQTELGHGSNVRGLETTATWNPEDKTFTIHSPHLTASKWWIGSLGKAANHAVVVAQLILNGKPYGPHPFVVPIRDMKTHEPLPDIHVGDIGPKFGYNTMDNGFLLFNNVKIPHVNMLNRFSGVDPETGKYIRPSNPALIYGTLTFIRSSIVFQSGSVLARGVTIATRYCAVRRQFQDRDADASETGENQVLNYTMVQHRLLPLLASSYALFFTGRAMINLYNANQKRMAQRRDAGDAKRKPGPEELSPGSDHLADLHAISCSLKAFASTTAAEGLEVCRRACGGHGYSAFSGIGSWYADYLPTVTWEGDNYMLTQQVARYLLKSARAVLAGKAPDNGISRIFKEFIRRQDIGAAFDVLDSDQDLVDAFAWRVSFLTFEALKHRDEEKQSWNSLLIDFWRLSTAYAQYQVVKNFHEALQDEATKKSLDPNTLAIMHKLFELFALHNLQSSASEFFTSAATTVRQIQLARTKRTLSLLDEIRPHAVRLVDAWSFPDWQLDSALGRSDGKVYEDLFHRASEVNPVNDIVFDPYPESDVLFRKNGSGPKAKL

SEQ ID NO: 2897 - protein, 402 aa, Streptococcus cristatus; identical to SEQ ID NO: 215

SEQ ID NO: 2898 - protein, 675 aa, Albugo laibachii
MIDTKLRDLAPKLLQKERISGDINVKLLTSYLHGSLEANQRRKELLNLVALNPVLSDDRTMYRNHTERYAFALKQSFHLIHFFKKHHIESPNAKRIVSSSLQETLPTVVHDRMFIPTIELHGTPEQKKKWLIPAREYRIYGTYAQTELGHGSNVQGIETTAQYDAHRQEFIIHSPTFTSRKWWPGGLGKTANVAVVYARLLLDNGRDVGVHAFIVPLRSLRDHRPLKGIELGDIGPKVGFQAVDNGFCAFHHVRIPRNHMLMRFARVNADGSYQKARNSRLIYFTMLHMRVGCLYKCRYALARATTIATRFSAVRVQGNSTKSSGNCTELQVIEYQNQQKSLFPLIGMAFVALFVERMVENHPIFAQQIGLEHENLEFHLAELHAISSGLKGWLSEYCSNGVESCRRLCGGFGFLHSSNLPQIYNELVGTCTYEGTFDILAEQHARFLRRRFEAYETNNVVEGALCAPSVSFMSQWKCWLDPNLRCRAKSTIDLTDMELLREMFAVRATRFIARLASASRSSGGDNNANMALMMRVSRAHSELLMVTASISELGNFPAHHAKTKDVVRNSIVLLVLSLVEQNLADFREVDYMSTEQGDLVRVVILDLLSKIRNNAVLLTDAWDFMDLELKSAIGRYDGDIYRALVECAADEPLNKTLIHEGYYLFQKPIIQKASL

SEQ ID NO: 2899 - protein, 667 aa, Zea mays
MDASAEVDHLAAERSAARFDVEAMKVAWAGSRHAVEVGDRMARLVASDPVFRKDNRTMLSRKDLFKDTLRKAAHAWKRIVELRLTEEEAGMLRLYVDQPGYVDLHWGMFVPAIKGQGTEEQQKKWLPMAYKFQIIGCYAQTELGHGSNVQGLETTATFDPKTDEFVIHSPTLTSSKWWPGGLGKASTHAVVYARLITEGKDYGIHGFIVQLRSLEDHSPLPDITLGDIGGKFGSGAYNSMDNGVLRFDHVRIPRDQMLMRLSQVTREGKYVHSDVPKQLLYGTMVFVRQTIVADASKALSRAVCIAVRYSAIRKQFGSQDGGPETKVLDYKTQQSRLFPLLASAYAFRFVGDWLKWLYMDVTQKLEAKDYSTLQEAHACTAGLKAVTTSATADAIEECRKLCGGHGYLNSSGLPELFAVYVPACTYEGDNIVLLLQVARILMKTLSQLTSGKQPVGTMAYMGNVQYLMQCKCAVNTAEDWLNPVAIQEAFEARALRMAVNCAQNIGQAANQEEGFYERSPDLLEAAVAHIQLVIVTKFISKVQQDIPGPGVKEQLQNLCNVYALYILHKHLGDFLATGCITPKQGALANEQLGKLYAQVRPNAVALVDAFNYTDHYLGSVLGRYDGNVYPALYEEAWKDPLNETVVPEGYHEYLRPLLKQQLKLSRL

SEQ ID NO: 2900 - protein, 665 aa, Zea mays; identical to SEQ ID NO: 2834

SEQ ID NO: 2901 - protein, 411 aa, Ichthyophthirius multifiliis
MSRLADYKNQFTQKATYIDSAVDYLNFQQLLNKEDNDFRLKLREFLQLNIAPTINEYVESAEFPEEYIPKLKEIQLLKNLTDKPYGNSSSILAQGVLYLELSRCDPGLATFVIVQHGLLMSTINQLGSQEQKDKYLPLMRDLELTGGWGLTEFKNGSDATSIQTTVKSTKDGWVLNGDKRWIGNGNRDIMVVWARNIEDNNKIQGFLLNLKTPGVHTEVIKHKLALRIVQNCQLNFQNVFIPKENYLVKATDFSKGTSKILLHSRILVCWLAAGIAVGVYDHVIKYISERKQFGKPVSSFQLQQEKLVRIMGYCQSILLMCWRVSTIYDQGKATLGQATLCKAFTTSKTREIARLGREMFGGNGIIIDNYVMKALADIEALYTYEGTYDINSLVAARELTGVAAFKVSVKQ

SEQ ID NO: 2902 - protein, 409 aa, Ichthyophthirius multifiliis
MSDRLNNYKNQITQFPIVESSIDYFDFPSLLTSEQNTTRKAFREFLHKEIAPYINEYIEKAQFPDFVLPKFRQFGLFNHLLNAPYGLSSSILSQGILFAEISRVDASLATFSAVQSSLLMSTIEILGSEEQKNKYLPKLRDLELVGGWGLTEEKVGSDASSLQTSVKRDPSGKGWILNGNKRWIGNGNKDIMIVWARNVENNKVQGFIVDLKSPGVNSVVIKNKLALRMVQNCQIQFNNVHIPEENFLPKATDFQKGTSKILLHSRLIVCWITFGVAMGVYDHTIKYMNERKQFGVKISSFQIQQEKIQRIMSNVQAILFLCWRLSVLYDQGNITIGQVALGKAFATERTREITRLGREIFGGNGIIFDNYVMKALVDTEALYTYEGTYDINALVAGRELTGISAFKTK

SEQ ID NO: 2903 - protein, 686 aa, Mycosphaerella graminicola
MPDFSDDLKPASPTGPEILSQEREHSNVPVDELAQHLLSRNDFLKRQERIIPILEKERVFSKAKQQNLSRPDRYQLGLARAKQLRRLADKHSWDEEDQSMSKYLVDDVSPFMVHDSMFPQTVKEQGSEEQRAYWMPKIERWEAIGCYAQTELGHGSNVRGIECKATWDPKAKEFVIHSPSLTASKWWNGSMGRTANTAIVVAQLYVPKTADSTELVHHGPHTFIVQIRDLKTHKPLEGIVVGDIGVKYGYAPMDNGYMLFNNFRVPHSAMLSNYSSIDYNNCTYTKPANPAVVYGSLTYVRATIIMHARLIIARAVTIAVRYSTVRRQFQDKDTTDKHAPELSVLDYPTVQIRILPLLATAFALHYTGEAMHNLYSNTRAQIEKGDFSRLAVLHAQSSGLKSLCTELAANSIETCRRAMGGHGFGGGSGYIQLNSDYLSKPTVEGDNWMITQQTARFLLKRMQAAVAGKGKAEDEIEQSCRDWLSERQQSPAPYRIFQSDEEIVKAFHRRSRDITYRAYVDRHEKKRNWNAMLLQLRKVSHAESQSILVTNFYEAMSQADLSPTLREHLKVQFRLFAFYTMDSEARDFVKARAASDEDVDELPSKIQDLMAEVRPHAVRLVDSWKIPDYLLDSALGRSDGKVYEDLFNRAHRLNPLNETTFNPYFQHDEIVMGGGKASLDNILAKL

SEQ ID NO: 2904 - protein, 697 aa, Mycosphaerella graminicola
MAEVPQWVRNLKPAEPQGSDLLAQERKASNVNVEKLSNFLFTKEALSRRDEILKILKAEPILDKSQDYFLGRVDKWEHALGKAKKVRQLAVKHNWGDLEKRVANDLISEPLPYALHEGMYLVTLRDQGTPAQHEKYLKPAENFEHIGCYAQTELGHGSNVRGLETLAIWNPEDQTFIIHSPHLTSSKWWIGSLGRTANYAAVMAQLIINGKPYGPHPFVVPIRDLKTHQLLPNIYAGDIGPKFGYNTMDNGYLLFNKVKVPHDAMLAKFSAVDPKTSKYLKPASPSLIYGTLTWVRSTIVLMSGSTLARGVTIATRYLAVRRQFQDRDAPAGQKGENQTLNYTMVQIRLLPLLASAFALHFTGKGMMSLYEANQRKIKSTSTTGDQKERDPGPEETQSGSDLLSDLHGTSCGLKSLCSTMAAEGLEVCRRAMGGHGYSSFSGVGSWYADYLPTVTWEGDNFMLTQQVARYLLKAARTVIKGQDPNNDTTENLTYFHKRRDVGAAFDILDKDDEIVSAYAWRSAYLTFEALHARDDLKKSWNSLLPAFYQLSRAHSQYLIVKNFYETLQSPSISSELDPATLVLMHKLFRLYALHTLEQESADFFTSSAVTVQQIRLARTKAVMQLLEDIRPHAVRLVDSWSFPDWQLNSSLGRYDGKVYEDMFYRAAELNPLNKRIVDPYPDSPVLFRKEAPEKGRL

SEQ ID NO: 2905 - protein, 679 aa, Acetobacter tropicalis
MTPILASYAQDRWHKAVSEFEDIQSAVNGQIIAQASSSGLDFGGLVQHARSKGGPALRKLNFHQRADMIKKLALYLTERKQTLYDLSFNTGATSRDNLFDIDGGIGTLFAYASMAKKNLPDKYILAEEIETLSRNGTFMGTHILSSLQGVAVHINAYNFPCWGMLEKLAPAIIAGVPVITKPATVTSYVAHAVAQMIVDSGIFPPGAFQFICGRTGDLLDHLKGQDVLSFTGSITTSEKLRNHPIISANAVRFIAERDSLNAAVLGPDVSPDMPEFDLFIRAVTQEMTVKAGQKCTAIRRIMVPETIIAEVTTELKARLDRIVVGDPQHEGVTMGPLAGLAQREDVRRHVATLAQESEIVFGDPQHCDPLGASDQNGAFMSPVLLQNLNPHDAISLHHTEAFGPVATIMPYTSLADAASLVKRGEGSLVATLCTYDDNVAAELVASLASFHGRLHILDRECAKESTGHGSPLPALVHGGPGRAGGGEELGGIRGIRHYMQRTALQASPTRLTRLTGRWTIGAQEALRKEHPFRYNFAQLTVGDTIHTQPRTITVQDIEHFAEFTGDTFYAHTDEKAAAANPFFPGRVAHGYLLLSFAAGLFVDPAPGPLLANYGLESLRFLKPVSPGDAIQVRLTVKSKNAAREPHYGEVRWDVELFNQNKETVARYDLLTMSAQPAAA

SEQ ID NO: 2906 - protein, 677 aa, Bradyrhizobiaceae bacterium
MKLDSYVNGQWTAPSGDFTEVRSAVTGDVVAEAMTGGLDMRGILAFARDTGGKNLRRLTFHQRADMLKKLAQYLTERKDQLYKLSFQTGATRTDNLIDVDGGIGTLFVYAGKGRRELPNSTFLLDGAVEPMGKAGTFAGQHIITSLQGVAVHINAFNFPCWGLLEKLAPALLAGVPVVSKPATVTSYVAHALARMIAESGILPEGAFQFIVGSTGDLFDHLTCQDVVSFTGSADTSEKLQRHPVIAREAVRFVAERDSLNAAILAPDSGPGTPEFDLFIKEVAKEMTVKAGQKCTAIRRVLAPMSHVDAVIGALRERLDKVVIGNPEQDNVRMGPVVGLEQRRDVLNHVKALRTEAQLVAGDPDNFDVQGADVVRGAFVPPILLHCANPAQATKVHSIEAFGPVSTVMGYSDLDEAVTLTNRGGGSLVASVYTHDPKVASDLVFGISSFHGRLVMIDRDCAKEQTGHGSPMPQMVHGGPGRAGGGEELGGVRSVHQYMQRTAVQGSPRMLTGVTGSWTKNAPIVEKDRHPFRFHFEDLDVGQTFYSKERTITLEDIEHFARFTGDTFYAHMDEKATKGHPFFPGRVAHGYLLLSFAAGLFVDPDPGPVLANYGLDSLRFIKPIQPGETIKVRLTAKDKSPRNKQYGEVRWDVEILTDKDESAATYELLTMNAVRPVA

SEQ ID NO: 2907 - protein, 679 aa, Acetobacter tropicalis; identical to SEQ ID NO: 2905

SEQ ID NO: 2908 - protein, 677 aa, Bradyrhizobiaceae bacterium; identical to SEQ ID NO: 2906

SEQ ID NO: 2909 - protein, 691 aa, Corynebacterium striatum
MTSQARLVPSYLSGQWVTPTDPTKITDVHDASTGELVAQVSAEGLDIAGAVEYARTTGRTGLQALTFHERAIKLKELALYLQDHREELNALAHKTGANKRDNFIDVDGGISTMFTFSSKGRRELPNSTVIPAGEAEVFSKDGSFIGRHIYTSIPGVAVQINAFNFPVWGMLEKFAPAFIAGVPSIVKPATPTGYVTEACVRLMIDSGILPEGSLQLISGSARDLLDYLDYRDHVAFTGSAATAHALRSHRNVIEGGITFTAEADSLNAAILGTDVTEDSPEFEAYVKAVFGEMTAKTGQKCTAIRRAIVPQHLVDPVIAALKARLEAKVVSGDPRDANATMGPLVSVEQREDVATAVRTLVDAGGDIVLGGPDELEGAFFAPTILRFADSRTPAVHNTEAFGPVVSFIGYDTPEEAIELAALGAGSLVASVITHDPELTTQLGRGIAAHHGRLHFLDRDDAKTSTGHGSPLPHLVHGGPGRAGGGEELGGVRGIKHFMQRTAIQGTPDHLTAITGQWHRGARVQRVTRADVVSSAGVHPFRKDLATLKIGDQFASDLRKVSLEDITAFAQSTGDTFYAHTDEEAATANPFFPRRVAHGYLLVSWAAGLFVEPAPGPVLANYGLENLRFITPVTYDDSIRIELTAKRITPRVTDDYGEVCWDAALYNQHDELVASYDVLTLVEKVDTIYAQQ

SEQ ID NO: 2910 - protein, 402 aa, Corynebacterium striatum
MPPILDSSHPLGAHLAGIKYPHADILGVADRLPEDEQSKLATIHEFLQTEIRPVVGEFWDREELPFDLLPTMAAHGLGEIELSGTSRLYRGLVYAEVTRADVSLSALVGIHNELVVGLIDKLGSDAQKKEWLPGLRQFEKVGCFALTEPDHGSDIAGGLAATAEKTADGWVINGAKRWIGAGTFADFSICFARDIEDNDIKAFIVEHNREGVTTQKIARKMGLRIMQNADINYDNVVIPHENLIPGAETFANVNDFLCYSRAWVGWQGAGIQLGIFDKAREYAVKREQFGRPIAKFQLVQEQLARILGNATASLAMMAQVAEVQEKGLLEMPFAALAKATTTRLARESAAAGRNIGGGNGILTEYDLSKFMLDAEVLFTYEGTYDINSLIVGRAVTGVSAFV

SEQ ID NO: 2911 - protein, 678 aa, Providencia alcalifaciens
MGKWATGAGEGRKIFHALTNEALYAVTTEELPLAQSLQYGRDVGGKALANLTFQQRGEMLKAVARYLLAHKDELYAISAQTGATKSDSWVDIEGGIGTLFSYAGLASRELPDDTVWSEDEMIPLSKQGQFVARHILTSRRGVALHINAFNFPCWGMLEKLAPTWLAGMPAIIKPATASAQVTQVMVALILESGLVPEGAIQLICGGVGDMFNHLDFEDVVTFTGSASTGQKLKSHPRINQKSVPFTMEADSLNCAILGSDVQLESPEFALFIKEVTREMTAKAGQKCTAIRRIIVPKSQLEHVKQALLKRLSGVTVGDPAVDGVRMGALINLEQRQDVQDKVNYLLANGCERLCGGSFANMQVVGGDSEKGAFFPPTLLYCAEPFVHQAVHETEAFGPVATLMSYDELEQAVQLAALGGGSLVGSLITADSQVAQTVIRAAARVHGRMLILNEAASTESTGHGSPLPMLVHGGPGRAGGGEELGGLRAVKHYMQRTAIQGSPSMLTAISKQWMRGAEAIADVVHPFRKYFEELVIGDTLLTARRTVTEADIVNFACLSGDNFYVHVDKLGAEQSMFGERIAHGYFVVSAAAGLFVDAGVGPVIANYGMENLRFIEPVKIGDTIQVRLTCKKKIKKAQKKVEDKPNGVIEWDVQVFNQHNDIVALYSILTLVERRHGDF

SEQ ID NO: 2912 - protein, 682 aa, Stappia aggregata
MTAHPHKVRVLESYLAGSWRQGKAEGKPLLDAATGAPVATIDASGLDLAEALAWGRDTGGKALRKMTYHERALMLKTLAQALTEQKEIFYQESFATGATRKDSWIDIEGGIGTMYAYSSKARREMPNTRVFVEGAVEPLSRDNTFSGQHVLTPLQGIAVHINAFNFPCWGMLEKIAPALIAGVPCLVKPASQTAYLTELMVRHILATGILPEGSLQLLCGSAGDLIDHVTGQDVVTFTGSAATGQMLRQTPAIVQNSVRFSMEADSLNAAVLGPDVRAEDPEFDLFIKEVAREMTVKAGQKCTAIRRVIVPRKLSAAVADALCKRLGKTVIGDPRDEAVSMGPLASAGQREEVLARVADLKTEAEIVPGLDQKGPAKGAFAGPVLLHCDNPLSAEAVHSVEAFGPVATLMPYDELEEAVELTHKGKGSLVASLFTNDPSVAEEAVLGMAPFHGRVMIGNRQSAKSSTGHGSPLPMLVHGGPGRAGGGEELGGLRSVKHYMQRTAVQGTPALLGAVTGRWISGAPGREDSRHPFRKSLSDLKIGDQLHTKAREVSLEDIEHFATFTGDTFYAHMDEDAAKRNPFFEGRVAHGYLIVSFAAGLFVDPDEGPVLANYGVDNLRFMTPVNAGDALKVQLTAKEISPRISADYGEVRWDCLVTNQNDEPVAQYDVLTLVAKEWPASA

SEQ ID NO: 2913 - protein, 688 aa, Serpula lacrymans
MVHFDASSQTRVDMANARSQATIDIPVIRDLLYDGRENWDAHCRVQRIVSEDPVFDKSQRDFLGRGDLYRRGLAMTNRILELEDIHKWSSQETSEAMNMLDETLPIRLHLIAFEPVLLSQGSASMLQRYRHLAANKAIHGCYLQTELGHGTNVSRLETTATYIPETDEFDIHSPTLTSRKWWIGALGKTATHGVVQAKLILPGGKDVGPHLFLVQLRSLEDHRVLPGLTIGDIGPKALGGNASNDNGFASFNHVKIPRDNMLSRFAQVTRDGQYVKPPHAKLSYGGMLYIRSSMVISGGWTMAKAATISIRYTTVRRQGGGDVDGLERQVISYPSTFYRLLPILSRAYVFILLGQRITTAFNEMSSRLASGDASLLPEIHATTAGLKILVSTTGTEDLETARRSMGGHGYSAFSGLGRIYADYVPSATYEGDNFVLDGQVIRTALKSYSNIYSTKTSSMSSLSPFSSYLRLCHSTKPPQITNSSTWDDLASVILLLELRAAFVVRDFARNQGDDDASASQRVSRAVVDAFVATQIGHIVKDLHILNLEKRVISDLLRLYLLTTIESNLVDFLSFNILPRGESGDPARSLRLSIRDLCLELLPNAIGLTDAFGFSDWELNSALGVYDGNVYEALWKRAQEEPLNKDEVTLAYEESIKPMLQRGHKLALRGRSKLCRLLCIATSTINLII

SEQ ID NO: 2914 - protein, 686 aa, Salinisphaera shabanensis
MQSSSYVQGQWVTGEGGKTVLNAVTGEPVARVSSDGIDFAAMLDYARTQVGPKLRALTFHQRALQLKALAQTLMADKERFYKLSTATGATRTDSWVDIDGGIGTLFTYASKGRRELPNATFALDGNPEPMSRHGSFIGQHIHTSLEGVAVHINAFNFPVWGMLEKFAANYLAGLPAIVKPATQTAYVTEDVVRAIVDSGLIEEGALQLISGGVGDLLDHVTCQDVVTFTGSAATGRKLKQHPAIVENATRFSMEADSLNFLALGPDAGPDTPEFKLAVKEVMREMTVKAGQKCTAIRRVLVARDHQQAFIDALSEKLDKVVVGNPEAEGVTMGALASRDQVEEVRARIADLAEGAKIVYGDPARCEVVDADADKGAFVAPVVLSADAPFEHTAIHTIEAFGPVATVMPYETTEEAVALARLGGGSLVGSIVTYDAGFAQAMTLGCAPFHGRLLVLDRDCAKESTGHGSPMPMLVHGGPGRAGGGEELGGMRAVFHYMQRSALQGSPDMLADVIDHWLPGGKRVQTDRHPFQKHFDELEIGDAILTDAREVTLEDIEHFANFTGDTFYAHMDEDAAKANPFFDGRVAHGYYIVSLAAGLFVEPNPGPVLANYGVDNLRFMTPAYPGDALRVALTCKHKTKRENTEYGEVRWDATVTNQNDEVVAQYDVLTMVATTDWTPEAEETAAA

SEQ ID NO: 2915 - protein, 686 aa, Salinisphaera shabanensis; identical to SEQ ID NO: 2914

SEQ ID NO: 2916 - protein, 402 aa, Streptococcus anginosus; identical to SEQ ID NO: 2686

SEQ ID NO: 2917 - protein, 402 aa, Streptococcus infantis; identical to SEQ ID NO: 2894

SEQ ID NO: 2918 - protein, 683 aa, Microbacterium testaceum; identical to SEQ ID NO: 2753

SEQ ID NO: 2919 - protein, 700 aa, Microbacterium testaceum; identical to SEQ ID NO: 2754

SEQ ID NO: 2920 - protein, 413 aa, Microbacterium testaceum; identical to SEQ ID NO: 2755

SEQ ID NO: 2921 - protein, 836 aa, Psychroflexus torquis
MQTTQSYIQGQWTQGKGEGKPIFDSITGEHFTNINVDGFDVPEVLAYGREKGDTLRKMTFQERGNMLKALAFHLQKKKRVFYDLSYRTGATKMDSWFDIDGGFGNLFANASLRKLFPNQPFDVEGDPIDLSHGGRFMAHHILVPKEGVAIHINAFNFPVWGMLEKCAVNWMAGVPAVVLPAPQSAYLTEAVVKEIIASGILPEGGLQLISGTAKNILDSTESQDIVTFTGSAKTGRLLKNHPRLLEESVPFTMEADSLNASVLGEDAVPGTPEFDLFIREVRNEMTVKCGQKCTAIRRILVPEQLIEDVQIALGKALDKVTLGDPRLKEVRMGSLIDKNQVEAVKKSILELSKTAELVYGNFDEAKTIGADYAKGAFMKPILLRENHPFENEAAHITEAFGPVSTLMPYKTLEDAIKLSKKGKGSLVSSIFTNSDIIARDYTIQAASHHGRILSINRESAKQSTGHGAPLPNLVHGGPGRAGGGEEMGGKRGIKHFMQRCAIQGSPTTLTEITGIYQPKADYKDAENHPFAYHWEDIQPGMSLKTHNRTLTDTDIINFGNLTWDHFYAHTDITSLEGSIFEQRTAHGYLIISAAAGLFVYPNKGPVAANYGLEEIRFLRPLYHNDTIHVRLTCKEKVDRDQKGKELPSGIVKWYVEVFDTEAVEEDDKLVAIATILTMVQKKQTTFYEVDRSFIEDKLRELDESATAQWGLMTPQHMVEHLEMSLRIATGEISNFEINAPEEHIEKVQETLYNYEKMPRGYKMPLMKKDELEPLKYEGLSEAKMSLLEAYDNFVVFFREHPKAITKNAVFGELTSFDWKLLNRKHFNHHFQQFGLI

SEQ ID NO: 2922 - protein, 402 aa, Streptococcus oralis
MATKEEILRELYPEDLFHYADGLTLGEAEVLQETRRLIEKYLRPVINEYWEKPDFPFEEFYAVAKGAQIMNNPKLFEGREGSWKPSELYIAFLYLELARFDASMATFYTVHGGLCYNTILLGGDERQQKEFLPKLAAFDWQGCFALTEPLSGSDIAGGLATTAERVGDKWILNGEKRWIGGSDTADVVPVFARDVADGKVKCFIVRKGAPGYHAEPIPHKIALRCVRNGHITMKNVEVPDSDRLVNINGFGDVARILTFTRADVAHIAMGVTCGSYVSALKYAKDREQFKRPIAKFQIVQEKLARMQANAVAVIAYSTRIAEMQEKGNELMLNSALAKMHNSLVMRETVALARETCGGNGITLETDVARFFADAESIYTYEGSHEVNALIVGREITGLGAFV

SEQ ID NO: 2923 - protein, 402 aa, Streptococcus infantis; identical to SEQ ID NO: 2894

SEQ ID NO: 2924 - protein, 792 aa, Hordeum vulgare
WAGSQHAVEVADRMARLVASDPVFRKDTRTMLSRKELFKDTLKKAAHAWKRIVELRLTEEEANLLRLYVDQPGYVDLHWGMFVPAIKGQGTEEQQKKWLPMAYKFQIIGCYAQTELGHGSNVQGLETTATFDPSTDEFVMHSPTLTSSKWWPGGLGKASTHAVVYARLITEGKDYGIHGFIVQLRSLDDHSPLPGVTLGDIGGKFGSGAYNSMDNGVLRFDHVRIPRDQMLMRLSQVTREGKYVHSDVPKQLLYGTMVYVRQTIVADASKALSRAVCIAVRYSAIRKQFGSQAGGPETQVINYKTQQSRLFPLLASAYAYRFVGQWLKWLYTDVTQKLEAKDYSTLPEAHACTAGLKSVTTSATADAIEECRKLCGGHGYLNSSGLPELFAVYVPACTYEGDNVVLLLQVARFLMKTVSQVATGNQPVGTVAYMGNIQHLMQCKSAVNTAEDWLNPAAVKEVFEARALRMAVNCAQNVSKAPSQEEGFSELSPDLLEAAVAHVQLIIVTKFIEKMQEDIPGPGVKEQLQKLCSIYALHLLHKHLGDFLSTGCVTARQGALANEQLGKLYAQVRPNAVALVDAFDYTDHYLGSVLGRYDGDVYPALYEEAWKDPLNETVVERELEGQIGHHAIQLPHQFDSPSPSSPLPTLAPDPPAPARAKPWRRPSTCRSTTSSRTTRRATPPPAGAAAAARAAVDLPLAAAARPPPPPLSEASAPTGAPSRGRGTGRRPTSRRRPRNRRGSTTCTRTPLPEAAAAGGSRLSRPAPSSSSPIWTSASRPRTSRSFSPSWVI

SEQ ID NO: 2925 - protein, 696 aa, Hordeum vulgare
MATMSRSGYGSEDEDSTPAMRRLRRLSLHLLQPSDRPAPEGANSLVPAACAGKRRAGGLDADVAALTSYLRGRHRATQERLYRFFVERPELHTPVELPMAAHRELCLRQMVALVREAGVRPLSLMADDPAEYFAVMEAVGGLDISLAIKVGVQYSLWGGSIINLGTKKHREKYFDKIDNLDYPGCFAMTELHHGSNVQALQTTATFDPVTDEFIIDTPNNGAIKWWIGNSALHGKFATVFARLILPLQGKGGEPADMGIHAFIVPIRDLETHAVLPGIEINDCGHKIGLNGVDNGALRFRSVRIPRDNLLNRFGDVARDGKYTSSLPTINKRFAATLGELVGGRVSLAHSSVGILKVAVTIAVRYALLRQQFGPPKQPEISVLDYQSHQHKLMPMLASAYAFHFARRYLVDKYSEMKKTNDEDISADVHVLSSGLKSYITSYTAKSISICRESCGGHGYAAVNHFGDLRNDHDIFQTFEGDNTVLLQQVAGDLLKQYQQKFKGGTLSVTWNYLRDSMSTYLSQPNPVTARWEGEDHLRDPKFQLDAFRYRTSRLLHSVAARLQKHMKTLGGFGAWNRCLNHLLTLAESHIESVILARFIEAVKSCPDEKTREVLKLVCDLYALDRIWKDIGTYRNVDYVAPNKAKAIHKLVDYLSYQVRLVARELVDAFDLPDEVIRAPIGLQSEAYAQYTQHIGF

SEQ ID NO: 2926 - protein, 697 aa, Hordeum vulgare
MPSNPEWVKALKPSGPQGSELLAQERAKSDLNVDQLAEFMFTKEVLQRNERILNILLAEPVFDKSQNYFRGRNARIEAALARGKRLQQLQVQHNWSKDEFETANSLISEPTPYGLHASMFLVTLREQGTPEQHKLFLEKAEAYKIIGCYAQTELGHGSNVRGLETTATWNADDKTFTIHSPTLTASKWWIGSLGKTANHAVVMAQLFIAGKNYGPHPFVVPIRDLKTHEPLPNVHVGDIGPKFGYNTMDNGFLLFKNVKIPHINMLARFSSIEPKTNKYVRPSNPSLIYGTLTYIRSHIVLQSGSVLARGVTIATRYCAVRRQFQDRDAPATETGENQVLNYTMVQVRLLPLLAATYALHFTGRGMIALYNQNQQRMNSTAAPESRRAPGPEELNAGTDLLADLHATSCALKALASTTAAEGLEVCRRACGGHGYSSFSGIGSWYADYLPTVTWEGDNYMLTQQVSRYLLKSARAVLKGNAGDNDTTRILSEFIRRRDIGAAFDVIGNDEDLVAAFAWRVSFLTFEALRHRDEDKQSWNSLLVDFWRLSTAHAQYMVVKNFHEALNDPDTKKSVEPNTITLLHKLFRLYALNTLEKEASEFYSSAAVTVRQITLARTKAVMTLLEEIRPHALRLVDAWKFPDWQLDSSLGRYDGKVYEDMFHRASELNPLNSVVFDPYPDSKVLFKKDERQNLRSKL

SEQ ID NO: 2927 - protein, 696 aa, Hordeum vulgare
MATMSRSGYGSENEDSTPAMRRLRRLSLHLLQPSDRPAPEGANSLVPAACAGKRRAGGLDADVAALTSYLRGRHRATQERLYRFFVERPELHTPVELPMAAHRELCLRQMVALVREAGVRPLSLMADDPAEYFAVMEAVGGLDISLAIKVGVQYSLWGGSIINLGTKKHREKYFDKIDNLDYPGCFAMTELHHGSNVQALQTTATFDPVTDEFIIDTPNNGAIKWWIGNSALHGKFATVFARLILPLQGKGGEPADMGIHAFIVPIRDLETHAVLPGIEINDCGHKIGLNGVDNGALRFRSVRIPRDNLLNRFGDVARDGKYTSSLPTINKRFAATLGELVGGRVSLAYSSVGILKVAVTIAVRYALLRQQFGPPKQPEISVLDYQSHQHKLMPMLASAYAFHFARRYLVDKYSEMKKTNDEDISADVHVLSSGLKSYITSYTAKSISICRESCGGHGYAAVNHFGDLRNDHDIFQTFEGDNTVLLQQVAGDLLKQYQQKFKGGTLSVTWNYLRDSMSTYLSQPNPVTARWEGEDHLRDPKFQLDAFRYRTSRLLHSVAARLQKHMKTLGGFGAWNRCLNHLLTLAESHIESVILARFIEAVKSCPDEKTREVLKLVCDLYALDRIWKDIGTYRNVDYVAPNKAKAIHKLVDYLSYQVRLVARELVDAFDLPDEVIRAPIGLQSEAYAQYTQHIGF

SEQ ID NO: 2928 - protein, 669 aa, Hordeum vulgare
MDTSSVAKPHYEINDTKNVHLLEERQSATFNVEEFTQFMFGQSDNYYEINTRRKIIRLALAHPIHRTHLPFEYLNADEHYSLVIRKSLLAIEEAKHLKITNDKHRQWFFYIFSSGRFAFYIHDVMCTYAIETMSNEEQKRKFLPLAKSYRITTAYTQTELGHGTDLRRLETEAVFDRETDSFVLNTPTLTSTKFWPGALARSSNYALLMAHLYAPDRNHPCGNQMFLVQLRDLDTHELLPGVETGSISTRFNDCAGDNGYLRLTNVRVPRTNMLMKAAEVDRNGNFQRCGDARVLYGAMIHMRIHLSYSFAVSLAQAITIATRYSAVRFQGSNPQGKETRILDYPLQQEKLVPCLASAYAFLVTFLSLNNYFNNLKTNETVFFRQLPELHALAAGLKAYTSSVGERLAQNCRVSCGGHGFLFASGIIGIRNFLDASTSAEGDTVVLYQQTARYILKMIQRVEEDSDKGLDASIAYLRAKVWSGKTMINLEDYCHLFESRAQLLAKEALALMFESSLSPYATFLKNSIQLVQLAKAHMETYIMRSFLEQVNKAAHHPKFSVILEQLFYVFAIHTLRNESKDFIRLNLLTAEQIYELENRLLPDLYTRLRPNLVPLVDAFDFHDVELDSCLGRYDGQAYQALMERARLNPANQEKVPPIWKAIKQGALSKL

SEQ ID NO: 2929 - protein, 668 aa, Hordeum vulgare
MADAGGEPDHLTGERATAHFDVDAMKVAWAGSQHAVEVADRMARLVASDPVFRKDTRTMLSRKELFKDTLKKAAHAWKRIVELRLTEEEANLLRLYVDQPGYVDLHWGMFVPAIKGQGTEEQQKKWLPMAYKFQIIGCYAQTELGHGSNVQGLETTATFDPSTDEFVMHSPTLTSSKWWPGGLGKASTHAVVYARLITEGKDYGIHGFIVQLRSLDDHSPLPGVTLGDIGGKFGSGAYNSMDNGVLRFDHVRIPRDQMLMRLSQVTREGKYVHSDVPKQLLYGTMVYVRQTIVADASKALSRAVCIAVRYSAIRKQFGSQAGGPETQVINYKTQQSRLFPLLASAYAYRFVGQWLKWLYTDVTQKLEAKDYSTLPEAHACTAGLKSVTTSATADAIEECRKLCGGHGYLNSSGLPELFAVYVPACTYEGDNVVLLLQVARFLMKTVSQVATGNQPVGTVAYMGNIQHLMQCKSAVNTAEDWLNPAAVKEVFEARALRMAVNCAQNISKAPSQEEGFSELSPDLLEAAVAHVQLIIVTKFIEKMQEDIPGPGVKEQLQKLCSIYALHLLHKHLGDFLSTGCVTARQGALANEQLGKLYAQVRPNAVALVDAFDYTDHYLGSVLGRYDGDVYPALYEEAWKDPLNETVVPDGYQEHLRPLLKQQLKLSRL

SEQ ID NO: 2930 - protein, 665 aa, Glycine max; identical to SEQ ID NO: 92

SEQ ID NO: 2931 - protein, 679 aa, Caenorhabditis elegans
MANRSIRDGDNPELLEERRMATFDTDKMAAVIYGSEEFARRRREITDAVSKIPELADIKPYPFLTREEKVTEGTRKISILTKYLNQLIDRDNEEESLHLHREVIGYEGHPFALHDALFIPTLQSQASDEQQEKWLERARRREIIGCYAQTELGHGSNLRNLETTAVYDIASQEFVLHTPTTTALKWWPGALGKSCNYALVVAELIIKRNNYGPHFFMVQLRDEKTHIPLKGVTVGDIGPKMNFNAADNGYLGLNNLRVPRTNLLMRHCKVEADGTYVKPPHAKIGYSGMVKIRSQMAMEQGLFLAHALTIAARYSAVRRQGHLDDKQVEVKVLDYQTQQHRLFPSLARAYAFIFTGFETIHLYSQLLKDVDMGNTSGMADLHALTSGLKSVVAHETGEGIEQARMACGGHGYSMVGFENQVKKKKHFMELFQASYISVVYGIAIGGCTYEGENMVMLLQLARYLVKSVELIKAGKAKKLGPVASYLADKSDETDLTSLNGYVKMFENMARRQAWKATEKFLKLMESGESREVAWNKSAVELTRASRLHTRLFIIEAFMRRVSRIEDIPVKEVLTDLLHLHVNYELLDVATYALEFMSFTQLDYVRDQLYLYLEKIRPNAVSLVDSFQISDMQLRSVLGRRDGHVYENLFKWAKSSPLNNADVLPSVEKYLKPMMEKAKL

SEQ ID NO: 2932 - protein, 665 aa, Glycine max; identical to SEQ ID NO: 92

SEQ ID NO: 2933 - protein, 679 aa, Caenorhabditis elegans; identical to SEQ ID NO: 2931

SEQ ID NO: 2934 - protein, 665 aa, Glycine max; identical to SEQ ID NO: 92

SEQ ID NO: 2935 - protein, 679 aa, Caenorhabditis elegans; identical to SEQ ID NO: 2931

SEQ ID NO: 2936 - protein, 679 aa, Providencia rettgeri
MGKWVQGEGEGRKIHHALTNETLYTVTTEGLPLAESLQYGRQVGGEILSAMTFQQRGQMLKALAKYLLEHKAQLYAISAQTGATKADSWVDIEGGIATLFSYSGLANRELPDDTIWPEDEMIPLSKQGQFIGHHILTSRRGVALHINAFNFPCWGMLEKLAPTWLAGMPAIIKPATASAQLTQAMVKLMVDSGLVPDGAIQLVCGGVGDMFEHLDFEDVVTFTGSASTGQKLKSHPRIIAKSVPFTMEADSLNCAILGDDVQPEQPEFALFIKEVVREMTAKAGQKCTAIRRIIVPKNQLENVKQALLKRLSATTVGDPAVEGVRMGALINLEQRQDVQEKVNYLRDHGCDVLCGGQFEKLDVIGADSQYGAFYPPTLLYCAEPFNSTAVHEIEAFGPVATLMSYDNIEQAVQLAILGGGSLAGTLVTADAQVAQTVIRASARAHGRMLILNEASAAESTGHGSPLPLLVHGGPGRAGGGEELGGLRAVKHYMQRTAIQGSPSMLTAITKQWIRGADTIADVVHPFRKHFEDLAIGDTLLTARRTVTEADIANFACLSGDNFYVHVDKIGAAQSLFGERIAHGYFVVSAAAGLFVDAGVGPVIANYGMESLRFIEPVKIGDTIQVRLTCKKKIKKTQKLAEDKPNGVVEWDVQVFNQDDTVVALYSILTLVERRVGDFH

SEQ ID NO: 2937 - protein, 680 aa, Saccharopolyspora erythraea; identical to SEQ ID NO: 2217

SEQ ID NO: 2938 - protein, 669 aa, Selaginella moellendorffii
MEEAGRIDHLSGERQKAQFDLQPMKVLLAGGEHELDVAQRVAAIVARDPVFSKANRTRLSREELYKNSLRKASHGWKLIQQLKLTEEEAFKLRSLVDEPTFTDLHWGMFVPAIKGQATDEQQKYWLPLAYKMAVIGCYAQTELGHGSNVQGLETTATFDPATDEFVMNSPNLTSTKWWPGGLGKASTHALVYARLITDNHDYGIHAFIVQIRSLDDHKPLPGVTVADIGVKFGNAGYNTMDNGLLRFDQVRIPRNNMLMKLAKVTKEGKYISSDVPKQLAYGAMVYVRQSIVSDASVYLSRAVTIAVRYSCVRRQFGGQGNDPETQVIDYKTQQHRLFPLLATTYAYRIVGQWLKWLYSDVMNRLESHDFSTLPEVHACTSGLKSLTTSVAADGIEECRKLCGGHGYLCSSGLPELYAAYVPACTYEGDNVVLLLQVARFLLKTLSQLGGGVKPVGTASYLGNLPVLTKQGSRVSQGTDWLDHSNLLYAFEARAARLALVATQLVQKAGNEAGFEQHSIELIEAARAHCELMVLSKFVERLQRGVPGRGVQRQLDILCEVYGLFLLVSRAGDFLSTGCLTPTQVALAKQQLQNLYTEVRPNAVALVDAFGHTDHYLGSILGRYDGDVYPNLYKDAWEEPLNKTVVTDGYEEYIRPILQQEFLTSRKARL

SEQ ID NO: 2939 - protein, 415 aa, Selaginella moellendorffii
MSVGLPALDLSRAFPQATPASSFPPLVSDYFQLHDLLSKEDQDLRMRVRTVMEKEVAPIMAEYWEKAEFPFEIVPKMASLNIAGGTIQGYGCPGLSILGSAIAAAEVARVDASCSTFILVHSSLAMLTIAMCGSEQQKQKYLPQLAKLDTIACWALTEPDYGSDASSLSTTATKAKGGWILNGQKRWIGNSTFADVAVIFARNTETNQINGFIVRKGTPGYRATKIENKIGLRIVQNGDIVLKDAFIPDDDRLPGINSFADTNKVLAISRIMVAWQPIGVTMGVYDMCHRYLLERKQFGAPLASLQINQEKLVQMLGNIQAMALVGWRLCKLYDSGKMTPGQASLAKSWNTKRARETVALGRELLGGNGILVDFLVAKAFCDLEPIYTYEGTYEVNALVTGREVTGIASIRPRKA

SEQ ID NO: 2940 - protein, 415 aa, Selaginella moellendorffii
MSVGLPALDLSRAFPQATPASSFPPLVSDYFQLHDLLSKEDQDLRMRVRTVMEKEVAPIMAEYWEKAEFPFEIVPKMASLKIAGGTIQGYGCPGLSILGSAIAAAEVARVDASCSTFILVHSSLAMLTIAMCGSEQQKQKYLPQLAKLDTIACWALTEPDYGSDASSLSTTATKAKGGWVLNGQKRWIGNSTFADVAVIFARNTETNQINGFIVRKGTPGYRATKIENKIGLRIVQNGDIVLKDAFIPDDDRLPGINSFADTNKVLAISRIMVAWQPIGVTMGVYDMCHRYLLERKQFGAPLASLQINQEKLVQMLGNIQAMALVGWRLCKLYDSGKMTPGQASLAKCWNTKRARETVALGRELLGGNGILVDFLVAKAFCDLEPIYTYEGTYEVNALVTGREVTGIASIRPRKA

SEQ ID NO: 2941 - protein, 669 aa, Selaginella moellendorffii
MEEAGRIDHLSGERQKAQFDLQPMRVLLAGGEHELDVAQRVAAIVARDPVFSKANRTRLSREELYKNSLRKASHGWKLIQQLKLTEEEAFKLRSLVDEPTFTDLHWGMFVPAIKGQATDEQQKYWLPLAYKMAVIGCYAQTELGHGSNVQGLETTATFDPATDEFVMNSPNLTSTKWWPGGLGKASTHALVYARLITDNHDYGIHAFIVQIRSLDDHKPLPGVTVADIGVKFGNAGYNTMDNGLLRFDQVRIPRNNMLMKLAKVTKEGKYISSDVPKQLAYGAMVYVRQSIVSDASVYLSRAVTIAVRYSCVRRQFGGQGNDPETQVIDYKTQQHRLFPLLATTYAYRIVGQWLKWLYSDVMNRLESYDFSTLPEVHACTSGLKSLTTSVAADGIEECRKLCGGHGYLCSSGLPELYAAYVPACTYEGDNVVLLLQVARFLLKTLSQLGGGVKPVGTASYLGNLPVLTKQGSRVSQGTDWLDHSNLLYAFEARAARLALVAAQLVQKAGNEAGFEQHSIELIEAARAHCELMVLSKFVERLQRGVPGRGVQRQLDILCEVYGLFLLVSRAGDFLSTGCLTPTQVALAKQQLQNLYTEVRPNAVALVDAFGHTDHYLGSILGRYDGDVYPNLYKDAWEEPLNKTVVTDGYEEYIRPILKQEFLPSRKARL

SEQ ID NO: 2942 - protein, 694 aa, Selaginella moellendorffii
MEGESQRNLSDSRRNISKKDQERSASRLERLASHMAAVPLVREAQLARQECAKVKIKHQVHVSTLVEFLTQGHQSEQEKVYRFFLERPHLQTPVEIHKDKHRELCMRQLTAVVREAGIRPMDLLLNDPASYFVFTEAIGHIDLSLAIKLGVQFSLWGGSVINLGTKKHRDKYLAGISNLDYPGCFAMTELHHGSNVQALQTTATFDRLTDEFVINTPDEGATKWWIGNAAVHGKFATVFARLKLPSPDSHLDKDMGVHAFIVPIRSMEDHSVLPGVEIRDCGYKVGLNGVDNGALRFSNVRIPRDNLLNRFGDVSRDGEYNSSLPTVNKRFAATLGELVGGRVGLAYGSVGVLKASVTIAIRYALLRQQFGPPNKPEISILDYQSHQQRLMPLLASTYGFHFATQYLVNRYAEMKVTHDDEVVADVHALSAGLKAYITSYTAKALSTCREACGGHGYAAVNRFGSLRNDHDIFQTFEGDNTVLLQQVAADLLKQYKEKFQGGALSVTWNYLRESMGTYLNQTNPVVTHREGHGHLRDPNFQLDAFQYRTARLLHTAALRLRKHSQRLGSFGAWNRCLNHLLTLAESHIESVILAKFIEAVNRCPDKDVRSLLKLVCDLYALDRIWEDIGTYRNQDYVAPNKAKAIHRLVEYLSYEVRGVAKELVDGFGVPDFVLRAPIGLQNGQYSEYMQYVGF

SEQ ID NO: 2943 - protein, 694 aa, Selaginella moellendorffii
MEGESQRNLSDSRRNISKKDQERSASRLERLASHMAAVPLVREAQLARQECAKVKIKHQVHVSTLVEFLTQGHQSEQEKVYRFFLERPHLQTPVEIHKDKHRELCMRQLTAVVREAGIRPMELLLNDPASYFVFTEAIGHIDLSLAIKLGVQFSLWGGSVINLGTKKHRDKYLAGISNLDYPGCFAMTELHHGSNVQALQTTATFDRLTDEFVINTPDEGATKWWIGNAAVHGKFATVFARLKLPSPDSHLDKDMGVHAFIVPIRSMEDHSVLPGVEIRDCGYKVGLNGVDNGALRFSNVRIPRDNLLNRFGDVSRDGEYNSSLPTVNKRFAATLGELVGGRVGLAYGSVGVLKASVTIAIRYALLRQQFGPPNKPEISILDYQSHQQRLMPLLASTYGFHFATQYLVNRYAEMKVTHDDEVVADVHALSAGLKSYITSYTAKALSTCREACGGHGYAAVNRFGSLRNDHDIFQTFEGDNTVLLQQVAADLLKQYKEKFQGGALSVTWNYLRESMGTYLNQTNPVVTHREGHGHLRDPNFQLDAFQYRTARLLHTAALRLRKHSQRLGSFGAWNRCLNHLLTLAESHIESVILAKFIEAVNRCPDKDVRSLLKLVCDLYALDRIWEDIGTYRNQDYVAPNKAKAIHRLVEYLSYEVRGVAKELVDGFGVPDFVLRAPIGLQNGQYSEYMQYVGF

SEQ ID NO: 2944 - protein, 402 aa, Streptococcus anginosus; identical to SEQ ID NO: 2686

SEQ ID NO: 2945 - protein, 405 aa, Streptococcus parauberis; identical to SEQ ID NO: 2843

SEQ ID NO: 2946 - protein, 401 aa, Streptococcus parauberis; identical to SEQ ID NO: 2844

SEQ ID NO: 2947 - protein, 669 aa, Oryza sativa; identical to SEQ ID NO: 987

SEQ ID NO: 2948 - protein, 667 aa, Caenorhabditis elegans; identical to SEQ ID NO: 2144

SEQ ID NO: 2949 - protein, 669 aa, Oryza sativa; identical to SEQ ID NO: 987

SEQ ID NO: 2950 - protein, 667 aa, Caenorhabditis elegans; identical to SEQ ID NO: 2144

SEQ ID NO: 2951 - protein, 669 aa, Oryza sativa; identical to SEQ ID NO: 987

SEQ ID NO: 2952 - protein, 667 aa, Caenorhabditis elegans; identical to SEQ ID NO: 2144

SEQ ID NO: 2953 - protein, 411 aa, Tetrahymena thermophila
MAARLNDYKNQISKPSYVDSSFDYYRFTDIISKEDNEFRLKLRAWLEKEVQPTINDYVERAEFPEEYIPKIRETQVFHYLVDQPFGKGKSILTQGVMAAELSRIDAGLGTFAIVQAGLLTATIDQLGNENQRQKYVPLLRDLQLTGGWGLTENKFGSDATSLQTTVQKTEGGWLLNGDKTWIGNGNRDIMVVWARNVENNKIQGFIVDLKAKGVRSEVLKHKLALRIVQNCQITFTNVFIPEENMLSKATDFQKGTAKILLHSRLMVCWLVAGICMGVYDNVIKYISNRKQFGVPISSFQLQQEKLARIMSNTQAILLFAHRISQMYDNKKITLGQVALAKAFCTERAREVARLGREMLGGNGIIFDNYVMKAFADIEALYTYEGTYDINSLVGGRELTGVAAFKVPKKNK

SEQ ID NO: 2954 - protein, 670 aa, Xenopus laevis; identical to SEQ ID NO: 534

SEQ ID NO: 2955 - protein, 681 aa, Oryctolagus cuniculus; identical to SEQ ID NO: 344

SEQ ID NO: 2956 - protein, 694 aa, Petroselinum crispum; identical to SEQ ID NO: 112

SEQ ID NO: 2957 - protein, 670 aa, Xenopus laevis; identical to SEQ ID NO: 534

SEQ ID NO: 2958 - protein, 681 aa, Oryctolagus cuniculus; identical to SEQ ID NO: 344

SEQ ID NO: 2959 - protein, 694 aa, Petroselinum crispum; identical to SEQ ID NO: 112

SEQ ID NO: 2960 - protein, 670 aa, Xenopus laevis; identical to SEQ ID NO: 534

SEQ ID NO: 2961 - protein, 681 aa, Oryctolagus cuniculus; identical to SEQ ID NO: 344

SEQ ID NO: 2962 - protein, 694 aa, Petroselinum crispum; identical to SEQ ID NO: 112

SEQ ID NO: 2963 - protein, 706 aa, Anopheles gambiae; identical to SEQ ID NO: 2847

SEQ ID NO: 2964 - protein, 675 aa, Anopheles gambiae; identical to SEQ ID NO: 2882

SEQ ID NO: 2965 - protein, 424 aa, Oscillochloris trichoides
MHLPDVMRNLSGVTPHEVGLALKRLALKRRSKGAPPINSDFYDLRDLLGPDDVAVLTKIRTYMEERVRPVIGDYWERGEFPHELVPGFAHLVQETWATRPYAIDSLGPLLSGMACMEMARVDASIYTFFGVQWGLAMGSISMFGSEAQKAHWLPQMSRFEAIGAWSLTEPDVGSATAAGLTTTARREGDTWVINGAKKWSGNAPFADIHVVWARDLADQQVKGFLIERGTPGLHVEKLPGKIALRVVQNADIHLENCRVPERNRLPNAHSFRDVARQLAVARGGVAWAMTGVAMGAYEHALAYANQRQQFGQPIAGFQMIQNNLVQMLANVTAMQVLCTRMAQLQTRDGRISQERASLAKMFCGEKMRETVALARGVLGGNGILLEHHVARFFADAEALYSYEGTHEMNTLIVGRAITGIGAFL

SEQ ID NO: 2966 - protein, 453 aa, Croceibacter atlanticus; identical to SEQ ID NO: 2756

SEQ ID NO: 2967 - protein, 694 aa, Pyrenophora teres
MKPTPDWVKQLKPSGVQGHELLKAERENSNVPVQELEVLLHTQDAIDRRDKILKILKAEKVFDKSQNYFMGRIDKFERALAREKRLRNLKKQHSWTTEEFRTAADLVGEPGPYGLHDTMFKVTLEGQATPEQQEKWLTKANEYKIIGCYAQTELGHGSNVRGLETTATWNKEDKTFIIHSPHLTASKWWIGSLGRTANHAVVMAQLIIDGKSHGPTPFCVQIRDLKTHEPLENIHIGDIGPKFGYNTMDNGFLLFNNVKVPHISMLARYTFVDPNTNKYGRRGAPSLVYGTLTWVRSTIVMQAGSVLARGVTIATRYCAVRRQFQDRDAPAGEAETPVLNYTMVQIRLLPLLAATFALHFTGKSMMDMYQENQKKIAQGTASNAPSKRGAGPEEVQSGSDMLADLHASSCALKSLSSSIAAEGLEVCRRACGGHGYSSFSGIGPWYSDYLPTTTWEGDNYMLTQQVARYMLKSARSVLKGQKPTNDTTQILSDFHARRNIGCAFDVIGSDDDLVSAFAWRVSFLTFEASKHRDEQKKPWNDLLVDFYRLSKAQAQYMVVKTNLSALRTIEKEGKVDKNILDVLMKLFRLFAMHTLEQEGAEFYASGACSKNQISLARTNTVMNLLKEIRPHAVRLVDAWGFDDWVLDSSLGRADGKVYEDMFHRASELNPLNDITVDPYPDSDVLFKRIEKSKL

SEQ ID NO: 2968 - protein, 648 aa, Dictyostelium purpureum
MESYEQRLKNIVNHLQPTNNGGIEMVDCSADLEVNTISSNSSIPKWNKQELSQYLESAPEHIRVAKKNLLELLKDPIFAPKYNMNVQEWRELTLQRAIKVIKAGAISLAEFNRDPMKYLVSLEMLNLCDPSLSVKLGVHFSLFGNAVLNLGTEKHHLKYIKDIDSWKLPGCFGMTELGHGSNVQGVETTATYDKNTEEFIINTPSDSAQKFWIGNAALHGQACSVFAQLYIDNVHYGVHVFVVPIRNPDGTIAQNVRIMDNGHKLGLQGVDNGRIWFDNKRIPRDNLLNKFGDVQKDGTYVSSIQSKGKRFGAMVAPLVGGRVLISTSALNVSKMALMIATRYAYSRRQFGSKGNEIRIIEYLTHQRRLFPMIASSVAFTFSVEKLKRLYCEPNKNSQNVKDVHIWSSGLKAVVSWMKTNILQLCRECCGGQGFSSFNQIALFKSDLEIDMTYEGDNHVLLQQVSRNLLVELQKGRYTLTSANHDSNIHSYDFQIQSLKWRESNLVQTLSSRIMAQLDQGRSLEQGWNTCLDVVTQLGKAFVDRITLEEFQAGIKNAPSSTKPVLELCRNLFFSWKVNEDLGYFLCHDGIATQTAQKVQDSINILCAEMLPIGLDLVNSFNVPEQFIHAPIAQSDYIQEFRYGLNRNY

SEQ ID NO: 2969 - protein, 684 aa, Dictyostelium purpureum
MERLSVLCNHFDNDDNNQYLLQSNDVVATSTTNSNNQQTASVNNLLQLSSKIQLDSNKIEKLTAILFDHPDKQLQEDRNRLVDKLKDPIFEWKPYVSFHELRELTQNRLVALSHDPVLKCSEIVTNYKKFSMFQSTLVYSDMSLAVKSSVHWGLFAGSVACLGTEKHEKYFNDIDTCKMNGCFALTELGHGSNVKGVETIAEYDPATQEFIIHTPSDTAQKIWIGNAATYGCFATVFANLVSNGQNYGLHPFLVQIRDTKTLEPLKGISTADNGPKIGLNGVDNGRIWFNKVRIPKDNLLNKFGDIDNAGVYSTPIKNPNVRFNSMLESLIGGRITVANMANSAAKMGLYIAISYAFTRRQFGPTNQKEELLIDYITHQRRLFPQLAEVYINQVGINYVINKFQNKTDKDARDVFLLACGFKAATTWNRSKTLQLCRECCGGQGMAASNKIGILRADTDVDLTYEGDNTVLMQAVSKALLQEFKSYFTGTKRITGMLSYTYSKGHIGIFLRNKNFFTKRLHTESHLLDPDVLLDAFIYREFKLLRLLIKTLRGKVKNEKMSGIQAWNSSLDLVLQLANAYVERVSIEKFLEEVQKASDDIKPVLLSLCVLYELTKIENDLGWFLSNKYFAPIKGQAIGNTINKVCNSLRDHAIPLVKAFDIPSQFLTAPIIGDWVAHYSNPKNF

SEQ ID NO: 2970 - protein, 689 aa, Dictyostelium purpureum
MYCNKYKNNKTNKDLEFERNQATFSVEELNRILNDNDQNSINIKNEIKNLIESDPIISKPQEIHFLSREDQFKRVLYVCSKLRGIRQKYGEAGVMQYHNNLFEELPYIINDLVFASAFKSLASEEQLNKWYHHFLNYEYLGSYSQTELGHGSNVQAIETTATYIKETQEFEINSPTLTSTKWWVGGLGKLSTHTIVFAQLLLQDPENPNKLKNYGPHPFLVSVRSLENHQPLKGITIGDIGPKLGFNLIDNGFLRLDHIRVPRDQLLNRFFNVTADGKYIKPKHSRLIYAGMVGVRSAIIENSFVSLARSTTIASRYSVIRKQFKLSPKDNEERKVIEYANQMQRIIPHIASTFGFYFTGNRFAKEFDQMISQIKVNQDTTLLSELHANSSALKSYLTYAAAQGVSECRLSCGGHGYSHFSGIPYLQANQLHIVTAEGENNLLPQQTTKYLLSIIKKLSTSEDVDQVKLGKSVEYLRDEMKSTLKNIEEYYSGKDTSILHPDTLLQLFKHRSFNLLRILSENLQDAMMNSKDLASVWGDLNVEINHIGQAHAQLYVLQSFYDQLLKIKNSNQVSEPIKSLMDQLFQCYCLYTINNEMVDFVQDGYLDLKEVDQLRKSLTNVYKQLRPNIIPIVDSFDLCDATLGSALGNYSGNVYDTLFNWASTQAFNSNTNYTNEINNIINKSLYSKL

SEQ ID NO: 2971 - protein, 690 aa, Dictyostelium purpureum
MVLKIMSSFKMESSEINANDAFKIGKGYNEMLPFPTAINENPKDQTSKLSLTEKLKNWSIQGFEHHNIRDELNRIMSDKSLFHGDVNLGKEEQRVQTLKQLLAIAQGIFDKGLVQITDLREDPSKILAMMDIVSQFDDDSLMTKLIVNNFLFGAAVFNLGTERHHKLLPEIQSGRLLGCFAMTELGHGSNVRSLETTATYDPKTNEFIINTPLRTSTKWWIGNAGHATISSVFARLIIDGKDQEVHCFLVPIRKSNGIDLLPGIRIGDVGAKFGLNGVDNGWIQFENVRIPATNLLDRFGSVEGGVYSSPIKSPSRRFANILAQMITGRITISFGTTRTLKSGLIIATRYASKRLQFGPTSTGPEIPILSYPTHQLTIMPMIASAYAFDAIKVYLGRRFQERTDEAEIHVLASGLKAMISQYTTVSLMELRRLCGGHGYGSYSRYGRLIATVDVGRTFEGDNTLLLQQVAKDLLTQFKKEYSGNKFTGTLKYLGKNTSLLISGMNPLTTMRSDDAHLLSFQFLLDSMEFRSSKLLIQSAQTVSKNYKQTKDSFAAWNQSLEILIHLAKAHTETVIVTKFIESINKEKDIEVRSTLKKLCQLYGLYIIRQDFEFFRNSNYLKKGKAKAIIKLVGQLCSELSQNALVLVKGFGNEEHLMESPLGMEDGDLYENICKQVGGNFTRNNYLNSKL

SEQ ID NO: 2972 - protein, 422 aa, Dictyostelium purpureum
MERIQIISNHLTSGKTQDTSSTSSFDYYQLDDLLNDNDKDIRYKIKSFVDNELNKININEYYEKAEFPFEVLEKLSKLNLVGSTMKGYGCSNITPTSLGLIGMELAKSSADLATFYAILLNITMLGIYYCGSEQQKEKYLPDLASMKKIGAFALTEPNAGSDAAGLQCKAKKVDGGWLLTGEKRWIGNAPFADVIVVWARNVDTNKIHGFIVEPKTVNQKGCRIETIKNKIALRSVQNGHIYFDNCFIREDQRLPLANDFNSGPGRCLFLTRVVVGWIALGIASNAYEKCLEYVKNRQQFGQPLAQFQIIQDRLVKMMGNIQAIALMCIRVSSLYEQSKLTLGQAGLLKAFASAKAREVVSLARECFGGNGILLDQGGIGRNFVDIEGVYTYEGTYDINTLVAGREITKLSAISSNNRNFNK

SEQ ID NO: 2973 - protein, 699 aa, Phalaenopsis sp.; identical to SEQ ID NO: 579

SEQ ID NO: 2974 - protein, 699 aa, Phalaenopsis sp.; identical to SEQ ID NO: 579

SEQ ID NO: 2975 - protein, 699 aa, Phalaenopsis sp.; identical to SEQ ID NO: 579

SEQ ID NO: 2976 - protein, 405 aa, Streptococcus parauberis
MVKESRADKLFNEGEMYFSDLYNFADGLTAGEKEVLKELEEVLKNDLKPVLAENWHNATFPLEQFKKVIDLHLMDDPRLLEGREDGRISELFRGFRAYTLAKTDPVLGTFYTANGGLFHECVRVGGSQEQIDKLMPGVYSWEGLGVLAMTEPEHGSDIAGGMAATAKRDGDYWILNGHKKWIGAGTLAKWHAFFARDVDDNQVKLFYVERESEGVETFVTPEKAFFRSMPNAEIIYKDVRVHESQRAQNVNSWKDCASILRNTRSDVAWLLAGATAGAFEAALAYTRERLQFGKPIASFQLIQEKLARMAMNAQATLAIAVRLAEQQEQGIYREEASSMAKLHNGFRARETAALAREVGGGNGILLKYDIPRFFADIEGMYTYEGTHEVNSLIIGRHYTGISAFI

SEQ ID NO: 2977 - protein, 728 aa, Melampsora larici-populina
MSDESVAPVGPPDAAILRDPLQSSHSTSQGPTPSIPPWTADKSSLKQNFTVASHLKPSGTAGPKLLQIERSHASFSSEALTTYLYGQPFLDRQAKLLNIIQDEEAFDKTRLNYQGRSERFRHALRKEKRFVQLAKEHHWDAEDTAMAEMLIDMPGPFSLHKSMFLKTLTEQGDDEQQELFTRRAEKFEIIGCYAQTELGHGSNVQGLETTAMYDPKTKEFVINSPFLTASKWWIGGLGRSADHAVVMAQLITNEAKHGPHPFVVPIRDLITREPLEGRTIGDIGPKLGYQTTDNGMLLFDHVRIPHNHLLSRFSKVDPDTGVYVKPQNAKLAYGTMTYIRAGIVQQARAVLARACTVAVRYCAIRRQFVDKDAPMDGKKPAENQVLDYQMVQYRIFPIIAQAFACHYTGKEMFRLYSESQKNMAEGDFSLLADVHASSSGLKSLTTIMAAQAIEECRRACGGHGFSQASGLGALYADYLPQVTWEGDSYMITQQTGRYLFKTMRTLYADPNAKLSAENVTGEYILRYLSNPEAKSPVRYSGDFHDVEAFVLAFGHRAAYLIAQATRKRDIERRTWNSLLVDIYRCSVAHCQFILVRNFAQAILHDSALKTNPALHQIVKVVFELFACHTMDIEASEFLASGYINPSQHTLLRNRVYALLAQIRPEAVALVDSLAIPDYLLNSELGRYDGNVYENLIAFAAREPLNGVRFNVNPWDEELAIGEPKLSKL

SEQ ID NO: 2978 - protein, 738 aa, Melampsora larici-populina
MSNASKTPSTMETISKERENCPFDLWRMTCAMHGGEEWAKLKGTMMIEIERDPSFRLDDIHDLSKDQIRERTMMKFANMIHYVTTERLDIFTKRMELIGIADPSFWTRFGVHYGLFLGAIRSGATSNQFSYWMEKGVLGMNGLVGCFGMTELNHGSNVAGLETTSTFDEKTDEFVIHTPSLSATKWWIGGAAQTATHCSVFARLIVKGKDYGTKTFIVPLRDPRNFALLPGVNIGDIGKKMGRDGIDNGYIQFTYVRIPRAYMLMKHTQVTRDGQVYEPPLAQLTYGALLQGRTAMVADGANVSKKALTIAVRYGAVRRQFKTGDNELETQLLDYPIHQRRLMPLLAQAIAMGFTALRMTKMFEKLTEELESFDSSSDTEQTERVLETLKETHASSAGLKAFSTWQCLDTIDKCRQTLGGHGYSAYAGLASMYADQAVQCTWEGDNTILSLQAGRSLISAYQDAQKGKKVSTGVAYLDDKSVLTNKCPSDTKCVDLNTMNSAWATISANVVKKAAEVYDTKLKSGVNKDVAMEGCSHERFCAAKIHTMGYLYRQFLDALETLESEEPSGSTTVSTLRTICQLYGAFQIEENAAYFLKYGFYTAKQMDIISEKINQLCAEVRTYAVSLVDSFYYSDHIINSPFGRYDGNVYAAYFNAVRAANPLPPVHPYFDRLIKPLLTRKPLEMEDAASMSIDEEIEEIQQERLSGEGEVDQGDGSLSLTEDQKLETEGTAEWEKKR

SEQ ID NO: 2979 - protein, 690 aa, Cucurbita sp.; identical to SEQ ID NO: 355

SEQ ID NO: 2980 - protein, 690 aa, Cucurbita sp.; identical to SEQ ID NO: 355

SEQ ID NO: 2981 - protein, 690 aa, Cucurbita sp.; identical to SEQ ID NO: 355

SEQ ID NO: 2982 - protein, 405 aa, Streptococcus parauberis; identical to SEQ ID NO: 2976

SEQ ID NO: 2983 - protein, 622 aa, Danio rerio
MLLSSIDQMPSSSLARYLDGEFWEIKDAFRDAISKSDLFQSSCYERTLDQNRDLTADRLYHILRQPVMKEHLKNQLKEKQKGFINKSMSITEVVCAADMNTGVKLGVVCGLYGGAVNNLGSPEQKIKFYLPVSELQFTGMFAMTERGHGSNVRGIITEARYDQPTQEFIIHTPSEDAHKMYIGNAMKGNFAAVFAQLIINGESQGPHCFVVPIRDENGVMWPGVTVSDMKHKEGLHGVDNGILIFDNVRIPRENLLGKFGSVSADGLYSSPALRGNRFNAMLAALTPTRLGLTVQAMAAMKLGLIIAVCYSHSRRQFGPKDQEEVKIMEHQTQNLRLMPHLSAALALTFTSRYAADLMDDALCKGEDLQSNRALQALVAGLKAYSTWANVACLQDCRECTGGMVVVRELLTQYTKQMGNNLVMGLIRNLTSSASDSLRTSFLGFSVDKVGDLMFLLKAVRYRERVLQRSLASRLYTKVDKNKEEFFMAWNSCLHHVITLAMAHIHRVTLEQFALAVQDCQIKEDRALLSKFCLLHGTSLVYQERAWYLEHKYLTPTTSRQIRSQLLELCRSVKDDALKVVDDFNIPSCCIQAPIAGIANPRAEWAFYPKPEYPSSTQPLSKL

SEQ ID NO: 2984 - protein, 671 aa, Salpingoeca sp.
MDGSVGVGGRGPLDEERKGAEMDVDAVMALLAGSPEVVEKRRQIRRVIEADEVMSVDDYYFCDRTRRYERALEKTVRFVQLVRMHGWKDQDAIYARRCIREQLPVGLHWAMFIPCIKGQGTKEQQAKWLPLAETMQIVGTYAQTELGHGTFLRGLETTATYDPATESFILNSPTLTSTKWWPGSLGKTATHCVVMARLITKGRDYGTHAFIVQIRDLDTHRPLKGITVGDIGPKFGYDSMDNGFLRFDSVAIPRAHLLSRYAKVAVDGSYSKPLNTKLSYGTMIFVRSHMIMDAALHLKAATTIAVRYGAVRRQSLMDETDTTESKILDYTVQQETLFELLGAAFAFHFAGRILSDLYHRLQASLSSNDLSLLSYTHGTTSGLKAYCSTITSEGIEACRRCCGGHGYSKFSGLPDLYTDYVPACTYEGENVVMYLQCARYLLKMVAAIEQKDPVPSDLAYLGDRSLAAAARKLTSTHGVKNLDNLLLILRAIAVVRIMEAHGALISAQQRYATSGRAWNACAPVLMKAAQAHCRIMVFNYLLEGVRAAHLDDKTHGVLVSLTRFYGLRLASYDVVETDVLTRQAIANMKQAAEDERTVIRRNAVALVDAFDLSDFFLNSALGRADGRVYEALYEYAQKEPMNQHEVSPAVEQHLLPLMQTTRRIFGGQSKL

SEQ ID NO: 2985 - protein, 422 aa, Dictyostelium purpureum; identical to SEQ ID NO: 2972

SEQ ID NO: 2986 - protein, 690 aa, Dictyostelium purpureum; identical to SEQ ID NO: 2971

SEQ ID NO: 2987 - protein, 689 aa, Dictyostelium purpureum; identical to SEQ ID NO: 2970

SEQ ID NO: 2988 - protein, 684 aa, Dictyostelium purpureum; identical to SEQ ID NO: 2969

SEQ ID NO: 2989 - protein, 648 aa, Dictyostelium purpureum; identical to SEQ ID NO: 2968

SEQ ID NO: 2990 - protein, 707 aa, Clavispora lusitaniae
MSSIASVKGTVSFSQGPEPKNLIQRERDAATFDLNEMNYFLEGSKERAMETRLFISQFERDPVMAASPKDYDATKAEHRAITIQKIDRLSRYIEVETFDRLERRLSIVSVFDPSFHTRLGVHLGLFLGCIRGNGTADQMQYWLLKKEAAYVKNLYGCFGMTELAHGSNVAGLETTATFNEEDDEFIINTPHLGATKWWIGGAAHSATHCCVYARLIVKGKDYGVKTFVVPLRDADHNLMPGITIGDIGAKMGRDGIDNGWIQFSNVKIPRFFMLQKYCKVSSDGEVTEPPLNQLSYSALLLGRVIMVKDAFRWSARMVTIALRYAVGRTQFKAALAKESDPESQLLNYPLHQRRLIPLLALTYAFSNGANVLQETSTATMDELDDAVSSEDKQALDASVEKMKSLFIASGSLKSTCTWLTLNTIDQCRQACGGHGYSAYSGFGKAFNDFAVQCTWEGDNNILGMSVGKQLIKKFAAVKKGEKATGILDFLGGYEKLAGTNPVLEAKDLKEPKKILFAIEVALVRACIRADQILESKNGDTDFIGAELVTLSKLLAHFFLLKAFLDKIEATKDQPNLVAVLDLLAQLYGATVILEGFSGTFLTFSVTTTEAIAHNSTEHIAELCSKIRPHVIPLTDSFMMSDMMINAPIGYYDGNIYENYMRTVQENNPAKNHKAPYSAALEAMLNRSSLAERQRFEREEEAEEILSN

SEQ ID NO: 2991 - protein, 671 aa, Oryza sativa
MATAASRSGRRRGGENDEDDRTAAMPRLGVLSLQLQDPSPSSEAGLAPAACAAAGRRRATGGADAAAALAAYLRGRHRDTQARVFEFFLSRPDLQTPVEMSTAAHRELCFRQLCALVREAGVRPLSLMANDPAEYFAVMEAAGGADISLGVKLGVQYSLWGGSIINLGTKKHRDRFFDGIDNLDYPGCFAMTELHHGSNVQALQTTATFDPVTDEFIINTPNDGAIKWWIGNAALHGKFATVFARLILPLQGKGGDPADMGIHAFIVPIRDLDTNAVLPGIEINDCGHKIGLNGVDNGALRFRSVRIPRDNLLNRFGDVSRDGKYTSSLPTINKRFAATLGELVGGRVGIAYSSVGILKVSVTIAVRYALLRQQFGPPKKPEISVLDYQSHQHKLMPMLASSYAFHFATRYLVDKYSEMKKTNDEDVMADVHVLSSGLKAYITSYTAKSISTFEGDNTVLLQQVAGDLLKQYQEKFKGGTLSATWNYLRDSMGTYLSQPNPVTSRWEGEDHLRDPNFQLDAFRYRTSRLLHSVAARLQKHSKTLGGFGAWNRCLNHLLTLAESHIESVILAKFIEAVKRCPDEKTRELLKLVCDLYALDRIWKDIGTYRNVDYVAPNKAKAIHKLADYLSYQVRLVAQELVDAFDLPDLIIRAPIGMQSEAYAQYTQHVGF

SEQ ID NO: 2992 - protein, 430 aa, Oryza sativa; identical to SEQ ID NO: 2012

SEQ ID NO: 2993 - protein, 430 aa, Oryza sativa
MGSLAGGGGGGKVGLPALDVALAFPQATKASQFPPAVSDYYQFDDLLTDEEKTLRKKVRGIMEREIAPIMTEYWEKAEFPFHAIPKLATLGLAGGTTKGYGCPGLSLTASAISVAEVARVDASCSTFILVHSSLAMSTIALCGSEAQKQKYLPSLTQFRTVGCWALTEPDYGSDASSLRTAATKVPGGWHLDGQKRWIGNGTFADVLIILARNSDTNQLNGFIVKKGAPGLKCTKIENKIGLRMVQNADIVLNKVFVPDEDRLTGINSFQDINKVLAMSRIMVAWQPIGISMGVFDMCHRYLKERKQFGVPLAAFQLNQEKLVRMLGNIQAMLLVGWRLCKLYESGKMTPGHASLGKAWTSKKAREVVSLGRELLGGNGILADFLVAKAFCDLEPIFSYEGTYDINSLVTGREITGIASFKPAALTKSRL

SEQ ID NO: 2994 - protein, 677 aa, Drosophila sechellia
MSHIKNLIPSTVNPFLQKERAEAEFNVEEFSAWWHGGQDKLKKKREIEKAIFSDLEDGYGLNHEYMSHEEVYNSTVKKVAEASVKLKALQNKLNPGGTDIWPGGLFNAQSFGLFPANHPVATHITMFVDVIKGQGTAEQVEKWGKPAENCNIIGTYAQTELAHGTNVRGLATRADFDPKTDEFVLNTPNLEAYKWWPGGLGHTANHAMVVAQLYIADVHHGVQMFIVPVRDSETHMALPGVDIGEIGKKLGMASVNQGFLGLNHVRIPRTNMLMKFAKVERDGTFKASPASRINYLTMVYTRCLIVSQNSTLLLAAATIATRYSAVRRQSPIEPNQPEPQIIDHVTQRLKLFPEIATGIAYHLATEYVWEMYAQTVQEANNGKFERLPDMHILSCALKVLCTTDGCAGIEKLRLSTGGHGYLTAANLSNIYGNAVAAYTYEGENTVLLLQIGRALVKAWASFVDKKPLSASYSYFASSMQLKEFPKWDDSWQCIIKALQYTAAHKTRIAFENLANRMASGQSQGVAANNTGIELTRAAELHGRQFVCQTFLEQITGAKAQKRSPALNKILENVLELFLVQTVLNNLNDILRFIKLSDADLRSLQKRLEDSLEQFRPNAVAICDGFEFHDRVLNSVLGSYDGNVYPRLFDSAKRSTMNQKPVQTSFESYLKPLMKAKL

SEQ ID NO: 2995 - protein, 677 aa, Drosophila persimilis
MSHIKKLIPKTVNPDLLKERTDAEFNVEEFAAWWQGGQEKLNTKREVERAIFSDLEDGYGLNHEYMSHEDVYNSSVKKVAEAAVKLKALQNKINPGGNDIWPGLLYNVESHGLFPANHPLATHITMFVDVINGQGTPEQVEKWGKAAENCNIIGTYAQTELAHGTNVRGIATRADFDPKTDEFVLHTPNLEAYKWWPGGLGHTANHAMVVAQLYIADVHHGVQMFIVPVRDAETHMPLPGVDIGEVGKKLGMVAVNQGFLGLDNVRIPRTNMLMKFAKVERDGTFKASPASRVNYLTMVYTRCLIVNLTSTLLLEAATIATRYSAVRRQSPFEANQPEPQIIDHVTQRLKLFPEIANGMAYHLAAEHMWEIYAQTVEEANSGKFDRLPDMHILSCALKVLATTDGCAGIERLRLSTGGHGYLTAANMSNIYGNAVAAYTYEGENTVLLLQIGRALVKAWAAFVEKKPVSASYGYFATSMQLKQSPKWDNSRQCIIQALQYTAAQKTRIAFENLAERMASGQSQGVAANNTGIELARAAELHGRQFVCQTFLEQVTGPKAQKRSAALNKILENVLELFLVQTVLNNMNDVLRFISLTDADLKSLQKRLEVALEKFRPNAVAVCDGFGFHDRVLNSVLGSYDGNVYPRLFDSAKRSTMNQKPVQKSFETYLKPLMKANL

SEQ ID NO: 2996 - protein, 725 aa, Meyerozyma guilliermondii
MCILPPQFACYKAGFCHKYLNYTMEVKNTIQSGNIPTPALAIQAERAKATFDPELMNHFLEGSKEKSDEIKQMIQQMERDPILQVSSKVYDMTKAEHRLETARKIARLASYIESENFSSFENRMSLVSLMDPQLHTRIGVHLGLFLGCIRGNGTSEQMYYWVLNKEAAYVKQIYGCFAMTELAHGSNVAGLETTATYDVENEQFVINTPHIGATKWWIGGAAHSATHTTVYARLIVKGKDYGVKTFVVPLRDSNHNLNPGVVVGDIGAKMGRDGIDNGWIQFSNVRIPRYNMLQKYCKVSADGEVTEPPNNQLSYSALLGGRVVMVKDSFRWSAKVVTIAIRYAIARRQFKASKAGENDGENQIMNYPLHQRRLIPLLATAYAFSNGANVLDQLSKKTMDSLDHAVSQDDKAGIDKGIEEMKSLFVASGSLKSTCTWSTLNTIEQCRQACGGHGYSSYSGFGKTYNDWAVQCTWEGDNNILGMSIGKQLVKNISGVIKDGNKATGILDFLNNTKQYLNNEIVLKKDQLESLEQVLKAVEVALIRTANQALADLDKNGEDWDYIGARLVELSKMLAHFFMLKSFLEKFNTLEEGPMKSVLKQLAQLYSSSVILEGFSGIFLTFKVLDSDTVSYLSSEYIQKLCADLRPHVIPLTDAFNLSDMIINSSLGNYDGNVYENFFKIVKDRNPAPGSYTAPYEEEFRAHLNRPSLEDRQRNEINEDNEELV

SEQ ID NO: 2997 - protein, 706 aa, Meyerozyma guilliermondii
MSVSTNTVTSLPGPDPQASFRQERENQKFDPVQMHYFLEGSKARAEAIKRLTQQMERDPVLASDSSIYDLNKEQQRELTAVKINRMARYIENDDPKDFNLRMSLFGLFDPQVATRIGINLGLFLSCVRGNGTPEQIEYWTFNKETAGLKSIYGCFGMTELAHGSNVAGLETTATYDEATEEFVINTPHIGATKWWIGGAAHSSTHCSVYARLIVKGKDYGVKTFVVPLRDSNHDLMPGVTVGDIGAKMGRDGIDNGWIQFSDVRVPRFFMLQKFCKVSKEGKVTLPPLEQLSYSALLGGRVSMVLDSYRMSAKMSTIALRYAVARRQFKGSSSSDGKETQLINYPLHQRRLFPYLAQAYVLSAAALKVEHTIEQTLDDLDAAVASNDMPAIMRSIDGMKSLFIDSGSLKSTSTWLGAEAIDQCRQACGGHGYSSYSGFGKAYNDWVVQCTWEGDNNVLAMSVGKPIVRSISEVLDKGKKVRGSTSFLNHTKENLGETPVISNVSDLQDLKKILTAIEVLIMRLGADAVKTIKANGGNQDSVSPQLVVISKLKANHYALEEYIRRVDTHDNSELKPYLLSLGRLYAASMIIDRFAGDFLTYSVLSTKVVAENNSINLPKLCEEVRPHVITYTDSFQLSDMIINSAIGKFDGNVYENYFGIVKANNPPFKTKAPYSGSLEAMLNRPAKEERERFEKIGQAKQFLSKGL

SEQ ID NO: 2998 - protein, 735 aa, Sclerotinia sclerotiorum
MSPPQWVKDLKPSGPQGTELIKAEREKSNINVEKLSNFLFTKEVLERQENVLRILQADKVFDKSNNYFDGRVDRFKSSLAKAKRLRQLQVKHNWSEDEFRVANDLISEPTPFGLHETMFLTTLRGQGTPEQHKLFLEPAENYKYIGCYAQTELGHGSNVRGLETTATWNPEDKTFILHSPHLTASKWWIGSLGRTANHAVVMAQLIIAGKPYGPHPFVCQIRDLVTHEPLEGVYVGDIGPKFGYNTMDNGFLLLNHVKIPHINMLAKFSRVDPETNKYVKPSSPSLIYGTLTWVRSTIVLQSGGVLARGVTIATRYASVRRQFQDRDAGPDASGENQVLNYTMVQYRLLPLLAATFALHFTGKAMMGLYQDNQKRMQENAATASDNNRGAGPEELNSGSDLLADLHATSCGLKALGSTTAAEGLEVCRRACGGHGYSSFSGIGTWYADYLPTTTWEGDNYMLTQQVARYLLKSARAVLKGNAPNNDTTRIFTTFLQKQDMGAAHDILGSDSDIVAAFAWRTSFLAFEALKHRDAEKGSWNSLLVDFWRLSTAHSQYLVVKNFYDALQSESLRYELDPETIDVLHKLYRLYALNTLEKEASEFYSSAAVTVRQIQLARTKTVMNLLSEIRPHALRLVDAWAFPDWQLDSSLGRKDGKVYEDMFYRASQLNPLNGLTVDPYADNDNIVKRDETERFRREREWEDEKYKGITPPLPADFKKKINYREKKEDSSENLWV

SEQ ID NO: 2999 - protein, 698 aa, Botryotinia fuckeliana
MTPPQWVKDLKPSGPQGTELIKVEREKSNIHVEKLSNFLFTKEVLERQERILKILQADKIFDKSNNYFDGRVDRFKTSLARAKRLRQLQVKHNWNQEEYQVANELISEPTPYGLHASMYLTTLRGQGTPEQHKLFLEPAENYKAIGCYAQTELGHGSNVRGLETTATWNPEDKTFILHSPHLTASKWWIGSLGRTANHAVVMAQLIIAGKPYGPHPFVCQIRDMKTHEPLDGVYVGDIGPKFGYNTMDNGFLLLNQVKIPHINMLAKFSSVDPETNKYVKPSSPSLIYGTLTWVRSTIVLQSGGVLARGVTIATRYASVRRQFQDRDAGADASGENQVLNYTMVQYRLLPLLAATFALHFTGKAMMGLYQDNQKRMQQSATNTSDSSRGAGPEELNSGSDLLADLHATSCGLKALGSTTAAEGLEVCRRACGGHGYSSFSGIGSWYADYLPTTTWEGDNYMLTQQVARYLLKSARAVLKGNAPNNDTTKIFTTFLQKQDMGAAHDVLGSDSDIVAAFAWRTSFLTFEALKHRDAEKGSWNSLLVDFWRLSTAHSQYLVVKNFYDALQSESLQHELDAETIDVLHKLYRLYALNTLEKEASEFYSSAAVTVRQIQLARTKSVMKLLGEIRPHALRLVDAWAFPDWQLDSSLGRKDGKVYEDMFYRASQLNPLNGLTVDPYADNDNIVKSDETERFRSKL

SEQ ID NO: 3000 - protein, 669 aa, Oryza sativa; identical to SEQ ID NO: 987

SEQ ID NO: 3001 - protein, 433 aa, Oryza sativa; identical to SEQ ID NO: 2013

SEQ ID NO: 3002 - protein, 669 aa, Oryza sativa
MEGGVGGEVDHLAGERATAQFDVEHMKVAWAGSRHAVDVADRMARLVASDPVFRKDNRTMLPRKELFKDTLRKAAHAWKRIVELRLTEEEANLLRLYVDQPGYVDLHWGMFVPAIKGQGTEEQQKKWLPLAYRFQIIGCYAQTELGHGSNVQGLETTATFDPKTDEFVIHSPTLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTKEGKYVHSDVPKQLLYGTMVFVRQTIVADASKALSRATCIAVRYSAIRKQFGPQTGGPETQVLNYKTQQSRLFPLLASAYAFRFVGEWLKWLYTDVTHKLEAKDFSTLQEAHACTAGLKAVTTSATADGIEECRKLCGGHGYLNSSGLPELFAIYVPACTYEGDNVVLLLQVARFLMKTVSQLASGKQPVGTTAYMGNIQYLMQCKCGVNTAEDWLNPAAIREVFEARALRMAVNCAQNINKAPSQEEGFYELSPDLLEVAVAHIQLIIVTKFIEKLEQDIPGEGVKEQLRILCNVYALYLVHKHLGDFLSTGSITARQGALANEQLGKLYAQVRPNAVALVDAFNYTDHYLGSVLGRYDGNVYPALYEEAWKDPLNDTDVPDGYQEHLRPLLKQQLKLSRL

SEQ ID NO: 3003 - protein, 433 aa, Oryza sativa; identical to SEQ ID NO: 2013

SEQ ID NO: 3004 - protein, 681 aa, Rhodococcus equi
MSLLLQSYVQGRWHTAPDEGTPLLSAVDGSEVARISSTGVDVAGMIDYARTVGAPALAQLTFHERALALKSLALTLMAGKEEFYTLSAVTGATRKDSAVDIDGGFGTLLSYASKARRELPNDTVYLDGAPEQLGKRGTFVGQHVYTARRGVAVQINAFNFPVWGFLEKLAPAFIAGVPSIVKPASQTAYLTELVFRRIIESGLLPEGSVQLLCGSAHGILDHLSGQDSVAFTGSADTAAVLRAHPNVVSEGIRFNAEADSLNASILGTDVSADSEEFGLFVEQLVTEMTVKAGQKCTAIRRAFVPEQLVDQVVAATSARLRDVVVGAPGAEGVTMGALASIEQRDEVIKSLRALTESARIVHGDPDEVEVVGGDSAAGAFMSPILLRCDDRDATEPHEVEAFGPVSTILGYRDNTDVIELVARGKGSLVASLVTADSAIARELVLGLAPYHGRLLILDRHDARESTGHGSPLPVLVHGGPGRAGGGEELGGIRGVLHHMQRTAIQGTPNVLTAVGQRWVVGADRSQSDRHPFRKNLSELALGDAIVGGPRRVTRSDIDHFAEFTGDTFYAHTDPEAAEANPLFGGIVAHGYLVVSLAAGLFVDPAPGPVLANFGVDNLRFLTPVKADDELTVTLTAKQVTPRASADYGEVRWDAVVANQDGDAVATYDVLTLVAKSTGETR

SEQ ID NO: 3005 - protein, 681 aa, Rhodococcus equi; identical to SEQ ID NO: 3004

SEQ ID NO: 3006 - protein, 676 aa, Pseudonocardia sp.
MTLLRSHLAGTWQTGTGEGRPLHDAVTGEEVARISADGLDLGAALDFGRRTGGPALRELTFHQRAALLKALGQHLREHREELYAVSAQTGATLGDSKFDVDGGIGVLLAYASKAKRELPNDTVVVEGDVEPLGRGGTFLGQHVLTPLRGVTVQVNAFNFPVWGPLEKLAPAFLAGVPTLIKPASPTAFLTAKLVELVVDSGLLPTGAVQFVAGGLGDCFEHLTGQDVVSFTGSASTAQTLRSHPAIVRNAVRFSAEADSLNLAALGPDAGPGTDEFDLFVKALTTEMTVKAGQKCTAIRRAFVPSAHLDAVVEAASARLATVVVGAPGAEGVRMGALASLDQREEVRRSVKALRDAGRIVSGDPDHVEVTGADADRGAFVSPLLLVGDPDRAEPHEVEAFGPVATVLPYDTTDRLVEYAARGQGSLAGSVVSADPAFVREVVLGIAPFHGRVHVLNARDAGESTGHGSPLPQLVHGGPGRAGGGEEMGGIRGVLHHMQRTAVQADPDSLAAITGRWVTGAQRHESDVHPFRRHLEELRPGDCLVAGPRRVTREDVEHFAEFTGDTFYAHMDEAAAAANPLFGQRVAHGYLVVSLAAGLFVDPDPGPVLANFGVDGLRFLTPVRFDDELTVTLTCKQLTPRESAGYGEVRWDADVTRQDGESVARYDVLTLVAKKDS

SEQ ID NO: 3007 - protein, 675 aa, Amycolatopsis mediterranei; identical to SEQ ID NO: 2676

SEQ ID NO: 3008 - protein, 845 aa, Dokdonia donghaensis
MILESYINGHWVKGDDSNTRNMYDAITGDVIGLTSTEGLDIASALQFGRDNGKALRDMTFQQRGNMIKKLALYLNKRKEQFYEISYKTGATRADSWVDIEGGFGNLFANASLRKLFPDQSYAVEGDAIDLSRGGRFMAHHILVPKKGVAVHINAFNFPVWGMLEKCAVNWMAGMPAVVLPAPQTAFLTEAVVREIINSGILPKGSLQLLSGLTTSILDTVNSQDVVTFTGSAHTGRKLKVHPRLTEESVPFTMEADSLNASILGPDAVPGTPEFAIFIKEVRKEITSKCGQKCTAIRRVIVPENLMEDVQIALGKQLERTVIGDPKLREVRMGALINNDQRDAIKTQIAKIAQTADMVYGSTDTIEAMGADGAKGAFMSPIVMRENNPFKNTQVHEIEAFGPVTTLMPYNGVEEAIELAQMGKGSLVSSVVTADDAFAKAYTIEAASHHGRILTLNRDSAPQSTGHGSPLPLLVHGGPGRAGGGEEMGGIRGIKHYMQRCAVQGSPTSLTEITGIYQPNGDYKEAEQHPFAYHYEDIKPGMSLKTHKRTITDNDIQNFANLTWDHFYAHTDITSLDGSIFEKRTAHGYFIISAAAGLFVYPNKGPVSANYGLEDIRFLRPLYHNDTIYVRLTCKEKRERDVSGREHPSGIVKWYVEVFDAEPVDYENGKTDEEAEALVAVATILTMVEKKQTTFVEMTESRIDTCLSKLNQDTKPVWGAMTPQQMVEHLELTYRIAAGEIQDFEVATPDKLLDKVAATLWDYNKMPRDYNFPLYEAGIQPALQHKDLDEAKKAMLNARKAYLDFYKKNKKATTNNAVFGKLNKYEWYLMERKHLNHHFEQFNLLD

SEQ ID NO: 3009 - protein, 748 aa, Saccharomyces cerevisiae
  MOD_RES (214)..(214): Any amino acid
  MOD_RES (540)..(540): Any amino acid
MTRRTTINPDSVVLNPQKFIQKERADSKIKVDQVNTFLESSPERRTLTHALIDQIVNDPILKTDTDYYDATKLQEREITAKKIARLASYMEHDIKTVRKHFRNTDLMKELQANDPDKASPLTNKDLFIFDKRLSLVANIDPQLGTRVGVHLGLFGNCIKGNGTDEQIRYWLQERGATLMKGIYGCFAMTELGHGSNVAQLQTRAVYDKQNDTFXIDTPDLTATKWWIGGAAHSATHAAVYARLIVEGKDYGVKTFVVPLRDPSTFQLLAGVSIGDIGAKMGRDGIDNGWIQFRNVVIPREFMLSRFTKVVRSPDGSVTVKTEPQLDQISGYSALLSGRVNMVMDSFRFGSKFATIAVRYAVGRQQFAPRKGLSETQLIDYPLHQYRVLPQLCVPYLVSPVAFKLMDNYYSTLDELYNASSSADKAALVTVSKKLKNLFIDSASLKATNTWLIATLIDELRQTCGGHGYSQYNGFGKGYDDWVVQCTWEGDNNVLSLTSAKSILKKFIDSATKGRFDNTLDVDSFSYLKPQYIGSVVSGEXKSSLKELGDYTEIWSITLIKLLAHIGTLVEKSRSIDSVSKLLVLVSKFHALRCMLKTYYDKLNSRDSHISDEITKESMWNVYKLFSLYFIDKHSGEFQQFKIFTPDQISKVVQPQLLALLPIVRKDCIGLTDSFELPDAMLNSPIGYFDGDIYHNYFNEVCRNNPVEADGAGKPSYHALLSSMLGRGFEFDQKLGGAANAEILSKINK

SEQ ID NO: 3010 - protein, 748 aa, Saccharomyces cerevisiae; identical to SEQ ID NO: 976

SEQ ID NO: 3011 - protein, 748 aa, Saccharomyces cerevisiae; identical to SEQ ID NO: 976

SEQ ID NO: 3012 - protein, 659 aa, Saccharomyces cerevisiae
  MOD_RES (633)..(633): Any amino acid
MEHDIKTVRKHFRNTDLMKELQANDPDKASPLTNKDLFIFDKRLSLVANIDPQLGTRVGVHLGLFGNCIKGNGTDEQIRYWLQERGATLMKGIYGCFAMTELGHGSNVAQLQTRAVYDKQNDTFIIDTPDLTATKWWIGGAAHSATHAAVYARLIVEGKDYGVKTFVVPLRDPSTFQLLAGVSIGDIGAKMGRDGIDNGWIQFRNVVIPREFMLSRFTKVVRSPDGSVTVKTEPQLDQISGYSALLSGRVNMVMDSFRFGSKFATIAVRYAVGRQQFAPRKGLSETQLIDYPLHQYRVLPQLCVPYLVSPVAFKLMDNYYSTLDELYNASSSADKAALVTVSKKLKNLFIDSASLKATNTWLIATLIDELRQTCGGHGYSQYNGFGKGYDDWVVQCTWEGDNNVLSLTSAKSILKKFIDSATKGRFDNTLDVDSFSYLKPQYIGSVVSGETKSSLKELGDYTEIWSITLIKLLAHIGTLVEKSRSIDSVSKLLVLVSKFHALRCMLKTYYDKLNSRDSHISDEITKESMWNVYKLFSLYFIDKHSGEFQQFKIFTPDQISKVVQPQLLALLPIVRKDCIGLTDSFELPDAMLNSPIGYFDGDIYHNYFNEVCRNNPVEADGAGKPSYHALLSXMLGRGFEFDQKLGGAANAEILSKINK

SEQ ID NO: 3013 - protein, 664 aa, Gossypium hirsutum
MEALDYHAEERRKAEFDLEEMKIVWAGSRQNYEISDRMARLVASDPVFRKDNRTMLSRKDLFKDTLRKAAHAWKRIIELRLSEEEAHMLRSYVDQPAFTDLHWGMFLPAIKGQGTEEQHEKWLPMAYKMQIIGCYAQTELGHGSNVQGLETTATFDPQTDEFVIHSPTLTSSKWWPGGLGKVSTHAVVYARLITGAQDHGVHGFIVQLRSLDDHSPLPGITVGDIGMKFGSGAYNSMDNGLLRFDHVRIPRNQMLMRVSQVTREGKFVQSDVPRQLVYGTMVYVRQTIVSDASCALARAVCIATRYSAVRRQFGSQNGGPETQVIDYKTQQSRLFPLLASAYAFRFVGEWLKWLYTDVTQRLQANDFSTLPEAHACTAGLKSMTTSVTADAIEECRKLCGGHGYLSNSGLPELFAVYIPTCTYEGDNVVLLLQVARFLMKTVSQLGSGKKPVGTTAYMGRAEHLMQCHCEVERAEDWLKPSVILEAFEARAFRMSIACAKNLSKFSNPEDGFSELSPDLLEAAIAHCQLIVVSKYIEKLQQDIPGKGVKRQLEILCNVYASHLLHKHLGDFVTTSCITPKQGALANEQLRLLYSQVRPNAITLVDAFNYTDHYLGSVLGCYNGNVYQRLYEEAWKDPLNDTVVPDGYLEYVRPILKQHIRTARL

SEQ ID NO: 3014 - protein, 664 aa, Arabidopsis thaliana; identical to SEQ ID NO: 146

SEQ ID NO: 3015 - protein, 664 aa, Arabidopsis thaliana; identical to SEQ ID NO: 68

SEQ ID NO: 3016 - protein, 664 aa, Arabidopsis thaliana; identical to SEQ ID NO: 146

SEQ ID NO: 3017 - protein, 664 aa, Arabidopsis thaliana; identical to SEQ ID NO: 68

SEQ ID NO: 3018 - protein, 664 aa, Arabidopsis thaliana; identical to SEQ ID NO: 146

SEQ ID NO: 3019 - protein, 664 aa, Arabidopsis thaliana; identical to SEQ ID NO: 68

SEQ ID NO: 3020 - protein, 656 aa, Daphnia pulex
MVGVVYENLDLKRERSRCSFDKEEITNLIDGGKEKTQERRDLVQYILSDPDLKDPVPIEYLSHYERYGAELKKACLLVQKMRKPNGKPLDIGVGPAAVILKEGNALGLHFVMFMPALMGQASVEQQQKWLPRALNLELIGTYAQTELGHGTFLRGLETKATYDPDTKEFVLDTPSLSAYKWWPGGLGKTANYAVVMAQLYTKGKCEGIHPFLVQLRDENTHEPLPGISVGEIGPKLGLNSNDNGYLGFNQVRIPRDQLLMKHSQVLEDGTYVKPKNTKLGYATMVYVRVFIVQDMASVLRRAVTIATRYSCVRHQSELKPGEPEPQILDYKAQQNKLFPALAASFAFHFAAENLWNLYHVATENIGKGDLQMLPDLHGMSCAMKALSTSEAANFVETLRQSCGGHGYMVSSGFPRLYGVATASETYEGENTVLWLQVARYLIKTRMDNAGGKSVAYLIDTKLPDNKPGDLGLDSIINLFQRVASGYVDLAVKELEGYSRQGKAPHDAWNQSAVQLIKAAQAHARYLVADCFVRSVREGKLSGPVRSILNELCEFLLIYWLVERSGDFFMFAELKAQQLIELQSKYMELLGTIRTYAVNLVDAFDIPDEALGSVLGCWDGNAYQRLFDEASKSPLNKSTVHRESFEKYLKPLMQSNL

SEQ ID NO: 3021 - protein, 634 aa, Daphnia pulex
MSKEIYENPDLKKERQNCPFNKEEITHLLDGGKEKTIERKQLENYILSDEQLKDAVPMEYLSHADKYAEELRKACLLMHKLADSPAGQVPTLRALMGAGLGSAVLKEGNPLALHYVMFIPALMGQGTIDQQAKWLEKAYNLNMIGTYAQTELGHGTFLRGLETRATYDPKTQEFILESPSLTAYKWWPGSLGKTANYAVVMAQLYTKGKCEGTHPFMVQLRDEETHEPLPGIVNMWLNPVCISSYIHYGTYVKPTNSKLSYATMVFVRVVVCQDVTTNLRKAVTIATRYSCVRRQSELKPGDREPQVMDYQAQQNKLLPPLAATFAFQLAADHLWNLYHTANNNIEQGDLELLPDLHGLSCALKALCSSEAANFVEVCRQSCGGHGYMSCSNFPRIYGQVTAAETYEGENTVLWLQVARYLVKTRKEQSGGLSVKYLIGEEKGPKTVDTTLEGIVKLYRRAAVGLVDVAIAELDKSGRKGEAPHDAWNHAAVYLIKAAQAHARLFVVESFVDSLKEGKLSAPVRTVLSQLCELFIIYWLLERSGDFFLCSNLTKQDLLLLNSKYVELLAAIRPQAVNLVDSFDLRDEVLNSPLGCWDGNVYQRLFDEAAKSPLNQSNVHESFHKYLKPLLKSNL

SEQ ID NO: 3022 - protein, 690 aa, Daphnia pulex
MDPELQDILKDFPPGPLSEYRNNASFNWKDMCLLIQGKDALVLKHKIWSTLEKDPVFAHCATKPTLKENRLLTLQRAQKLAEYNFMPAKNLLQKPEMLDSVVMAIGQLDWSSIVKLQLLYNFVISALYGMGTERHFKEIQRLMRREIGACFCLTEIGHGTNTKAMRTTAKFDVKTQEFVFHTPDFQAAKCWAGNLGETATHAVVFATLYTPDGENHGLHAFFIQIRDTQTFENLPGVSIGDMGEKLGLNGVDNGVMLFDQFRVPRAALLNRTGDVSESGLYVSPFKDKKKRLGASLGTLSAGRVGIASMATANLIKAITVGIRYSAVRRQFGPEDSNVELPVLEYQLQQWRLFPYLGAAYVLINFTRTFRKDFIEMQMAMMNKEDPDRLASVGAEVHAISSFAKPLSSWLAQQGVQECREACGGHGYLAVSGLGSVREDNDANCTYEGDNNVLLQQSANWLLNLWSLVQRRQSVAPYTPLGSAIYLDSAESILKSKCKLDTSQQWFEPQALLDAYQFAVCHLLRSTANRMQQLMDQKMDAFTAKNQAQAYHYRPLSIAYGETLFLMRMMRLLNDPNIPEQLRAVLKSLTALFGATNLMKHLSALTQGGYFQSNTSAALQTAIEQLCEKLKPDAIALIDAVAPSDFALNSALGHSDGQVYRHLEEHMASSMKTRPDWWQQVLLPPKKTSHL

SEQ ID NO: 3023 - protein, 845 aa, Dokdonia donghaensis; identical to SEQ ID NO: 3008

SEQ ID NO: 3024 - protein, 695 aa, Aspergillus nidulans
MPDFTDSLLPAEPSGASVLASERARSNLSIDELSTHLHSHDGFLALQDKVLPILQSEPLLNKSTQHNLSRPDRFKLALARAKLVRRLADKHGWTPAEHEMAEYLVDEVSPYMLHMGMFITTIQEQGSDEQRQEWLPKIEKWEIIGAYAQTELGHGSNVRGLETQARWDGTRKGFVLHSPTLTASKWWNGTLGRTANHAVVVAQLMLPDPVQTSEGDSGDQRGTKYISYGPHPFIVQVRDMKTHQPFEGIVIGDIGPKYGIRIPHSALLSRYCSVNPETGRYSKPSQPTLVYGTLTYMRSKIVQHARLVLARAVTVAVRYTAIRRQFKDRDDASKNSPELPVLDYPTVQIRILPLLATAFALHYTGLAMQNVYSRTRRQIESGDFSSLAYMHTDGIETCRRALGGHGYGGGSGLVQLNADYLSKVTVEGDNWMITQQTAAYLIKKMGSVVSASVAKVEKDEIDVQFTTYFPKIQGGETDRGDRQCDYDILRNDGDLVQAFQHRATALAYDVYRERVVRKRGWTSIMTQLHRLSKGTESLLVEQELTSSAQSQSILVTQFYNALSSDTELSAAVKDVLWDLYRLFSLSTLETEKYEFFSHNAASKHDLDAVLERINELTSRIRPHAVRLVDAWQIPDYLLDSALGRYDGRVYEDLFHRAHRVNPLNKTTVNPNYWEDEIVKNQGPGGEDMWSILAKL

SEQ ID NO: 3025 - protein, 661 aa, Coccidioides posadasii
MPPRNISNKPNETPLSVFLWGGKDKFEARKQLLKALTTNPIFSKRAVTVPSLSRKDAWVRAVHQARELIALKQKEKWSHEQFRQAVVMLDYFLPVQPQFRIFLSNMERQMSDEQKAIWMPKAERLEIFGSYAQTELGHGSNVRGIETTATFDRDADEFVINSPTLSSTKYWIGATGIWATHSLVVARLIIHAKDYGNHLFLIQLRDLDTQELMPGVEIYELGPKAFQGMVGVDNGAMQFHNVRIPRSQMLARNAQVLRDGTYVPPKNTKHSYGSMVTVRAIMVEATGYELLKAVSVAYHYTTFRKQFWRKGQEEETTVFDYASVKYRLLPLLAQGTALVLVGQSIKQAFDEYSKLVINTGDFSQLEDLHLQTVGAKVYSTDITARGVETCRIACGGHGYSALSGFGRMYAHTVNAVTYEGDNYVISQQVPRAILKHYNGRTESTVPSLSYLSFIRDPDAAGILTAASESGWFKLENQQWVLERRLATLVRAHLDATVCGKDTSFTVHELTMAALRFCILARFLGCCSAKLSGLNSMAHWKPWLMWFTFSDFFVKFSLSILQTAYKDIYSPHSLTEHQRKTLVSAYDQAIETLAEHSKSIIEAYGFTDFEMDSALARPDMDPYEALWQGARQSEMNNFREIWPLIVDARKIWGRLEGEKAKL

SEQ ID NO: 3026 - protein, 402 aa, Streptococcus anginosus
MATKEEILRELYPEDLFHYADGLTLGEAEVLQETRRLIEKHLRPVINEHWEKPDFPFEQFYTVAKGAQIMNNPKLFEGREGSYKPSELYIAFLYLELARFDTSMATFYTVHGGLCYNTILLGGDERQQKEFLPKLAAFDWQGCFALTEPLSGSDIAGGLATTAERVGDKWIINGEKRWIGGSDTADVIPVFARDVADGKIKCFIVRKGAPGYDVEVIQHKIALRCVRNGHITMTNVEVPDSDRLVNINGFEDVARILTFTRADVAHIAMGITCGSFVAALKYTTNRQQFKRPVAKFQIIQEKLARMQANAVAAIAYSVRLAEMQEAGNELMLNSALAKMHNSLVMRETVALAREVGGGDGITLETDVARFFADAEAVYTYEGSHEVNALIVGREITGLGAFV

SEQ ID NO: 3027 - protein, 402 aa, Streptococcus anginosus; identical to SEQ ID NO: 3026

SEQ ID NO: 3028 - protein, 707 aa, Arthrobacter arilaitensis; identical to SEQ ID NO: 2890

SEQ ID NO: 3029 - protein, 682 aa, uncultured Sphingobacteriales
MVLKNYALGKWTVGEGEKQTLYNAITGAKIAETSSKGLDFGEMMDYAREVGGPTLRKMTFHERGRMLKALALHLISIKEKFYALSAQTGATKLDSWIDIEGGIGNLFTYASLRKQFPDETFYVDGETAPLSRGGSFIGQHICVPKQGVAIHINAFNFPIWGMLEKISVNLLAGVPAIVKPATVTCYLTELMVKEIIDTDILPEGSLQLICGSARGILDNVTSQDVVTFTGSASTGRMLKAHENIVNESVPFNMEADSLNCCVLGDDVNPGDIEFDIFIKEVQKEMTVKAGQKCTAIRRIIVPANKVEDVQIALGERLAKTTLGDPSVEGVRMGSLAGLEQREEVKEKVLELSKSQEIVYGDLDHFKVVGADKEKGAFLAPILFLNYDPFTKTDCHNIEAFGPVSTIMPYKNIEEAIELAKMGKGSLVCSIITADDSIAKEFVMGAAANHGRILILNADCAKESTGHGSPMPMLTHGGPGRAGGGEEMGGKRGVMHYLQLTAVQGHPTSITKVTNVFQYGAAQTENDVHVFRKHFEELEIGETVFTQRRTITEGDIVNFANVSWDHFYAHTDVTSLDGTIFEERVAHGYFILSAAAGLFVDAKKGPVLLNYGLEECRFVKPVYAGTTIGVRFTVKEKVDQEKRSKEDIAKGIVKFLVDVYDETRETVAIATILTMVKKLDQSK

SEQ ID NO: 3030 - protein, 733 aa, Ashbya gossypii; identical to SEQ ID NO: 2742

SEQ ID NO: 3031 - protein, 687 aa, Vitis vinifera; identical to SEQ ID NO: 789

SEQ ID NO: 3032 - protein, 446 aa, Vitis vinifera; identical to SEQ ID NO: 790

SEQ ID NO: 3033 - protein, 695 aa, Ostreococcus lucimarinus
MLDDSRDGRGHRVVDAHTRALVEPSSDVIAASTSDPKEDLRLERARASFNSRELEVLLAGGKDNYKLRQRIASVMTTNEAFSKRGKYFDERDELYERTLRMYLALPSAVASMNEKEPIAVARIMRELIDEPGGLDLHLGMFIPTIQGQGDEEQRKYWIPKCVKLECVGTYAQTELGHGTYLRGLETTATYDEEREEFVVHSPTLTSTKWWPGGLGKTSTHAVVMARLFTKGVDHGVHPFVVQIRDNKTHEPLPGCTIGDIGNKMGYNAVDNGFLRFDHVRVQRRAMLMGHSKVERDGTYVPAPVAKVSYGTMVFIRSDIVMNAALYMKKAVTIAIRYNLVRRQSNADEVTGMECQVIDYQHSQRTLFPILAKAFAFHCTSDYMRRMYFEFQRDSREKKDFSALPELHATSSGLKAYCSWATKDAIEACRLTCGGHGYMNLAGFGTTLATYAPNVTYEGDNNVLCLQTARYLLKAHRKMLNGQPPVDALRYLDGASSRSALALGASLRDEKAILDAYAHRAWRLVTEASKVTGDLSPDEAMRVHMVQWIGAAKAHCAFVVMYNFVLAYDETRSRVSAETLNVLHRLVCLHGLCGMDDTMGEFLEDGHIDGEQAAEIRQEIFKLLSEIRPDAAALVDSFGLHDYFLNSALGAKDGDVYRRLYEEVQAAPFNRKHTPPGYTELLQPKLSRGNFGVSKL

SEQ ID NO: 3034 - protein, 404 aa, Paramecium tetraurelia
MIRLNLLAGQVKEKIAQIDPMEYLSLYDLLTPEELEVRKAVEAFVQKEVAPKINDYVEAAQFPTEIVNAVKPLKLFHHFLNKPYGHGTSYTKQGVILMEAARADAGFATFIAVQNLLLNYTLEKFGNATQKQKYLTKTRDVEYIGGWGLTERGYGSDASSLTANVKKVQGGYILNGDKRWIGNGNKDVLIVWARNLDTNKVEGFIVETKWPGYHAEVIQGKLALRIVQNCQITFTNIFIPDENKLESVTDFQNGPNQVLMHSRVIVPWIALGVMRGVYEHSLKWTTSRKQFGKYLASFQLQQERLVRILSTFQASFLMVLRLSRLAAEGKATIGMISSVKAWVTDKTREVARLGREMLGGDGIISDNYVIKALTDAEVLYTYEGTYDINSLVAGREITGIGAFK

SEQ ID NO: 3035 - protein, 576 aa, Aspergillus flavus
MSDFTDHLRPSQPNGPEILARKRTQTHIPVDELAHHLLAQDGYLERQARILRIVEQEPLFDKKRQANLSREDLFKLALARAKLLRRLVDKHGWDIDDYKMAETLVDDVSPYYLHLHMFITTIREQASDAQQAYWLPLIESFKIIGAYAQTELGHGSNVQGLELQARWDPGSKEFILHSPTLTASKWWNGSLGRTANHAIVVAQLLVPNSGGEYQSHGPHPFIVQVRDMQTHQPRKGVVIGDIGPKFGYATIDNAYMLFHHFRIPHSALLSRYAKLDPDSGQFSKPAVPAVVYGTMTYVRSLIVLQSRMALARAVTIAVRYTTVRRQFRDRDDLKGPEVAVLEYPTVQIRILPLLATTYVLHYAGQAMQRIYREAREQIQAGDFSGLAHMHSLSSGLKSFCTDLVADGIETCRRALGGHGYGGASGFIRLSPDYLSRVTVEGDNWMITQQVAAYLIKRMHAAVANIDSATGNETEDLYKEFLRANRSLALLVEIFHDTLQNDRSLPPPAKNTLRDLYHLFAFFHMETHAYDFFRSGAAPQRDLDELPNRVRHLMARIEPHAVALVDAWKIPDYLLDR

SEQ ID NO: 3036 - protein, 672 aa, Rhodobacteraceae bacterium
MGLLQINSFAAGTWIAPDSSARPIENAATGEVMGQAGNASLDVARMLDHARTIGGPNLRKMTFHDRARMLKAVAAHLNTHKQALYDLSFATGATQSDHLIDVDGGIGTMFVFASKGRREMPDGHVYIDGEIEQLSRNGSFLGQHICTSMQGVAVHINAFNFPVWGMLEKLAPTLLAGVPAIVKPATATCYVTELAVRLMLESGLLPDGALQLVSGGLGTMLDQLTLQDVVSFTGSAQTALKLRSAPHILENSIRFVAEQDSLNASILGPDAAPGTPEFDLFIKEAQSEMTTKAGQKCTAIRRIIAPENHVSAVIDALSDRLSKTVIGDPNKAETRMGALVSNAQKRDVLAKAAIIGAEAEQVYGNKDFHEHKGAFLTPMLFHCATPDTANRVHDTEAFGPVSTVMGYRDIDHAIALVNRGQGSLVASVITHDPVVARNVALGASAFHGRLYFNNRDSMKESTGHGSPLPHMVHGGPGRAGGGEELGGVRGVMHYMQRTAIQGSPDILTAIGGTWVDGAKEKPAPAHPFTRTFHEVEIGETIHTDPRSVNMDDIEHFAHFTGDTFYAHMDDAAAKRNPFFPGRVAHGYLLLSFAAGMFVEPNEGPVLANTGLDNLRFMKPVEAGDSIKVRLTVKKKTPRNEEYGEVRWNVTLTNQNAEKVAEYELLTMNAYTR

SEQ ID NO: 3037 - protein, 425 aa, Streptococcus mitis
MGLSTNSEYKNVSALITNKGVMTMATKEEILRELYPEDLFHYADGLTLGEAEVLQETRRLIEKHLRPVINEYWEKPDFPFEEFYAVAKGAQIMNNPKLFEGREGSWKPSELYIAFLYLELARFDASMATFYTVHGGLCYNTILLGGDERQQKEFLPKLAAFDWQGCFALTEPLSGSDIAGGLATTAERVGDKWILNGEKRWIGGSDTADVVPVFARDVADGKVKCFIVRKGAPGYHAEPIPHKIALRCVRNGHITMKNVEVPDSDRLVNINGFGDVARILTFTRADVAHIAMGVTCGSYVAALKYAKDREQFKRPIAKFQIVQEKLARMQANAVAVIAYSTRIAEMQEKGNELMLNSALAKMHNSLVMRETVALARETCGGNGITLETDVARFFADAESIYTYEGSHEVNALIVGREITGLGAFV

SEQ ID NO: 3038 - protein, 425 aa, Streptococcus sp.
MGLSTNSEYKNVSALITNKGVITMATKEEILRELYPEDLFHYADGLTLGEAEVLQETRRLIEKHLRPVINEYWEKPDFPFEEFYAVAKGAQIMNNPKLFEGREGSWKPSELYIAFLYLELARFDASMATFYTVHGGLCYNTILLGGDERQQKEFLPKLAAFDWQGCFALTEPLSGSDIAGGLATTAERVGDKWILNGEKRWIGGSDTADVVPVFARDVADGKVKCFIVRKGAPGYHAEPIPHKIALRCVRNGHITMKNVEVPDSDRLVNINGFGDVARILTFTRADVAHIAMGVTCGSYVAALKYAKDREQFKRPIAKFQIVQEKLARMQANAVAVIAYSTRIAEMQEKGNELMLNSALAKMHNSLVMRETVALARETCGGNGITLETDVARFFADAESIYTYEGSHEVNALIVGREITGLGAFV

SEQ ID NO: 3039 - protein, 402 aa, Streptococcus anginosus; identical to SEQ ID NO: 2686

SEQ ID NO: 3040 - protein, 680 aa, Rhodococcus erythropolis; identical to SEQ ID NO: 2259

SEQ ID NO: 3041 - protein, 402 aa, Streptococcus anginosus; identical to SEQ ID NO: 2686

SEQ ID NO: 3042 - protein, 401 aa, Eremococcus coleocola
MNKLEVLKEMYPEDVYGYSSALTEKEVAILQNLRHELETRVRPILIDSYENAELPREEILGAFAAARIMDHPDLFEGREDKWKAREIYNTFLYLELARFDPSVATFYTVHGGLGYNTILIGGSEEQKEKYATKVRTMTGQTCFALTEPDHGSDIAGGLATTAEFKNGEWVLNGEKRWIGGAKTADFIPVFARDVADNKIKCFMVAKGSEGLSVENVEHKIALRIVNNGHITLKDVKVKDEDRLVNINGFGDVAKIFVFTRVDVAHIAMGTAAGAFNAALRLTTDREQFERKIASFQLVQEKLATMQANVAACIAYSARVAELQEEGTAKMFNSSLAKLHNAKRMRETVALAREVCGGNGITYETEVARFFTDAEAIYTYEGTHEVNSLIVGRELTGIGAFL

SEQ ID NO: 3043 - protein, 401 aa, Eremococcus coleocola
MSKAEKLAQLFPEDLYKFSDCLTEKEVDVLMEVEAALEKHLRPVITEHSEKAEFPMDAFYAFVNEVAIMSDPRLYEDREDKYTPSQYYYAYLWYLMSRFDTSIATFFGVHGGLGYYTFLLGGSPEQVERWVPKLQNFELQTCFGLTEPEHGSDIAGGLATTATRQGDKWIINGEKRWIGGAGSADVLPIFARDTEDNKIKCFILEKGQKGLTIDKIENKIALRMVQNGHITMKDVEVADDHRLVNINGFKDVARVLYVTRSGVANLAAGNSAGAFRAALKYTKERKQFTKSLVEFQLVQEKLARMQANVISELALITQIAKLQTSGEFDEVRSSIAKMFNSLRSRETVALAREVCGGNGITYDYDVARFFQDAEAIYTYEGTHEVNSLVIGRAITGKGAFV

SEQ ID NO: 3044 - protein, 402 aa, Eremococcus coleocola
MSKSKIEKLQYLYPEDIYGYSHDLSENEVDFLLKLRETLEKELYPVIDDHWKKELFPMEAFKKITDLGIMTDPSLFEGRENKLKTSEIFNLFRLYELNRMDSSIGAFTIVHGGLAYSTVLIGGSQEQIDYYAPKLASYEWHSCFGLTEPLHGSDIAGGLATTAELQGDKWVINGEKKWIGGAATADVLPIFARDVADGQIKCFMVPGGTPGLTVDKIDGKISLRLIQNGHIKMNNVQVDKTARLENINSFRDVAKILYTTRADVAHLATGLHAGALANTLKYVKEREQFGKKISQFQLVQEKLARMQANCVTSLALSHRLAQLQEQGRYEEVQSSLAKMNNAYRLRETVALGRELLGGNGIIVEHDVARFFVDAEAAYSYEGTHEVNSLILGRFLTGKGAFV

SEQ ID NO: 3045 - protein, 437 aa, Populus trichocarpa; identical to SEQ ID NO: 328

SEQ ID NO: 3046 - protein, 436 aa, Populus trichocarpa; identical to SEQ ID NO: 331

SEQ ID NO: 3047 - protein, 689 aa, Populus trichocarpa; identical to SEQ ID NO: 330

SEQ ID NO: 3048 - protein, 639 aa, Populus trichocarpa; identical to SEQ ID NO: 333

SEQ ID NO: 3049 - protein, 664 aa, Populus trichocarpa; identical to SEQ ID NO: 329

SEQ ID NO: 3050 - protein, 677 aa, Drosophila simulans
MSVNADLQRERAAATLDSEDFARWWAGGSWQLEERRALERRFYEDPDFAEPVHPSCLSYKERYEQTVARSTRFLAKLRQWQREKQPQLQLSVNMLRDFRLLLSGSLGTGLFQQSFPLRVHFSMFMTTLLSQGTEEQQAQWLNRSWHMDGVLGTYAQTELGHGTFVRGLETRADYDPITQEFILNTPTQSSYKWWPGGLGNTANVAIVLAQLYVKGKHYGLQSFVVRIRDERTHEPLTGVDVGDIGPRLGGNGVNNGFLGLRDVRIPRNQMLMKNAQVLTDGTFVQGRPPLLLYGTMVYVRVITLKDVLFGLLQAATIATRYSVVRRQSRINSDQPEVSILDHITQQAKILPQIARGVSYRLVSDWVWRFYEDVLRQLEDESTAGRNSLPELHALSCCLKAVATDEASEGVELLRKSCGGHGFLSSANFDSIYGLTAAAYTYEGEYTVLLLQTARFLVRQYVDSLKRKVLPSSVSYLRDTSRLVWGKNLAANCVRALEISAMEQVRQAWQTQKTHQSSKVSAEMASNLAGRQLTSAAIAHAHAFFTRNALEQVEALRKKGDLSPNVSLVLGQLVELFVIDTFLRQSGCVLRWNNGITGTQLRFVERRFEELLAKLRPNAVALVDGFDFHDRVLGSTLGCHDGRVYERLMEEARRNPVNQEPVNSSFHNHLLPMMRGKL

SEQ ID NO: 3051 - protein, 649 aa, Drosophila simulans
MSHIKNLIPSTVNPDLQNERSAAEFNVEEFSAWWHGGHDKLKKKREIEKAIFSDLEDGYGLNHEYMSHEEVYNSTVKKVAEAAVKLKALQNKLNPGGTDIWPGGLFNAQSFGLFPANHPVATHITMFVDVIKGQGTAEQVEKWGKAAENCNIIGTYAQTELAHGTNVRGLATRADFDPKTDEFVLNTPNLEAYKWWPGGLGHTANHAMVVAQLYIADVHHGVQMFIVPVRDSETHMPLPGVDIGEIGKKLGMASVNQGFLGLNHVRIPRTNMLMKFAKVERDGTFKASPASRINYLTMVYTRCLIVSQNSTLLLAAATIATRYSAVRRQSPIEPNQPEPQIIDHVTQRLKLFPEIATGIAYHLATEYVWEMYAQTVQEANNGKFERLPDMHILSCALKVLCTTDGCAGIEKLRLSTGGHGYLTAANLSNIYGNAVAAYTYEGRTRYFASSMQLKEFPKWDDSWQCIIKALQYTAAHKTRIAFENLANRMASGQSQGVAANNTGIELTRAAELHGRQFVCQTFLEQITGAKAQKRSPALNKILENVLELFLVQTVLNNLNDILRFIQLSDADLRSLQRRLEDSLEQFRPNAVAICDGFEFHDRVLNSVLGSYDGNVYPRLFDSAKRSTMNQKPVQTSFETYLKPLMKAKL

SEQ ID NO: 3052 - protein, 674 aa, Drosophila willistoni
MNVDLQQERASATIDSEDFAQWWAGGKTNLEQRRSLESQFFNDPQFDDVIPASCLSYKERYEHSVARGTQFLHKLRQWFSEKQGKNNVCDLNTLQEFRFLLSGPLGTGLFQQSFPLRLHFSMFVSTLLNQGTEEQQRKWLSRAWHMDGIIGTYAQTELGHGSYIRGLETRADYDAEHEEFILNTPNLTAYKWWPGGLGQTANMVVVLGQLYVGEKHCGLQSFLVRIRDEQTHEPILGVDVGDIGPKLGANCVNNGYLGFQNVRIPRDQMLMKNAQVTSDGKFIQSGQPLLLYGTMVFVRVITVRDVMFELLQAGTIATRYSAVRRQSPIEPGKPEPQILDHLTQQAKIFPQLARGVSYRLVADWLWQFYQNVMQTLEKKDSALASDSLAELHAVSCCLKAVATQEASEGIDILRKACGGHGYMASANFDSIYGLATAAYTYEGEYTVLLLQTARFLVRQYVDSLKRKILPGSVTYLRDVSRLVWGKDLVENCVRSLEIASLEQIRLAWQCQKEQRKRGLGVEQSNNLAGRQLVAAATAHAHAFLTRTTVRELRRIVSGLKPSVAGILTQLMELFVLDTFLRQAGQVLRWNSINGRQLRQVEQRFEQLLSKLRPNAVALVDGFDFHDRVLGSTLGAYDGRVYERLMAEARRNPLNQETVNSSFYSHLQPMMRGKL

SEQ ID NO: 3053 - protein, 676 aa, Drosophila willistoni
MSHIKNLIPKTINPDLQKERNAAEFSVQEFAAWWQGGQEKLDTKRTVENAIFSDLEDGYGLNHEYMSHEDVYNSAVKKAAEAALKLKALQKKLNPGGNNIWPQSLFNVHSHGLFPANHPLATHITMFVDVIKGQGTAEQVEKWGKAAENCNIIGTYAQTELAHGTNVRGIQTRADFDPQTDEFVLNTPNLEAYKWWPGGLGHTANHAMVVAQLYIDDVHRGIQMFIVPVRHADTHLPLPGVDIGEIGKKLGMAAVNQGFLGLNNVRIPRTNMLMKYAKVERDGSFKASPASRVNYLTMVYTRCLIVNLNSTLLLEAATIATRYSAVRRQSPIEADQPEPQIIDHVTQRLKLFPEIATGMAYHLAAEYMWELYDQTVLDANNGKFDRLPDMHILSCALKVLCTTDSCAGIERLRLSTGGHGYLTAANLSNIYGNAVAAYTYEGENTVLLLQIGRALVKAWSNFIADKPVSSSYAYFESSKQKKFPKWDNSWETIIKALQFTATHKTRIAFENLAERIASGQSQAVAANNTGIEFTRAADLHGRQFVCQIFVEQITGPKAQKRSASLNKVLENILELFLVQTVLNNLSDILRFINLTDADLRSLQKRLELSLEKLRPNAVAICDGFDFHDRVLNSVLGSYDGNVYARLFDSAKRSTMNQKPVQKSFESYLKPLMKANL

SEQ ID NO: 3054 - protein, 697 aa, Drosophila virilis
MEALGECIELRREREGATIASEDFAVWWAGGRHELEERRALENYFFNDPEFDDAVHPSCMSYKQRYEHALTKGTKFLAKLREWQRSRRAQQPKGKEEHELEGAEDSVNIKLLYDYRMLLSGPVGTALFQQSFPLRLHFSMFLPTLLSQGNAEQQRRWVGRAWRLDGIVGTYAQTELGHGSYIRGLETRADYDAEREQFVLNTPTLSAYKWWPGGLGQTANMVVVLAQLYIRGKHHGLQQFLVRIRDEQTHEPLPGIDVGDIGPKLGANGVNNGFLGFRNVRIPRDQMLMKNAQVLADGRFVQAAQPLLVYGTMVFVRVMIVRDVMFGLLQAATIATRYSLVRRQSPIEPNAPEPQILDHVTQQAKILPQIARGICYRLAADVLWAIYQRVMQQLEAAGPNNSNGGRELPELHALSCCLKAVCTEGAAEGIDVLRKACGGHGYMSSANFDSIQGLASAAFTYEGEHTVLLLQTARFLLRQHLDALKRKVLPASVTYLRNASPLSWSDNLLENVARALEISAAAQLREAWQWQQEQRQHGKHTEQQANNLSGRRLTAAATLHGHAYLARNAIKQLEQLRRNVQPALYELLQQLVELFVLHTFLRQLGAVLKWNRNGISSKQLQQLEQRYEQLLGALRPNALALVDGFDFHDRVLGSTLGCWDGRVYERLMAEARRNPLNQEAVNSSYHTHLQPLFRCKL

SEQ ID NO: 3055 - protein, 676 aa, Drosophila virilis
MPSKSIIPKTVNPDLQRERDGASFSSEEFAIWWAGCAEKLKFNRGVREYMYKDFDYDEYTQVFYMSYEDICEFAVKSSINVAKKLRQLQSERNPGGNEYWPTLFEEPEMWGLHLAGNPFHVMFMVVLRALKTQCTPEQYEEFGARVERFEVTATYAQTELGHSSHLRGLETRADFDRATDEFVLNTPTISSYKWWPGGLGHCSNYAMVMAQLYIDDQLKGLHLFYVQVREEDTHEPRPGIHIGELSKKIGFLGVNNGFLGMKNVRIPRSRMLMRHAQVQRDGSYVKSPVDALTYFSMLATRCIVARNTTLSLATAATIATRFSAVRRQSPIDPRLPEPQIIDHVTQQLKVFPEIATSLALRLAYDYLWDLFNVTSSDIDQGNYERLAELHALSCALKVMSSNDSAAGIERLRLACGGLGYLAASNLGNLYANTVAACTYEGENTVLLLQVSRFLLKSWRAAEGGAPLAPTASYLAGMQQNADFKVWTGSWADMVNAMQLAAANKTSLALRSLCNRMDKGESEKVAASHTGIQLTQAAEFHARAFVCHNFLTEVTGPKSKTRTSALNRVLEQLLELYLVNGTLKHMSDILRVASLTDVHLGQLQARLEAALTKLRPDVVAIVDGFDFGDEQLNSILGFFDGNVLERVFDAALKSPMNRKPVPKSFHEHLGPFMKSNI

SEQ ID NO: 3056 - protein, 677 aa, Drosophila virilis
MSQIKNLIPTTVNPDLQKERTAATFSVDEFAAWWQGGADKLNTKRVIEQAVFSDLEDGYGINHEYMSHEDLYNSTVKKVAEAAPKLKALQEKLNPGGKDIWPGCLYSVLAHGLFPANHPLATHITMFVDVIKGQGTPEQVEKWGSLAENCNIIGTYAQTELAHGTNVRGIETRADYDPRAGEFVLNTPNLEAYKWWPGGLGHTANHAMVVAQLYIAGKHKGVQMFIVPLRDPETHMPLPGIDIGEIGKKLGMAAVNQGFLGLKNVRIPRTNMLMKYAKVDRDGTFTASPASKVTYLTMVFTRCLIVNLNSTLLLQAATIATRYSAVRRQSPIEPDQPEPQIIDHVTQRLKLFPEIATGMAYHLAAEHMWELYDQTVLDANNGKFDRLPDMHILSCALKVLCTTDGCAGIERLRLSTGGHGYHIAANLSNIYGNAVAAYTYEGENTVLLLQIGRALVKAWASYKQGQTPSSSYAYFESSMRLKEFPKWTGSWQCIVQALQYTAAHKTRIAFENLSERIAAGQSQAVATNNTGIELTRAAELHGRQFVCETFIAQITGPKAQKRSPALNKVLENVVELFLVQTVLNNLNEILRFVNLTDEDLRSLQKRLELSLEKFRPDAVAVCDGFDFHDRVLNSVLGSYDGNVYPRLFDAAKRSTMNQKPVQKSFETYLKPLMKANL

SEQ ID NO: 3057 - protein, 695 aa, Drosophila virilis
MENVDTSFIPDLPAGGALAVYRKRANFDWKRLRLILEKEQGLRIKYKVWRRLESDPLFAHASRTLPMDEQKRLAAMQVNRMKHLDLVPKEVESLNFSAKTKYLMNINEALASYSPSLSVKIALGVGLFNNAIRALGTEKHTKYIEAAWNREIITCLAVTELSHGSNTKRIRTTATYDPSSQEFVINTPDFEAAKCWVGNLGKMATVAMTFANLITADGENHGLHGFLIPIRDPKTLLSYPGVLVGDIGEKCGLNGIDNGFVVFTNYRIPRDNLLNRTGNVTPEGVYESVFAEPGKALGAALESFSAGRIGIMQESANTLCSAAVIAVRYAAVRKQFGPERQGEEISIIEYQLHQYRIFPYLAAACVLKIAVEEMTNTYLEIIARSQADSNGFDILTQNAAEIHAIISASKPRITWSARDAIQEAREACGGHGYLRAAKLGQMRTDHDPLCTYEGDNNVLGQQASNWLLRQWSAKELESPIGSVKFLERRQQLLQLQYTQLVQQSPLDSWEFALTCYEWLLCHLMSRTSAHIEAQLAAGVHPFEARNKSQVMGARELSLAYAEYCALSRFVGHVQQLSLEQPYANVLRVLYDVYAMWLLENHMTTFYVGGFAVGGAFAAAVQERLLQSCAQLKDVAVSVADAIAPPDFALNSVIARADGQLYENLQNEFMTNECAFQRPAWWRDVIIPQPQEKSKL

SEQ ID NO: 3058 - protein, 725 aa, Drosophila mojavensis
MVGEQIVESVPVAPANNLGEIIKSLVDSYSDRDNVAPANIYEDKKIFPSFRSGPLQEYRDKASFCYKRLNVLLEGEDHIRLKHKIWQWMEKHPDFQREPEAPNLERTRELANKRHHLLWQQKFFDVNEYLNTPYLMLAFGQAIFSYDFSFSVKFSLSNGMFPSTLLTNGTGRLGKYIAKISDDRILGAYALTEIAHGTNANGMRTRATYDVKSQEFIIHTPDFEAAKCWVGNLGKTCTHAIVYAQLYVPDDKHQGLNAFLVPIRDELTLLPLPGVTVGDLGEKIGLNGIDNGFVMFNQYRIPKANLLSKTGDIDAQGNYNSPIKDQRKRLGASLGALSTGRVNITAITYVALSKAVCIATRYSASRRQFGPPDSNEEWPVIEYQSQQYRLMPHLTAVIALRVVSLWIGKKNMDMMMRGMMGEDTSREGMEIHAISSALKPYATWAARDGIQECREACGGHGYLRASGLGDLRNDNDANCTYEGENNTLIQQASNWLISLRRNNANFVEASPLETVAFLKDMNVILQTRGQEQNAGQALDVHNLLKALNWLTAWSLDTAVKRFEQLQSDGKDAFETRNNIQVFAAQKLSIIYAERTSYYVFYKFVTNLPASPEQQVLLKVLSFYGANLIIKYSSLFYQGGYFLNSSQIELYQQGILGLLSVLKNEAIALVDAIAPTDFILNSPLGMSDGNVYHHLQRAIVSTPGVYERPYWWRDVTYKTYLERAKL

SEQ ID NO: 3059 - protein, 676 aa, Drosophila mojavensis
MFSKNIIPKTVNPDLKKEREGANFSSEEFAAWWAGGKEKLEFNRSVREYMYKDFDYNENQQLYYKSHEDMCEFAVKSSIDVAKKLRQLQARRNPGGNEYWPTLFDEPELWNLHRAGNPFSVMYMVVVDALKTQCTPEQYKEFGVRVERFEVTATYAQTELGHSSHLRGLETRADFDRITDQFVLNTPSISAYKWWPGGLGQCSNHAIVMAQLYIDGQLKGLHMFYVQLREEGTHEPRPGVHIGELGKKMGFLGVNNGFLGMKNVRIPRTRMLMRHAQVHRDGTYVKSPVEPLTYFAMLSTRCIVARNSAVALACAATIATRFSAVRRQSPIDTSLPEPQILDHVTQQLKVFPEIATSLAYGLAYNYLRELFNATSRDINLGNYNRLPELHSLSCALKVMSTSDSAAGIERLRLACGGLGYLASANLCNIYVNTVAACTYEGENTVLLLQVGRFLMKSWRAAQSGAPLAVTASYLAEVHQNPEFGLWSGSWDNLVKAMQFAAANKTRLAFKSLSNRIDNGETERMASSHTGIELTQAAQLHARAFVVHNFLAEVTGPKSKARSPALNLVLEDLLELYLVNVALNNMSDILRVVHLTDEDLNKLQARLEAALAKLRPNAVAIVDGFDFGDAQLNSTLGFHDGNMLERVFDAALKAPMNRKSVPKSFHDHLGPFMKSNI

SEQ ID NO: 3060 - protein, 677 aa, Drosophila mojavensis
MSHIKNLIPTTVNPDLQKERSSASFDVNEFAAWWQGGADKLELKRKIELAIFSDLEDGYGINHEYMSHEDLYNSTVKKVAEAAPKLKALQEKLNPGGKDIWPGCLFRVQSHGLFPANHPLATHITMFVDVVKGQGTPEQVEKWGTLAENCNIIGTYAQTELAHGTNVRGIETRADYDPRAGEFVLNTPNLKAYKWWPGGMGHTANHAMVVAQLYISGKHKGVQMFIVPLRDPETHMPLPGIDIGEVGKKLGMAAVNQGFLGLKNVRIPRTNMLMKYAKVERDGTFIASPASRVNYLTMVYTRCLIVNLNSSLLLQAATIATRYSAVRRQSPIEPDEAEPQIIDHVTQRLKLFPEIATGMAYDIAAKHMWELYDQTVLDANNGKFDRLPDMHIMSCALKVLCTTDSCAGIERLRLSTGGHGYHIAANLSNIYGNAVAAYTYEGENTVLLLQIGRALVKAWNSFKQGQRVSSAYGYFESSMRLKEFPKWNNSWQIIIQALQYTAAHKTRIAFENMSERIAAGQSQGVAANNTGIELTRAAEFHGRQFVCETFLNQITGPNAQNRSPALNKVLENVLELFLVQTVLNNLGEILRFVNLTDADLRSLQKRLEVSLEKLRPDAVAICDGFDYHDRVLNSVLGSYDGNVYPRIFDAAKRSTMNQRPVQKSFETYLKPLMKASL

SEQ ID NO: 3061 - protein, 685 aa, Drosophila mojavensis
MEENSGECIDLRREREAATIVTEDFAVWWAGGRGQLEKRRELEQYFFSDPEFDDVASFNYLSYKERYEHVLTRGARFIAKLRQWQAKEQQSQQQEKDKDRVDIEEIYDFRRLLTGPLGAGLFPQSFPLRLHFAMFLPTLLNQGDEEQQRRWLARAWNMDGIVGTYAQTELGHGSYIRGLETRADYDVETEEFVLNTPTISAYKWWPGGLGHTANMVVVLAQLYIRGKHYGLQSFLVRIRDEQTHEPLPGIDVGDIGPKIGANGVNNGFLGFQNVRIPRNQMLMKNAQVLPDGQFKQAGQPLLLYGTMVYVRVVIVRDVTYQLLQAATIATRYSAVRRQSPIEPKAKEPQILDHLTQQAKIFPHIARGICYRLAADVLWAFYQRVMQQVETKDGAGPLAELHALSCCLKAVCTQDALDGIDVLRKSCGGHGYMSSANFDSLHGLAAAAFTYEGEHTVLLLQTARFLMRQFTAAIKRKVLPASVSYLRNASPLSWGGNLLENAARALEISASEQLRDAWQWQQKQRQAHSRTEQQANNFAGRRLAAAATLHGHAFLARNALEQLAQLKRSTNQGLFVLLQQLVELFVLDTFQRQLGAILKWNSVSGQQLQQLEQRYEELLGALRPNAVALVDGFDFHDRVLNSTLGCWDGRVYERLFEEARRNPLNQEAVNRSYHTHLKALLQSSKL

SEQ ID NO: 3062 - protein, 722 aa, Drosophila grimshawi
MVNERSDSDANANHLSDLLQSITDYYRGRQDVEPKNIYEDTKIFPAFRGGPLAEYREKASFCYKRMNVLLEGEEHIRLKHKVWQWMEEHPDFQREPEAPSLERTRELANKRHHLIWEQRFFGVDEYLTTPHLMLAFGQAIFSYDFSMSVKFVLSNGMFPSTLVSNGTGRLGKYVAKIANDRILGAYALTEVSHGTNANGMRTRATYDVKTKEFILHTPDFEAAKCWVGNLGKTCTHAIVYAQLYVPDEKHQGLNAFLVPIRDERTLLPLPGVTVGDLGEKIGLNGIDNGFVMFNQYRIPKDNLLSKTGDIDAQGNYSSPIKDSRKRLGASLGALSTGRVNITFLAYVSLSKAICIATRYSASRRQFGPNDSKVEWPVLEYQSQQYRILPHLATTIALRVATLWICKINVDLTIRGMMGEDTSKEGMEIHAISSALKPCATWAARDGIQESREACGGHGYLRATGLGDLRNDNDANCTYEGENNTLIQQASNWLISLRRSNTNFVDVSPLETVSFLSDMNVILQIQGQERTPAQALDVNNLLKALNWLTAWQLDETVKRFEKLQFDGKDAFETRNNIQVFAAQKLSIIYAERTIYYVFYKFVTGLPASPEQKVLLQVLSFYGANLVTKYSAIFYQGGYFRNSSHIELYQRGILELLSVLKNEAIALVDAIAPTDFVLNSPLGMSDGNVYQHLQRAIVSTPGVHERPAWWRDVTYKNYLQRGKL

SEQ ID NO: 3063 - protein, 677 aa, Drosophila grimshawi
MSMTKSFIPKTINHDLQKERLASTFDVEEFAAWWQGGEQKLKTKREIERALFADLDDGYGINHEYMSHEDLYNSAVKKVAEATPKLKALQQKMNPGGKDIWPGGLLSVHAHGLFPENHPLATHISMFVDVVKGQGTPEQVEKWGKLAENCNIIGTYAQTELAHGTNVRGIETRADYDIRAGEFVLNTPNLEAYKWWPGGMGHTANHAMVVAQLYISGKHKGIQMFIVPLRDADTHMPLPGVDVGEVGKKLGMAAVNLGFLGLKNVRIPRTNMLMKYAKVDRDGTFTASPASRVNYLTMVYTRCLIVNLNSTLLLQAATIATRYSAVRRQSPIEPNEPEPQIIDHVTQRLKLFPEIATGMAYHLAAEHMWELYNQTVLDANNGKFDRLPDMHILSCALKVLCTTDGCAGIERLRLSTGGHGYHIAANLSNIYGNAVAAYTYEGENTVLLLQIGRALVKAWASYKQAETPSSSYAYFETSMRLKEFPKWDNSWQCIVRALQYTAAHKTRIAFENLSQRIAAGQSQAVAANNTGIELTRAAELHGRQFVCQTFVEQITGPKAQQRSAALNSALENVVELFLVQTVLNNLSDILRFINLTDADLRSLQQRLELSLEKFRPNAVAICDGFDFHDRVLNSVLGSYDGNVYPRLFDAAKRSTMNQRPVQKSFETYLKPLMKASL

SEQ ID NO: 3064 - protein, 676 aa, Drosophila grimshawi
MLSKSIIPSTVNADLQKERDGASFNSEEFAAWWAGGPEQLKFKRSVKEYMYKDINLDERANFHYLSHEDICEFAVKNSINVAKKLRQLQAERNPGGSEYWPTLYEEPELAGLHLAGNPFGVMYLVVVKALKAQCTAEQYEEFGKRLEQFEVCAAYAQTELGHGTYLRGLETRADFDRDTDEFVLNTPTISAYKWWPGGLGHSANYSLVMAQLYIDNQLKGPHLFYVQVREEGTHEPRPGVHIGEIGKKMGFLGVNNGFLGMKDVRIPRNRLLMRHVQVHRDGTYVKSPVDVLTYFAMVSTRCLIVRIIYVALAATATIATRYSAVRRQSPIDPTLPEVQIIDHVTQQLKVFPEIATSMAHRLCFDYLWDLFNVTSKDIDQGRYERLPELHALSCALKVISSTDATRGTERLRLACGGHGYLTSSNLGNIYAHMSASCTYEGENTVLLLQIGRFLIKSWRAAQKGDPLPPTARYLAEVQRNPEFGAWTGSWENMTKAMQFAAANKTRLAFQSLSKRLDKGESEEVAASHTGIELTQAAELHGRAFIFHCFITEITGPKSKTRSPSLNRVLEQLLELYLVNMTLNNMSDILRVVSLTDGDLSKLQTRLETALTKLRPDAVAIVDGFDFIDGQLNSTLGSFDGNAPERIFDAALKAPMNQKSVPKSFHEYLGPFMKSNL

SEQ ID NO: 3065 - protein, 676 aa, Drosophila grimshawi; identical to SEQ ID NO: 2820

SEQ ID NO: 3066 - protein, 676 aa, Drosophila grimshawi; identical to SEQ ID NO: 2821

SEQ ID NO: 3067 - protein, 695 aa, Drosophila grimshawi
MEKMDTSFIPDLPTGGPLEVYRKRANFDWKRLRLILEKEQGLRIKYKVWRRLESDPLFAHPSRTPPMDQQKRLAAMQVNRMKQLQLVPKEIESLSFSAKTKYLMEINQALASYSPSLSVKIALSVGLFNNAIRAMGTEKHKKYIEAAWNREVITCLAVTELSHGSNTKRIRTTATYDPRMQEFVINTPDFEAAKCWVGNMGKTATIAMTFANLITADGENHGLHGFLIPIRDPKTLISYPGVLVGDIGEKSGLNGIDNGFVVFTNYRIPLDNHLNRTGNVTPEGVYESVFTDPSQALGAALESFSAGRVGIMQEAANTLCSAAVIAVRYAAVRKQFGPERQGEEMPIIEYQLHQYRIFPILAAACVQKIAVEELSNTYLAIIAGSQDDSNGFDVLSQKAAEIHAIISASKPRLTWSARDAIQEARESCGGHGYLQASRLGQMRSDHDPLCTYEGDNNVLGQQASNWLLRQWNAKELETPIGSVKFLERRHQLLQLHYAQLVQQSPMDTWEFALSCYEWLLCHLMSRTSAHIETQLSSGVHRFEARNNAQVVGARQLSLAFAEYMALSGFVGHVRQLGVEQPYAEVLRLLYDVYAMWLLEQHMTMFYVGGFAVGGAFAGAVQERLLQSCAKLKDVAVSVADAIAPPDFALKSVIARADGLLYENLQNEFMTNEGAFQRPDWWRDVIIPQSQEKSKL

SEQ ID NO: 3068 - protein, 677 aa, Drosophila erecta
MSHIKNLIPSTVNPDLQKERTGAEFNVEEFSAWWHGGQDKLKKKREIEKALFSDLEDGYGLNHEYMSHEEVYNSSVKKVAEAAVKLKALQNKLNPGGTDIWPGGLFNAQSFGLFPANHPVATHITMFVDVIKGQGTPEQVEKWGKAAENCNIIGTYAQTELAHGTNVRGLATRADFDPKTDEFVLNTPNLEAYKWWPGGLGHTANHAMVVAQLYIADVHHGVQMFIVPLRDSETHMPLPGVDIGEIGKKLGMASVNQGFLGLNQVRIPRTNMLMKFAKVERDGTFKASPASRINYLTMVYTRCLIVSQNSTLLLAAATIATRYSAVRRQSPIEPNQPEPQIIDHVTQRLKLFPEIATGIAYHLATEYVWEMYDQTVQEANNGKFERLPDMHILSCALKVLCTTDGCAGIERLRLSTGGHGYLTAANLSNIYGNAVAAYTYEGENTVLLLQIGRALVKAWASFVEKKPLSASYSYFATSMQLKEFPKWDDSWQCIIKALQYTAAQKPRIAFENLANRMASGQSQGVAANNTGIELTRAAELHGRQFVCQTFLEQITGAKAQKRSPALNKILENVLELFLVQTVLNNLNDILRFISLSDADLRSLQKRLEDSLEQFRPNAVAICDGFEFHDRVLNSVLGSYDGNVYPRLFDSAKRSTMNQKPVQTSFETYLKPLMKAKL

SEQ ID NO: 3069 - protein, 677 aa, Drosophila erecta
MSVNADLQRERAAATLDSEDFARWWAGGSLLLEERRTLERRFYADPDFAESVHPSCLSYKERYEQTVARSTRFLAKLRQWQRERQPQLQLSVNMLRDFRMLLSGSVGTALFQQSFPLRVHFTMFMTTLLSQGTEEQQAQWLNRAWHMDGVLGTYAQTELGHGSFIRGLETRADYDPLTQEFILNTPTQSSYKWWPGGLGNTANVAIVLAQLYVKGNHYGLQSFVVRIRDERTHEPLTGVDVGDIGPRLGGNGVNNGFLGLHDVRIPRNQMLMKNAQVLTDGTFVQGRPPLLLYGTMVYVRVIILKDVLFGLLQGATIATRYSVVRRQSRINNDEPEVSILDHITQQAKILPQIARGVSYRLVSDWLWRFYDEVIRQLEDESTPERNSLPELHALSCCLKAVATDEASEGVDRLRKSCGGHGFLSSANFDSIYGLATAAYTYEGEYTVLLLQAARYLVGQYVDSLKRKVMPSSVSYLRDTARLAWGKNLTANCVRALQISAMEQVRQAWQTQKMHQSSKVSAEMASNLTGRQLTSAAIAHAHAFFTRNALEQLEALRRKGDLSPNISLVLGQLVELFVIDTFLRQSGCVLRWNNGITGTQLRFVERRFEELLAKLRPNAVALVDGFDFHDRVLGSTLGCHDGRVYERLMEEARRNPVNQEPVNSSFHNHLLPMMRGKL

SEQ ID NO: 3070 - protein, 678 aa, Providencia rustigianii
MGKWVNGAGEGRKIYHALTNEALYSVTTEGLPLAKSLQYGREIGGEALANQTFQQRGEMIKALAKYLLAHKDELYAISAQTGATKADSWVDIEGGIGTLFAYAGLASRELPDDTVWSEDEMIPLSKQGQFIARHILTSRRGVALHINAFNFPCWGMLEKLAPTWLAGMPAIIKPATASAQVTQAMVKLMVDSGLVPEGAIQLICGGVGDMFDHLDFEDVVTFTGSAGTGQKLKSHPRIHQKSVPFTMEADSLNCAILGSDVLPESPEFALFIKEIAREMTAKAGQKCTAIRRIIVPKSQLENVKHALLKRLSGVTMGDPAVDGVRMGALINLEQRQDVQEKVDYLRANGCELLCGGSFTNLQVMGADSQNGAFYPPTLLYCAQPFIHQAVHETEAFGPVATLMSYDSLEQAVQLAILGGGSLAGTLVTADSQVAQSVIRASARAHGRMLILNEAAAAESTGHGSPLPMLVHGGPGRAGGGEELGGLRAVKHYMQRTAIQGSPSMLTAISKQWMRGADTVADVVHPFRKYFEDLVIGDTLLTARRTVTEADIVNFACLSGDNFYVHVDKLGAEQSMFGERIAHGYFVVSAAAGLFVDAGVGPVIANYGMENLRFIEPVKIGDTIQVRLTCKKTIKKVQKKAEDKPNGVVEWDVQVFNQRNEVVALYSILTLVERRHGDF

SEQ ID NO: 3071 - protein, 677 aa, Drosophila yakuba
MSVNADLQRERAAATLDSEDFARWWAGGAWQLEERRSLERRFFEDPAFADTVHPSCLSYKERYEQTVARTTRFLAKLRQWQREKQPQLQLSVNMLRDFRLLLSGSLGTGLFQQSFPLRMHFTMFMTTILSQGTAEQQAQWLNRAWHMDGVLGTYAQTELGHGTFLRGLETRADYDALTQEFILNTPTQSSYKWWPGGLGNTANMAIVLAQLYVKGKHYGLQSFVVRIRDERTHEPLTGVDVGDIGPRLGGNGVNNGFLGLHDVRIPRNQMLMKNAQVLADGTFVQGRPPLLLYGTMVYVRVITLKDVLFGLLQGATIATRYSVVRRQSRINSDEPEVSILDHVTQQAKILPQIARGVSYRLVADWLWRFYAEVLRQLEDESMAGRNSLPELHALSCCLKAVATDEASEGVDLLRKSCGGHGFLSSANFDSIYGLATAAYTYEGEYTVLLLQTARFLVGQYVDSLKRKVLPTSVSYLRDTARLVWGKNLAANCARALEISALEQVRQAWQTQKMHQSSKVSAEMASNLAGRQLTSAAIAHAHAFFTRNALQQLEALRKKDDLSPNVSLVLGQLVELFVIDTFLRQSGCVLRWNNGITGTQLRFVERRFEELLAKLRPNAVALVDGFDFHDRVLGSTLGCHDGRVYERLMEEARRNPVNQEPVNSSFHNHLLPMMRGKL

SEQ ID NO: 3072 - protein, 682 aa, Drosophila yakuba
MATSTSVIPNSVIPSTVNPDLQKERDGATVRSDEFAAWWAGGEEVLKFNRGVRKYLEKDVDTLEMLQLQNKTHEEIIEFSTRGAIEGAKKLRRLQEERNPRGEDYWPNLYDNQVMWGLVPGGNPFGVMYVMLVKALQAQCTPEQYADFGKRLERFEICGTYAQTELGHGTYLRGLETRADFDRKTDEFVLNTPKISSYKWWPGGLGHSSNHCLVMAQLYIDDKCKGPHMFFIQVRDEDTHEPLPGVHIGDIGKKMGFIGVNNGFLGLKNVRIPRTRMLMRHAQVKADGSYVSSPTNVLTYFAMVRTRCLIARNNAIMLAAASTIATRYSAVRRQSPIDPNEREPQIIDHVTQQMKLFPEIATSVAYRQASNYLWNLYDVTIQDIANGKYERLPELHSLSCALKVTCSMDSTSGVEKLRLACGGHGYLTSSNMSNIYVSATAACTYEGENTVLLLQIGRFLMKTWRAALTGAPLPPTVRYLAEVQKNPEFGTWTGSWENMVKAMQYAAANKTRLAFKSLSNRLSRGETETNSANHTGIEFTQAAELHGRAFVFSAFTEVVTGAKSKTRSANLNQVLENLLELYLVKETLNQMGHLLRFINLTDTDLSRLQDRLETVLTKLRPDAVAIVDGFDFSDLQLNSTLGSYDGNAYERIFDAALKNPMNQKAVPKSFHEILKPFMKSNI

SEQ ID NO: 3073 - protein, 677 aa, Drosophila yakuba
MSHIKNLIPSTVNPDLQKERTGAEFDVEEFSAWWHGGQDKLKRKREIEEAIFSDLEDGYGLNHEYMSHEEVYNSTVKKVAEAAVKLKALQNKLNPGGTDIWPGGLYNAQSYGLFPANHPVATHITMFVDVIKGQGTAEQAEKWGKAAANCNIIGTYAQTELAHGTNVRGLATRADFDPKTDEFVLNTPNLEAYKWWPGGLGHTANHAMVVAQLYIADVHHGVQMFIVPLRDSETHMPLPGVDIGEVGKKLGMASVNQGFLGLDHVRIPRTNMLMKFAKVERDGTFKASPASRINYLTMVYTRCLIVSQNSMLHLAAATIATRYSAVRRQSPIEPNQPEPQIIDHVTQRLKLFPEIATGIAYHLATEYVWEMYDQTVLEANNGKFERLPDMHILSCALKVLCTTDGCAGIERLRLSTGGHGYLIAANLSNIYGNAVAAYTYEGENTVLLLQIGRALVKAWASFVEQKPLSASYSYFATSMQLKEFPKWDDSWQCIIKALQYTAAHKTRIAFENLANRMASGQSQGAAANNTGIELTRAAELHGRQFVCQTFLEQITGAKAQKRSPALNRILENVLELFLVQTVLNNLNDILRFINLSDADLRSLQKRLEDALERFRPNAVAICDGFGFHDRVLNSVLGSYDGNVYPRLFDSAKRSTMNQKPVQTSFETHLKPLMKAKL

SEQ ID NO: 3074 - protein, 677 aa, Drosophila ananassae
MSHIKNLIPNTVNPDLQKERTGAEFDVEEFAAWWQGGQDKLKTKREIEKAIFSNLEDGYGLNHEYMSHEDVYNSSVKKVAEAAAKLKDLQNKINPGGNDIWPGLLFNVQSHGLFPANHPLATHITMFVDVIKGQGTPEQVEKWGKAAENCNIIGTYAQTELAHGTNVRGIATRADFDPKTDEFVLNTPNLEAYKWWPGGLGHTANHAMVVAQLYISNVHYGIQMFIVPLRHSETHMPLPGVDIGEVGKKLGMVAVNQGFLGLKNVRIPRSYMLMKFAKVERDGTFKASPVSRVNYLTMVYTRCLIVNLTSTLLLEAATIATRYSAVRRQSPIEENQPEPQIIDHVTQRLKLFPEIANGIAYHLAAEYMWEMYAQTVQEANNGKFDRLPDMHILSCALKVLCTTDGCAGIEKLRLSTGGHGYLTAANMSNIYGNAVAAYTYEGENTVLLLQIGRALVKAWAVFLEKKPISSSYSYFASSMELREFPKWDNSWQCIIKALQYTAAQKTRIAFENLASRMASGQSQGVAANNTGIELARAAELHGRQFVCQTFLNQITGPKAQKRSPALNKVLENVLELFLVQTVLNNLNDILRFINLTDADLRSLQKRLEVSLEKFRPNAVAICDGFGFHDRVLNSVLGSYDGNVYPRLFDSAKRSTMNQKPVQKSFETYLKPLMKANL

SEQ ID NO: 3075 - protein, 675 aa, Drosophila ananassae
MASSVIPKSVNPDLQKERDGASFNSEEFAAWWAGSEKELKFTRGVRDYLHKDVNLDEMLQIQNMSHEDINEFSIRTSIDAAKKLRRLQEERNPGGDEYWPNLYDNKVMWGLTPAGNPFGVMYVMLVKALQAQCTPEQYEEFGKRMEKFEICGTYAQTELGHGTYLRGLETRADFDPKTDEFVLNTPKISSYKFWPGGLGHSSNHCLIMAQLYINNESKGPHMFFIQVRDEETHEPLPGVHIGDIGKKMGFIGVNNGFLGLKNVRIPRTRMLMRHAKVNADGSYVSSPANVLTYFAMVRTRCVIAQNNALVLAGAATIATRYSAVRRQSPINPKEREPQILDHVTQQFKLFPEIATSLAHRLASDYLWKLYDATIDDIANGKYDRLPELHSLSCALKVTCSSDSAAGVERLRLACGGHGYLTSSNMSNLYVAATAACTYEGENTVLLLQIGRFLMKSWRSALSGAPLAPTVRYLSEVQKNPEFGTWTGTWENMVKAMEYTAAYKTRLAFKSLSNRLSRGESEGNAANQTGIEFTQAAELHGRAFIFSSFTTEVTGPNSKNRSAAFNRVLENLLELYLVKETLNQLSNLLRFINLTDTDLTRLQDRLETVLTKLRPDAVAIVDGFDFSDLQLNSTLGSFDGNAYERIFDAVLKNPMNQKLVPKSFHQYLKPFMKSNI

SEQ ID NO: 3076 - protein, 671 aa, Drosophila ananassae
MSVNSDLQRERAAAGLESEDFARWWAGGDAHLLERRSLEEHFYSDPRLQDAVHPSCLSYKERYEQTVAKATLFLAKLRAWQKAKHPQMSLDVNTLKDFRVLLSGSLGTGIFQQSFPLRLHFSMFMTTLLGQGTEEQQAQWLSRAWHMDGVVGTYAQTELGHGTYIRGLETRADYDPERQEFVLNTPTQSAYKWWPGGLGNTANVAIVLAQLYIQGKHHGLQSFLVRIRDERTHEPLPGIDVGDIGPRLGGNGVNNGFLGLKDVRIPRNQMMMKNAQVLPDGTFVQGRPPLLLYGTMVYVRVITVRDVLFCLLQAATIATRYSIVRRQSPIDADKPEVCVLDHITQQVKILPQIARGVSYRLVADWLWVFYEQVLLQLEANPPAGNSLPELHALSCCLKAVATDEASQGVDLLRKSCGGHGFLSSANFDSIYGMATAAYTYEGEYTVLLLQTARFLVRQYVDSLKRKVLPSSVSYLRDTARLVWGKDLVRNCVRALEYSALEEVRQAWQSQNIHRRSKVTDAMATNLAGRQMTAAAVAHGHAFLTRRALEELKKVQATKGVTEVLQQLVELFVLDTFLRQLGSVLRWNSLTGTQLRFVERRFEELLAALRPNALAIVDGFDFHDRVLGSTLGCHDGRVYERLMEEARRNPLNQEPVNVSFRSHLLPMMQGKL

SEQ ID NO: 3077 - protein, 706 aa, Micrococcus luteus
MTVTAPSLPEILPSYVAGSWWTPSHPSKVTDVTDANTGARLTGVSTDGLDTAAAIEHARTVGQQALGELTIHERALKLKELALYLNSRVQELYDVSFATGATQRDHAFDVDGGIGTLFTFSGKGRRELPNSNVIIDGDVEPLSRDGSFIGEHIYQRIPGVAVQINAFNFPVWGMLEKFAPAFVAGVPTVVKPATPTGYVTQKCVELMLESGVLPEGSIQLISGSARDLLDHLDYRDHVAFTGSAATAATLKKHPNVQEGGVRFTAETDSLNAAILGPDADPESPEFEAFVKVVFQEMTVKAGQKCTAIRRVIVPQDRVEAVTAALTERLAAKVVLGDPRVEGTTRGILASKEQQGEVRGAVQRLVDAGGQVRLGGPEGSTGDADAESGAFFAPTVLTFEDARTPEVHSVEAFGPVTSVIGYTDVADAVALATLGSGSLVATVATNDGEIARAFAAGIGAHHGRVHVLNRQTAATTTGHGAPVPVLIHGGPGRAGGGEELGGVRAVKHYMQRTAIQGSPDMLTAITGVWHQGAAAHTVTREDVEAGTAVHPFYKSLAELTVGDQFASGLRTVTLEDITAFAEETGDRFYAHTDEEAAMANPFFPRRVAHGYLLVSWAAGLFVAPDPGPVLANYGLENLRFITPVTYDDAIRVTLTAKRITPRVSDEYGEVVWDCRIHNQKDELCAQYDVLTLVAKTWPMASSETSQG

SEQ ID NO: 3078 - protein, 694 aa, Pyrenophora teres; identical to SEQ ID NO: 2967

SEQ ID NO: 3079 - protein, 430 aa, Deinococcus geothermalis; identical to SEQ ID NO: 2793

SEQ ID NO: 3080 - protein, 452 aa, Chryseobacterium gleum
MSNTFSKIRNAIGLFTSIDFDQLSAISQKVDLPKLMHNFSKLDDKQLSGLMKMLDPDKKKKELPPIDGDFYDIYHTLSPEQREIQLKVRAFMEKEVKPLVNHYWLRDEFPFELIPKFQKLDICGVTYQGYGCPGMPFLMEGVIAMEMARIDASIATFFGVQSGLAMGSIYICGSEEQKQKWLPQMQKFEKIGAFGLTEPEVGSGAAGGLTVTCRKTPEGWVLNGQKKWIGNATFADLVIIWARDLDSGEVKGFIVEKDNPGYSVEKIKGKMALRIVQNGLITLKDCLITEENRLQNANSFKDTGKVLRMTRAGVAWMATGCARGAYESALDYTRKREQFGRPIASFQMIQGHLVEMLSNLTAMQTMVFRLSEMQDEGILKDEHASLAKVFCTLRTRDIVSRAREVMGGNGILLEYDVARFVADAEAIYSYEGTKEINSLIVGRSITGFSAFV

SEQ ID NO: 3081 - protein, 831 aa, Chryseobacterium gleum
MEKLKNYIYGQWVEGTGNGVPLYNAVTGEQVAVSDTEGLNFEQALDYGRTVGYKNLSSMTFYDRGEMLKKVALYLLERKKKYYELSYKTGATHVDSWVDIEGGFGTFFTYSGLAKRMLPNTPFWVDGDTQKISANGTHLGTHILTPSEGVSIQINAYNFPVWGMLEKLSTSLLAGVPSIVKPSPFGSYLTNAVFQDMIESGVLPEGAVQLVCGEPGNILDYVQDGDSVLFTGSAHTGRKLKSLPSIAGNAVRFNMEADSLNCSILGLEAKPGTPEFDLFIKEVRNEMTTKAGQKCTAIRRIIVPEHLIGDVQNALSKALDQTKIGNPLSRETRMGSLVGRQQYEEVLRKVNLLKSETELVYDGKHELVDANYENGAFMSPKLFLNDKPFEKNISHDVEAFGPVSTLMPYRDAEEAAALAKRGKGSLVGSIVSQDENFIAETSWKMASQHGRIFVLNRDNAKESTGHGSPLPTLMHGGPGRAGGGEEMGGLSGLHFFLQKTAIQGSPDVLKAITKIYQQGAEKKFSDKHPFQKYFEEVEVGDSLETAGRTVTEADIVNFSNVSWDHFYAHTDATSLTGTIFDKTVAHGYFILSAAAGLFVSGKKGPVIANYGLEDCSFFKPVYAGDTITVYLTAKEKINRGVKGRNIPSGVVKWLVEVVNQRDEVVCVATILTLVAKQSPFIDLNVKNVHKILSGLTESTPALWGKMSPQQMIEHLEKAVLVSFGEPEAEKCFTPEENIEKWQDSLYNHRAMPKEFTAPFLPQDGSLPEPVHKNLEAAKQSFMDNLKKFVIYYKENPQAEHMNYVFGKLNKEMWELMHRKHFTHHFQQFGLI

SEQ ID NO: 3082 - protein, 450 aa, Sphingobacterium spiritivorum
MFDKIKNMMGLMKSVDLEQIEKISKKIDLKQVMEAISKMDDKQLQAVTKMLTGGGNKKKELPPINGDFYDIDAKLSPEDRALQLKVRSFMETEIKPIVNNYWLRDEFPFEIIPKFAALNIAGYTYEGYGCAGGTSLMEGVVAAEIARVDASIATFFGVQSGLAMGSIYICGSDEQKQEWLPKMQKMEVIGAFGLTEPEVGSGAAGGLTTTCQKTEQGWVLNGQKKWIGNSTFSDITIVWARDLDDGEVKGFIVRKETPGFEVEKIKGKMALRIVQNGLITMTNCVVAESDRLQNANSFKDTAKVLQMTRAGVAWMAVGCARGAYENALDYTRQRKQFGKPIAAFQLIQNHLVEMLSNLTAMQTLVFRLSELQDAGQLKDEHASLAKVFCSLRTRDIVSKAREVMGGNGILLEYNVARFLADAEAIYSYEGTKEINSLIVGRSITGFSAFV

SEQ ID NO: 3083 - protein, 402 aa, Eremococcus coleocola; identical to SEQ ID NO: 3044

SEQ ID NO: 3084 - protein, 401 aa, Eremococcus coleocola; identical to SEQ ID NO: 3042

SEQ ID NO: 3085 - protein, 401 aa, Eremococcus coleocola; identical to SEQ ID NO: 3043

SEQ ID NO: 3086 - protein, 436 aa, Zea mays
MAGKRVTGRDGQDEGGAKVGLPAMDLSLAFPQATPASIFPPSASDYYPSDDLLTSEERSIRMKVRGIMEKEIAPIMSAYWEKAEFPFNAIPKLASLGVAGGTIKGYGCPGLSITASAVTMSEIARVYASCSTFILVHSSLAMVTIALCGSEAQKQKYLPSLAQLTTVGCWALTEPNYGSDASSLRTLATKAPGGWHIDGQKRWIGNSTFADVLVVLARNADTQQLNGFIVRKGAPGLKATKIENKIGLRMVQNGDIVLNKVFVPDEDRLPGINSFQDISKVLAISRIMVAWQPVGISMGVFDMCHRYLKERKQFGVPLAAFQLNQEKLARMLGNVQSMVLVGWRLCKLYESGKMTPGHASLGKAWNSRTAREVVSLGRELLGGNGILADFLVAKAFCDLEPIYSYEGTYDINSLVTGREVTGIASFRPAAPAKARL

SEQ ID NO: 3087 - protein, 408 aa, Corynebacterium genitalium
MTSASPLATDLINFDSLLSRDEIEWRDDIRSFVESEIKPHVGQWYEDAHVPFELIPRFAEKGMIGAHLSGYGCPGRSAVDYGLAMLEVEAADSGLRTIFSVLGSLAMTSIHLNGTEEQKEKYLPKMAAGELLGAFGLTEPTAGSDPASMTTRATYKPGEGWVLNGEKRWIGLSHYADLTIIWAKVSTADLEAAGLDGFPEGRDETIAGFIVEKDTPGFDPQQIDKKLSMRVSTQAHIYMKDALVGEDKILSGRFGLKAPFMCLNEARYGIGWGVLGAARDSIECALAYAKERTQFGKPLAGFQLTQKKLVDMAVGLNQGYLLALHIGRQKDAGTLDISQISVAKLQNTRTAIEIAREARTILGGNGVTHDYSPIRHAANLESVRTYEGTDEMHTLILGQKMTGIGAFA

SEQ ID NO: 3088 - protein, 698 aa, Corynebacterium ammoniagenes
MTTSIIDTIVPSFLSGKWQTPDDPSKVTDVADPSTGEIVARVSAEGLDIAAAVEYARTGGRKNLQELTIHERSLKVKELAIFLQDHRDELNQLAHQTGANKRDNFVDVDGGISTMFTISSKGRREMPNSHVVTDGEPEVLSQDGSFLGRHIYTTIPGIAVQINAFNFPVWGMLEKFAPSFIAGVPSIVKPATPTGFVTQALVRLMLESGILPEGSLQLISGSARDLLDHLDFRDHVAFTGSAATAHTLRAHKNVLEGGVQFTAEADSLNAAILGTDVTEDAPEFEAYTKAVFNEMTSKAGQKCTAIRRAIVPNNLVEPFIAALSQRLDSKVVAGDPRDADATMGPLVSTEQRDDVAAAVHTLVDAGGEVVYGGADKLDGAFFAPTILRFADATTEAVHSTEAFGPVVSVIGYDEPTEAVELAAQGAGSLVASVITHDDELAALYGRGIAAYHGRVHFLDRVDAKTSTGHGSPLPHLVHGGPGRAGGGEELGGIRGILHYMQRTAIQGSPDHLTAVVGQWHRGAAVNRVTRKDVEAGTGVHPFRKDLATLKIGDQFASDLRKVTLEEILAFAKETGDTFYAHTDEEAAMANPFFPRRVAHGYLLVSWAAGLFVEPAPGPVLANYGLENLRFIEPVTYDDSIRIELTAKRITPRVTDDYGEVCWDAALYNQDDVLVASYDVLTLVEKVDTLYAEKQIVSQ

SEQ ID NO: 3089 - protein, 680 aa, Brevibacterium mcbrellneri
MNAKAPLSVDVDYLRRFLEGDRASVREKGREFAAHSALRLKPEWSLERKRQATLEGVVALANAGFTTLSMPKHLGGPEDYASYVAGFEELVLAEPSIQIKAGVQYGLFSGAIHHLGNKEQHARWLKDALEGKLLGSFAMTEIGHGSDVANVDTTATYDPAKQEFVIHTPHRQAVKEYIGNAAAHAQAAVVFARLITSGIDYGVHAFFVPVRSEGGRPLPGVTIEDDGYKGGLAGVDNGRFGFDQVRIPRENLLDRYGHVAEDGEYSSPIHSPGKRFFTMLGTLVMGRVSLDGASTVASKLALDIALRYAVHRKQFEGGVPGESVHLMDYGEHQRRLMPLVAKAWANSVAHENLLDTFDEVFSSEAPPEATRQLLESQAAGFKAVSTWDALDTIQECREACGGAGFMWDNRLVGLRHDLDVYVTFEGDNTVLLQLVGKRLLQDYSRELKDIDFGGAARYLSHQAAEHSLYRSGIASMGRTIGDLFTPALASKRIRSGQLQEALLSSRVDSMLSDLAQKLRPAAKMDRQAAADLFNAHQHQLIQTAEAYIHLLKWKALTARLRAIDTTEHPDEAKMLRRIRDLYGLTLIHEHIGWHVMYGRLSMARARMVEPTIGRLCRKLAQNAQDLADMFGFTSEHRRTQISEGQEAARQNEATAHARQARSRTDYPIDERIIRAKKKKS

SEQ ID NO: 3090 - protein, 408 aa, Micrococcus luteus
MTTPFHAEADSFLGRADVVGLDSLFSAEEKAVALKVRGFVDEHIRPHIARWYDDAVFPREIVPELGRLGVLGMPYEGHGMPGRSAVEYGLAAQELEAGDSGLRTFVSVQGSLAMGAIHKHGSEEQKAQWLPRMTTGEAVGCFGLTEPGAGSDPASMTTTARQEPGGDWVLDGVKRWIGLATLADVAIIWAQTGEPGDGRGVRGFVVPTDTPGFRAEAITQKLSMRASVQCEIHLDGVRLPASAMLPADSAVGLKGPFQCLNEARYGIIWGAMGAARDSFDAVLDYAMQRQQFGVPLASHQLTQAKLADMAVAIGKGYLLAHQIGRAKDAGPLTPAMISAGKLDNCRVAIGIAREAREMLGGNGITLEHSPLRHANNLESVRTYEGTDEVHQLTLGRHLTGIGAFAPAR

SEQ ID NO: 3091 - protein, 404 aa, Micrococcus luteus
MTETLPTVEPEYDVAMPLDTDFYLALADVSDAEKDVWRRARAFALEPDVLPRIREAWDRHEYPLDLVARLGQADLLRDGVPVDGLPDVSRVAAGLAMMELSRLDGSIATMTGVQGGLAMRSIQLCGSEEQRAEHLPAMARGELYGAFALTEPTHGSDSVSLETRAERVDSGWRLHGHKKWIGNGAAGGVTVVWARSAEDEKVRGFIVRQESEGYTAEVIKGKVALRAIDQAHITLDGVFVPDADVLPEARSFKDTSRVLFATRVGVAWSALGKAVGCYEAAVQYAGQRVQFGRPLAAAQSVQTRLAEMLSQLTQVQLLVLRATRLEDEGRLTGPMASMAKYSATRAARSIAANARDLLGGNGILIQNEVARHFADIEAIHTYEGTETVQGLIIGREITGVGAFV

SEQ ID NO: 3092 - protein, 402 aa, Micrococcus luteus
MTALADRPVPASGAPAVAPGLPHVDLLRLRGRLESAERARLDAIEDHLQTRVRPHLTRYWDAEEFAFDLLPGLAELGLGRLVLDGSSSLFQQLVHAEIARVDLSLSALVGIHNELNLGMIAGLGSERQKATWQGRLESFDALGAFCLTEPDHGSDIAGGLATTATRDGDEWVIRGAKRWIGAGTIADVALVWARDTADGEIKGFVVPTDTPGYEATKISGKMGLRIMQNADITLDVRLPADAILPGATTFAATRALLRDSRMWVGWQGVGAQMGVLDVLRSYALRREQFGRPLAAFQLIQAQIAEVAGNLAASAGMMLQVDALRQEGRMEMMHAAMAKATSTRLARSSAALARDALGGNGLLTEHEIAKIMGDVEAIYSYEGSYGMNTLIVGRALTGVSAFV

SEQ ID NO: 3093 - protein, 706 aa, Micrococcus luteus
MTVTAPSLPEILPSYVAGSWWTPSHPSTVTDVTDANTGARLTGVSTDGLDTAALIEHARTVGQQTLGELTIHERALKLKELALYLNSRVQELYDVSFATGATQRDHAFDVDGGIGTLFTFSGKGRRELPNSTVIIDGDVEPLSRDGSFIGEHIYQRIPGVAVQINAFNFPVWGMLEKFAPAFVAGVPTVVKPATPTGYVTQKCVELMLESGVLPEGSIQLISGSARDLLDHLDYRDHVAFTGSAATAATLKKHPNVQEGGVRFTAETDSLNAAILGPDADPESPEFEAFVKVVFQEMTVKAGQKCTAIRRVIVPQDRVEAVTAALTERLAAKVVLGDPRVEGTTMGALASKEQQGEVRGAVQRLVDAGGQVRLGGPEGSTGGADAESGAFFAPTVLTFEDARTPEVHSVEAFGPVTSVIGYTDVADAVALAALGSGSLVATVATNDGETARAFAAGIGAHHGRVHVLNRQTAATTTGHGAPVPVLVHGGPGRAGGGEELGGVRAVKHYMQRTAIQGSPDMLTAITGVWHQGAAAHTVTREDVEAGTAVHPFYKSLAELTVGDQFASGLRTVTLEDITAFAEETGDRFYAHTDEEAAMANPFFPRRVAHGYLLVSWAAGLFVAPDPGPVLANYGLENLRFITPVTYDDAIRVTLTAKRITPRVSDEYGEVAWDCRIHNQKDELCAQYDVLTLVAKTWPMAPSEASQG

SEQ ID NO: 3094 - protein, 680 aa, Rhodococcus erythropolis
MSRLLESYVAGQWYAAPDAGTPLPSAVDGSEVARISATGIDLAEMVTYAREVGGPALSAMTFHERAGALKALALTLMAGKAEFYTLSTATGATTRDSGVDIDGGFGTLLSYASKARRELPDSTVFLDGNVEALGKGGTFLGQHIYTSRRGVAVQINAFNFPVWGFLEKLAPAFIAGVPSIVKPASSTAYLTELVFRRIIESGLLPEGSVQLLSGSARGLLDHLGGQDSVAFTGSADTAATLRAHPNVVGKGVHFNAEADSLNASILGEDAVPGTPEFDLYVKQLVTEMTVKAGQKCTAIRRALVPVSLVDAVVDAASERLNKVVVGHPDADGVTMGALASIEQRDEVLKSIRGLTKSATIVFGDPDNVDVVGADGQSGAFLSPVLLRAEENAHEVHELEAFGPVSTVIGYDGIDHAIELAARGEGSLVASVVTADTDIARRLVLGLAAFHGRVLVLNRDDAKESTGHGSPLPVLVHGGPGRAGGGEELGGIRGVLHHMQRTAVQGTPDVLTAVGERWFTGSQRTTGSEHPFRKSLAELKIGDTVVGGPRQVTLADIDHFAEFTGDTFYAHTDPVAAAANPLFGGIVAHGYLVVSLAAGLFVDPAPGPVLANFGVDSLRFLTPVKAEDSLTVTLTAKTITPRSSADYGEVRWDAVVTNQDNDPVATYDVLTLVAKTRPEGN

SEQ ID NO: 3095 - protein, 846 aa, unidentified eubacterium
MQKTQHYIQGQWQSGNGEGIPVFDAITGEHFTSTTVEGLDVPSILQYGRDKGDTLRKMTFQQRGNMLKSLALYLTKRKKAFYDISYRTGATKRDSWVDIEGGFGNLFANASLRKLFPNQSYHVEGDPIDLSRGGRFMAHHIMVPREGVAVHINAFNFPVWGMLEKCAVNWMAGMPAVVLPAPQTAYLTEAVVREIIASGILPEGALQLISGTTKNILDTVGSQDVVTFTGSAKIGRILKNHPQLTAESVPFTMEADSLNAAILGKDAVPGTPEFDLFVKEVRNEMTTKCGQKCTAIRRIIVPENLVGDVQSALIKQLDKVTIGDPRLREVRMGSLVSDAQRNSVREQVAKISETAEIVYGNSNDFEAIGADAQKGAFMKPVLLREDQPLQNEAAHVTEAFGPVSTIMPYKTLEDAITLAKMGKGSLVSSIVTNDDTIARDYAVNAASHHGRILILNRESAKQSTGHGSPLPGLIHGGPGRAGGGEEMGGMRGVKHYLQRCAIQGSPTSLTEVTGIYQPKADYKESPKHPFAYHWEDIKPGMSLKTHNRTITDTDIVNFGNITWDHFYAHTDTTSLDGSIFEKRTAHGYFIISMAAGLFVYPNKGPVAANYGLEEIRFLRPIYDGDTLYVRLTCKQKIDRDSRGTEHPSGIVKWYVEIFDKNVDTANAILPEGAEKEDPLVCIATILTMVEKKQEVFTEMTNETIQSCLNKLSEDSKPQWGIMTPQHMLEHLEYTYKIASGEIQDFEISTPEKYIDIIHDSLYNYKKFPQNSQFPQLEKETLAPLVHEDLQTAKEKFLEQRFKYLAFFKENPDAVLKNLVFGELNKYESYLLERKHLNHHFEQFNLL

SEQ ID NO: 3096 - protein, 674 aa, Sulfitobacter sp.; identical to SEQ ID NO: 2839

SEQ ID NO: 3097 - protein, 410 aa, Corynebacterium efficiens; identical to SEQ ID NO: 2797

SEQ ID NO: 3098 - protein, 420 aa, Corynebacterium efficiens; identical to SEQ ID NO: 2796

SEQ ID NO: 3099 - protein, 408 aa, Corynebacterium efficiens
MPMPTGQLSADVVEHADYLLLDADFTQGERVLRDQVRAFGKEHILPIINDYWERAEFPYEILEPLAGLGLAGTVIKGYGCPGLSRLENGIVSRELGRIDGSICTFFGVHSGLSMGSINILGSEEQRRRWLPDMAKFRKTGAFALTEPNHGSDSVSLETSARREGDSWVLNGHKRWIGNGHAGDIIVVYARDEADQQVKAFVVEKQRNGEYPPGYRAEVITGKTGKRAILQGDIVIDNLRIPEENRLTNCHSFKDVNRVLAATRGGVAWESTGHAMAGFELAAQYALQRHQFGSPIASYQLVQTKLAHMLADVVENQLLCVRMAELQERGEFSTPMASLTKMTTAKNALSICREARDMMGGNGLLLNNHIARHMTDMEVSYTYEGTDSIQALIVGRDITGISAFTHSRK

SEQ ID NO: 3100 - protein, 832 aa, Flavobacteriales bacterium
MEKIQHYVQGSWTTGKEEGTPILDAVTGEVFTSVAIEGLDIPEILQYGRTKGGEVLRRMTFQERGNMLKKLALYLTKRKDVFYELSYRTGATKVDSWIDIEGGFGNLFANASLRKLFPNQPYHVEGDAIDLSRGGRFMAHHIMVPKKGVAVHINAFNFPVWGMLEKCAVNWMAGVPAVVLPAPSSSYLAEAVARTIIDSGILPEGALQIINGTVKTILDTVESQDVVTFTGSAQTGRLLKAHPRLIQESVPFTMEADSLNASILGEDAAPGTPEFDLFIKEVRKEMTVKAGQKCTAIRRIIVPENLVEDVQISLGKALDKVTIGDPRLKEVRMGSLVSQQQVQAVRDSVNDLAKEAQIVYGDLDKIETIGADAKKGAFISPILLRADHPFQNTVIHEREAFGPVSTIMPYKNLDEAITLAQMGKGSLVSSIATNDDKIAKEYVVNAASHHGRILVLNRESAKESTGHGSPLPYLVHGGPGRAGGGEEMGGMRGIKHYLQRTAIQGSPTTITEITGIYQANAKYKEAEQHPFKYHWEDIEAGMSMKTHKRTITDTDIISFANVTWDHFYAHTDITSLDGSIFEKRTAHGYFIISAAAGLFVHPNKGPVSANYGLEECRFLRPLYHNDTIYVRLTCKQKIDRDVASAEHPSGIVKWFAEIFDADDELVALATVLTMVQKKQETFVEMSDDKIDECLSKLTEDMKPKWGIMTPQHMIEHLEYTYKIAAGEIQDFEISTPEKILEKVKNSLWNYTKFPKNSQFPLLEKDTLDDLKHDNLATAIEKFKSQRESYLEYFKENPDTTLPNMVFGELNKYEWYLVERKHLNHHFEQFGLI

SEQ ID NO: 3101 - protein, 677 aa, Hoeflea phototrophica
MDLINVNSYLAGHWTPADAGARAIFSAVTGDKLALAGQDAIDTQAMLDHARLKGGPALRAMSFHDRARMLKALALELGKFKDELYALSHTTGATLADGKIDIDGGIGTMLVYASKGRREMPDRHIYVDGDLEMLSRAGTFVGQHIATPLQGVAVHINAFNFPVWGMLEKLAPTLLAGMPAIIKPATATCHVTEQCFRRMIESGLLPEGAVQLVAGGLGNLLNRLDYQDVVSFTGSAQTALMLRSNPHLLENSVRFIAEQDSLNASVLGPDATPDSPEFDILVKEAVREMTAKAGQKCTAIRRIMVPEALLGPVGDAIAAKLATIRIGDPALETTRMGALASSAQKSDVLDKARQISAECRILSGNPETFEVDGADKTKGAFVAPMLLACDDPDAAQAVHAVEAFGPVATLMPYRDLAHAGELLNRGRGSLVASLITHDPAAARTIALSSAASHGRLYVNNRDSAGEATGHGSPLPHMVHGGPGRAGGGEELGGIRGVMHYMQRTAIQGSPDIISGITGTWIKGAAKPKSASHPFTRSFEELAIGDTIEAGPRTVTLEDIEHFAHFTGDTFYAHMDEAAAKANPFFPGRVAHGYLLLSFAAGLFVEPAPGPVLANTGLDGLKFMKPVSPGDAISVELTVKRKTRRTDEYGEVRWHVAVLNQDGDDVAEYELHTMNAYA

SEQ ID NO: 3102 - protein, 830 aa, Kordia algicida
MTLQSYINGQWTQGTGEGSPMFDAVTGETIGFATTEGLDIPAALQYGRTKGGEKLRKMTFQERGNMLKKLALYLNKRKEQFYDISYKTGATRVDSWIDIEGGFGNLFANASLRKLFPNQPFHVEGDPIDLSRGGRFMAHHILVPKRGVAVHINAFNFPVWGMLEKCAVNWMAGMAAVVLPAPQTAYLTEAVVRVIVDSGILPEGALQLLSGMTKSILDTVESQDVVTFTGSAHTGRILKAHPRLTQEAVPFTMEADSLNCSVLGEDAVPGTPEFDLFIKEVRKEMTVKTGQKCTAIRRIIVPENLVEDVQIALGKQLSKVTIGDPRLKEVRMGALINKTQVQSVKDQVSKLAKTADIVYGTLDNIDAVGADGEKGAFLSPILLRENNPFKNTNVHEIEAFGPVSTIMPYKNMDEAIELAQMGKGSLVSSIFTNDDTKAREYVVGAASHHGRILVGNRDMAKQSTGHGSPLPLLVHGGPGRAGGGEEMGGMRGIKHYMQRCAIQGSPTTLTEVTGIYQANAKYKETPKHPFAYHWEDIEAGMSLKTHKRTITDTDIINFGNLTWDHFYAHTDITSLDGSIFEKRTAHGYFIISAAAGLFVYPNKGPVAANYGLEECRFLRPIYHNDTVYVRLTCKEKVDRDSRGKELPSGIVKWFVEVFDQEDELVAIATILTMVQKKNPFKTINKTTIQNYLGKLTEDTKPAWGTMSPQQMVEHLEYTLKVASGEIQDFEIETPEKYLEKVHDSLYTHDKMPRNFDAPKLLEKLITESRYENLAEAKAKLLEAYDAFELYFKENPEATTKNAVFGHLDKFEWNLMNTKHFNHHFEQFGLL

SEQ ID NO: 3103 - protein, 674 aa, Oceanibulbus indolifex
MRDIQSFAAGEWLAPGAGARNIASAITGDVIAQAGNDALDVQAMLGFARDHGGPALRAMTFHDRARMLKALALHLMEHKQALYDLSYDTGATLSDHKIDVDGGIGTMLVFASKGRREMPDAHVYLDGAPEQLGREGQFMGRHICTPLQGVAVHINAFNFPVWGMLEKLAPTLLAGVPAIVKPATATCYVTEHCVRLMLDSGLLPKGALQLVSGGLGDMLDHLDCQDAVAFTGSADTALKLRSNPVLLQNSVRFTSEQDSLNASVLGPDATPGTPEFDLFVKEVQREMTAKAGQKCTAIRRIMVPQAQIDAVIAALSERLAKTTIGDPRDESTRMGALVSNSQKRDVLEKVALLSAEAERVFGDPDNFTVKGADKDKGAFLPPMLFHCADPDKAERVHDTEAFGPVSTLMPYRDLPHASALLNRGQGSLVASIITNDGEVARELTIGSAAFHGRLYFNNRTSMKEATGHGSPLPHMVHGGPGRAGGGEELGGIRGVMHYMQRTAVQGSPDILTAIGKQWVPGAQEITDRDHPFTRRFTELDLGETFYSKSREISLDDIETFANFTGDTFYAHMDDEAAAANPFFPGRVAHGYLLLSFAAGLFVQPDPGPVLANTGLDNLRFLEPVSAGDSMKVRLTVKHKTPRNEEYGEVRWHVTLTNQREEAVAEYDLLTMNAL

SEQ ID NO: 3104 - protein, 676 aa, Phaeobacter gallaeciensis
MSLLDVSSFAAGQWIAPGAGARSIASAITGAPLAQAGNDALDVQGMLDYARTVGGPSLRKLTFHDRARMLKALAGHLNQHKQALYDLSFNTGATQADHMIDIDGGIGTMFVFASKGRREMPDAHVYLDGDIEQLSRNGTFLGQHICTPLQGVAVHINAFNFPVWGMLEKLAPTLLAGVPAIVKPATATCYVTELAVRLMLESGILPEGALQLVSGGLGDMLDHLTMQDMVSFTGSAQTALKLRANPVILENSIRFVAEQDSLNASILGPDAVPGTPEFDLFVKEVSREMTTKAGQKCTAIRRIIAPDAQVEAVIEALSARLAKTQIGDPRLETTRMGALVSNSQKRDVLEKAAIIGQEAERVFGDPENFSVDGADSEKGAFVPPMLFHCADPDKAQRVHDTEAFGPVSTIMGYRDLDHAITLANRGEGSLVASVITHDAEVARAVALGAGAYHGRLYFNNRDSMKESTGHGSPLPHMVHGGPGRAGGGEELGGVRGVKHYMQRTAIQGSPDILSAIGGKWVPGGAEIAAKVHPFTRKFGDLELGETLHSAARQITLEDIETFAKFTGDTFYAHMDDEAAARNPFFPGRVAHGYLLISFAAGLFVQPDEGPVLANTGLDNLRFMKPVSAGDSIKVRLTVKKKTPRNEDYGEVRWHVTLTNQDDEIAAEYELLTMNAF

SEQ ID NO: 3105 - protein, 676 aa, Phaeobacter gallaeciensis
MSLLDVSSFAAGQWIAPGAGARSIASAITGAPLAQAGNDALDVQGMLDYARTVGGPSLRKLTFHDRARMLKALAGHLNQHKQALYDLSFNTGATQSDHMIDIDGGIGTMFVFASKGRREMPDAHVYLDGDIEQLSRNGTFLGQHICTPLQGVAVHINAFNFPVWGMLEKLAPTLLAGVPAIVKPATATCYVTELAVRLMLESGILPEGALQLVSGGLGDMLDHLTMQDVVSFTGSAQTALKLRANPVILENSIRFVAEQDSLNASILGPDAGPGTPEFDLFVKEVSREMTTKAGQKCTAIRRIIAPDAQVEAVIEALSARLAKTRIGDPRLETTRMGALVSNSQKRDVLEKAAIIGQEAERVFGDPENFSVDGADAEKGAFVPPMLFHCADPDKAQRVHDTEAFGPVSTIMGYHDLDHAITLANRGEGSLVASVITHDTEVAREVALGAGAYHGRLYFNNRDSMKESTGHGSPLPHMVHGGPGRAGGGEELGGVRGVKHYMQRTAIQGSPDILSAIGEQWVPGGTEIAAKVHPFTRKFGDLELGETLHSAARQITLEDIETFAHFTGDTFYAHMDDEAAARNPFFPGRVAHGYLLISFAAGLFVQPDEGPVLANTGLDNLRFMKPVSAGDSIKVRLTVKKKTPRNEDYGQVRWHVTLTNQDDEIAAEYELLTMNAF

SEQ ID NO: 3106 - protein, 676 aa, Roseobacter sp.; identical to SEQ ID NO: 2835

SEQ ID NO: 3107 - protein, 676 aa, Rhodobacterales bacterium
MGLLQVSSFVAGEWIAPGSGARSIENAVTGEVMATAGNNALDSQAMLDYARNTGGAALRNMTFHDRARMLKALATYLNERKQQLYDLSFNTGATQSDNMIDIDGGIGTMFVFASKGRREMPDALVYQDGDLEQLSRNGSFLGQHIYTPMRGVAVHINAFNFPVWGMLEKLAPTLLAGMPAIVKPATSTCYVAEACVRMMLESGLLPKGAVQLVSGGLGDMLDRLKTQDAVAFTGSADTALMLRSAPNIVENGIRFASEQDSLNASILGPDAKPNTPEFDLFIKEVSREMTAKAGQKCTAIRRIIAPEDCQQAIIDALSVRLGKTTIGDPRSEGTRMGALVSNGQRQDVLKKAALIGTEADCVFGDPDRFDVSGADAQKGAFVPPMLFHCTDPDSAQRVHDTEAFGPVATLMPYRDLDHAAELANRGQGSLVASLITNDGDVARQVVMNAAAWHGRIYINNRTSMKEATGHGSPLPHMVHGGPGRAGGGEELGGIRGVLHYMQRTAIQGSPDMLTAVCGTWVPESAEITAPAHPFTRSFTDLAIGETIHTGSREISLKDIETFAYFTGDTFYAHMDETAAAANPFFPGRVAHGYLLLSFAAGMFVEPNPGPVLANTGLDNLRFMKPVQAGDSIKVRLTVKKKTKRNDEYGEVRWHVTLSNQDDEKVAEYELLTMNAY

SEQ ID NO: 3108 - protein, 846 aa, Flavobacteria bacterium; identical to SEQ ID NO: 2836

SEQ ID NO: 3109 - protein, 676 aa, Roseobacter sp.; identical to SEQ ID NO: 2837

SEQ ID NO: 3110 - protein, 678 aa, Maritimibacter alkaliphilus
MTMTIMDVSSYAAGEWVKPGAGARNIASAVTGEVIATAGNDSLDVQAMLDHARNVGGPNLRKMGFHERAKMLKALGQYLTEHKQKLYDISFATGATQGDHGFDIDGGIGTLYVFASKGRRELPDGHVLLDGDVEEFSRHGTFKGQHIYTPMQGVAVHINAYNFPVWGMLEKLAPTLLGGMPAIVKPATATSYVTELCVKLMLDSGLLPEGALQLVAGGTGDMLDRLTCQDVVSFTGSADTALKLRSTPAILQNAVRFTAEADSLNSSILGPDAEPGTPEFDLFVKEVQREMTVKAGQKCTAIRRILAPESHVEAVIDALRERLAKNVIGDPANESTRMGALVSTGQRADVLEKIAILGTEAERVIGDPDNFEVHGADREKGAFLPPMLYHCANPDAATKVHETEAFGPVSTIMGYRDLDHAIDLANRGQGSLVTSLISNDPDTAIKVATGAGAYHGRIYINNRTSMKESTGHGAPLPHMIHGGPGRAGGGEEMGGIRGVKHFMQRTAIQGSPDMLQAIGNQFVPGATEKPAPAHPFTRTFTDLEIGETITTDARQITLDDIEHFATFTGDTFYAHMDAEAAKRNPFFPDRVAHGYLLLSFAAGLFVEPNEGPVLANTGLDDLRFMQPVVAGDSIHVKLTVKRKTRRTDAYGEVRWHVTILNQDEALVANYTLLTMNAY

SEQ ID NO: 3111 - protein, 403 aa, Oceanicaulis alexandrii; identical to SEQ ID NO: 2838

SEQ ID NO: 3112 - protein, 674 aa, Sulfitobacter sp.; identical to SEQ ID NO: 2840

SEQ ID NO: 3113 - protein, 675 aa, Streptomyces sp.
MVLLRSYVSGGWHTAPGEGVPLHDAATGEEVARISSEGIDFAAALDYGRKVGGPALRKLTFHQRAALLKSLASHLREHREELYALSARTGATLGDSKFDIDGGIGVLFSYGSKGKRELPNDTVYVEGAVEPLSRGGTFVAQHIATPLQGVAIQINAFNFPVWGPLEKFAPAFLAGVPSLIKPASQTAYLTARLVELIVESGILPDAAVQFVAGSVGDLLDHVTAQDLVSFTGSASTAQKLRAHPAIVRNSVRFNAEADSLNCSILAPDARPSTPEFDLFVKQLTTEMTVKAGQKCTAIRRAFVPAEMLDDVAEAVSARLAKVTVGNPNAEGVRMGALASLEQREEVRRSLKALLDAGSIVFGDPDHVDVVDGDEATGAFISPILLKADPERAEPHEVEAFGPVSTLMPYTSVKQVIEFAARGGGSLAGSVVTGDPVFAREIVLGVAPYHGRLLVLDSEDAKESTGHGSPMPQLVHGGPGRAGGGEEMGGIRGVLHHMQRTAVQGSPKVLGAVTGRWVEGGPRVEGEHPFRKSLAELSIGDTVVAGPRTVTRADIDHFAEFTGDTFYAHTDEAAAAANPLFGGIVAHGYLVVSFAAGLFVSPEPGPVLANYGLENLRFLTPVKVDDQLTVTLTAKQITPRIDQEYGEVRWDADVTNQDGDSVAKYDVLTLVSKEQP

SEQ ID NO: 3114 - protein, 435 aa, Streptomyces sp.
MAGDGPTTAPALHGVPASNDQVRAVRRHGGTKAVRTMAERRHGSEAGAVEGDFFGIVDLLDGEERKLLDRVREFLRAEVAPHANELWEAGRSPVSLRGRIAELGITGEEGDDAGVPARSSLFRGLLGMEMARVDPSFATFFGVHAELAMGSVRACGSEEQKARWLPAMTRWEKLGAFALTEPLVGSGTAAGLTTTARREGDTWVLDGEKKWIGNGSFADLLVVWARDVADDQVKGFVVEHGAAGLSADVIPHKIALRGVQNAHLALDGVRVPETDRLQHAESFADTNRVLRVTRAAVAWTATGCALGAYEAARAYAVEREQFGRPIGSFQLVQDNLARMLADITACQSLAVRLAALEEKDELSDAQAALAKMFCTTRMRETVARAREVLGGNGILLDHDAARFFADAEALYSYEGTRDMNSLIVGRAATGLSAFV

SEQ ID NO: 3115 - protein, 674 aa, Caenorhabditis elegans; identical to SEQ ID NO: 2091

SEQ ID NO: 3116 - protein, 662 aa, Caenorhabditis elegans; identical to SEQ ID NO: 2092

SEQ ID NO: 3117 - protein, 660 aa, Caenorhabditis elegans; identical to SEQ ID NO: 2093

SEQ ID NO: 3118 - protein, 674 aa, Caenorhabditis elegans; identical to SEQ ID NO: 2091

SEQ ID NO: 3119 - protein, 662 aa, Caenorhabditis elegans; identical to SEQ ID NO: 2092

SEQ ID NO: 3120 - protein, 660 aa, Caenorhabditis elegans; identical to SEQ ID NO: 2093

SEQ ID NO: 3121 - protein, 674 aa, Caenorhabditis elegans; identical to SEQ ID NO: 2091

SEQ ID NO: 3122 - protein, 662 aa, Caenorhabditis elegans; identical to SEQ ID NO: 2092

SEQ ID NO: 3123 - protein, 660 aa, Caenorhabditis elegans; identical to SEQ ID NO: 2093

SEQ ID NO: 3124 - protein, 676 aa, Silicibacter lacuscaerulensis; identical to SEQ ID NO: 2730

SEQ ID NO: 3125 - protein, 676 aa, Silicibacter sp.; identical to SEQ ID NO: 2884

SEQ ID NO: 3126 - protein, 674 aa, Rhodobacteraceae bacterium; identical to SEQ ID NO: 2656

SEQ ID NO: 3127 - protein, 674 aa, Roseobacter sp.; identical to SEQ ID NO: 2707

SEQ ID NO: 3128 - protein, 684 aa, Labrenzia alexandrii; identical to SEQ ID NO: 2731

SEQ ID NO: 3129 - protein, 676 aa, Ruegeria sp.; identical to SEQ ID NO: 2657

SEQ ID NO: 3130 - protein, 676 aa, Rhodobacterales bacterium; identical to SEQ ID NO: 2708

SEQ ID NO: 3131 - protein, 672 aa, Rhodobacterales bacterium; identical to SEQ ID NO: 3036

SEQ ID NO: 3132 - protein, 424 aa, Oscillochloris trichoides; identical to SEQ ID NO: 2965

SEQ ID NO: 3133 - protein, 696 aa, Gibberella zeae
MPPPNPDWVKALTPSGPQGSELIAKERAQSDINVDQLATFLFTKEVLERNAKILKILQEDPVFDKSQNYFRGRTDRLEAALARGKHLKRLRDKHNWTEEEHHVANDLISEPTPYGLHSTMFLKTLEEQGTPAQHELFLEKARNYEIIGCYAQTELGHGSNVRGLETTATWNPEDKTFTMHSPHLTASKWWIGSLGKAANHAVVVAQLILNGKSYGPHPFVVPIRDMKTHEPLENIHVGDIGPKFGYNTMDNGFLLFNHVKIPHVNMLNRFSGVDPETSKYIRPSNPALIYGTLTFIRSSIVFQSGSVLARGVTIATRYCAVRRQFQDRDADAGEVGENQVLNYTMVQHRLLPLLASAYALHFTGRSMINLYNANQKRMAQGRERDNSKRAPGPEELSPGSDHLADLHAISCSLKAFASTTAAEGLEVCRRACGGHGYSAFSGIGSWYADYLPTVTWEGDNYMLTQQVARYLLKSARAVLAGKAPDNGISRIFKEFIRRQDIGAAFDVLDSDQDLVDAFAWRVSFLTFEALKHRDEEKQSWNSLLIDFWRLSTAYAQYQVVKNFHEALKEESTKTSLDANTLTLLHKLFELFALHHLQSSASEFFTSAATTVRQIQLARTKRTLSLLDEVRPHAVRLVDAWSFPDWQLDSALGRADGKVYEDLFRRASEDNPVNDIVFDSNPASDILFRKNGPKAKL

SEQ ID NO: 3134 - protein, 688 aa, Ostreococcus tauri; identical to SEQ ID NO: 2670

SEQ ID NO: 3135 - protein, 499 aa, Mus musculus
MNPDLRKERAAATFNPELITHILDGSPENTRRRREIENLILNDPDFQHEDYNFLTRSQRYEVAVKKSATMVKKMREFGIADPEEIMWFKNSVHRGHPEPLDLHLGMFLPTLLHQATEEQQERFFMPAWNLEITGTYAQTEMGHGTHLRGLETTATYDPKTQEFILNSPTVTSIKWWPGGLGKTSNHAIVLAQLITRGECYGLHAFVVPIREIGTHKPLPGITVGDIGPKFGYEEMDNGYLKMDNYRIPRENMLMKYAQVKPDGTYVKPLSNKLTYGTMVFVRSFLVGSAAQSLSKACTIAIRYSAVRRQSEIKRSEPEPQILDFQTQQYKLFPLLATAYAFHFLGRYIKETYMRINESIGQGDLSELPELHALTAGLKAFTTWTANAGIEECRMACGGHGYSHSSGIPNIYVTFTPACTFEGENTVMMLQTARFLMKIYDQVQSGKLVGGMVSYLNDLPSQRIQPQQVAVWPTLVDINSLDSLTEAYKLRAARLVEIAA

SEQ ID NO: 3136 - protein, 427 aa, Mus musculus
MDNGYLKMDNYRIPRENMLMKYAQVKPDDTYVKPLSNKLTYGTMVFVRSFLVGSAAQSLSKACTIAIRYSAVRRQSEIKRSEPEPQILDFQTQQYKLFPLLATAYAFHFLGRYIKETYMRINESIGQGDLSELPELHALTAGLKAFTTWTANAGIEECRMACGGHGYSHSSGIPNIYVTFTPACTFEGENTVMMLQTARFLMKIYDQVQSGKLVGGMVSYLNDLPSQRIQPQQVAVWPTLVDINSLDSLTEAYKLRAARLVEIAAKNLQAQVSHRKSKEVARNLTSVDIVRASEAHCHYVTVKVFADKLPKIQDRAVQAVLRNLCLLYSLYGISQKGGDFLEGNIITGAQMSQVNSRILELLTVTRPNAVALVDAFDFKDVTLGSVLGRYDGNVYENLFEWAKKSPLNKTEVHESYYKHLKPLQSKL

SEQ ID NO: 3137 - protein, 403 aa, Staphylococcus aureus; identical to SEQ ID NO: 2665

SEQ ID NO: 3138 - protein, 679 aa, Bacteriovorax marinus; identical to SEQ ID NO: 2770

SEQ ID NO: 3139 - protein, 721 aa, Eremothecium gossypii; identical to SEQ ID NO: 62

SEQ ID NO: 3140 - protein, 699 aa, Yarrowia lipolytica; identical to SEQ ID NO: 994

SEQ ID NO: 3141 - protein, 701 aa, Yarrowia lipolytica; identical to SEQ ID NO: 995

SEQ ID NO: 3142 - protein, 700 aa, Yarrowia lipolytica; identical to SEQ ID NO: 361

SEQ ID NO: 3143 - protein, 700 aa, Yarrowia lipolytica; identical to SEQ ID NO: 364

SEQ ID NO: 3144 - protein, 689 aa, Yarrowia lipolytica; identical to SEQ ID NO: 369

SEQ ID NO: 3145 - protein, 662 aa, Candida tropicalis; identical to SEQ ID NO: 32

SEQ ID NO: 3146 - protein, 709 aa, Candida tropicalis; identical to SEQ ID NO: 30

SEQ ID NO: 3147 - protein, 709 aa, Candida tropicalis; identical to SEQ ID NO: 348

SEQ ID NO: 3148 - protein, 709 aa, Candida maltosa; identical to SEQ ID NO: 117

SEQ ID NO: 3149 - protein, 724 aa, Candida maltosa; identical to SEQ ID NO: 55

SEQ ID NO: 3150 - protein, 721 aa, Eremothecium gossypii; identical to SEQ ID NO: 62

SEQ ID NO: 3151 - protein, 699 aa, Yarrowia lipolytica; identical to SEQ ID NO: 994

SEQ ID NO: 3152 - protein, 701 aa, Yarrowia lipolytica; identical to SEQ ID NO: 995

SEQ ID NO: 3153 - protein, 700 aa, Yarrowia lipolytica; identical to SEQ ID NO: 361

SEQ ID NO: 3154 - protein, 700 aa, Yarrowia lipolytica; identical to SEQ ID NO: 364

SEQ ID NO: 3155 - protein, 689 aa, Yarrowia lipolytica; identical to SEQ ID NO: 369

SEQ ID NO: 3156 - protein, 662 aa, Candida tropicalis; identical to SEQ ID NO: 32

SEQ ID NO: 3157 - protein, 709 aa, Candida tropicalis; identical to SEQ ID NO: 30

SEQ ID NO: 3158 - protein, 709 aa, Candida tropicalis; identical to SEQ ID NO: 348

SEQ ID NO: 3159 - protein, 709 aa, Candida maltosa; identical to SEQ ID NO: 117

SEQ ID NO: 3160 - protein, 724 aa, Candida maltosa; identical to SEQ ID NO: 55

SEQ ID NO: 3161 - protein, 721 aa, Eremothecium gossypii; identical to SEQ ID NO: 62

SEQ ID NO: 3162 - protein, 699 aa, Yarrowia lipolytica; identical to SEQ ID NO: 994

SEQ ID NO: 3163 - protein, 701 aa, Yarrowia lipolytica; identical to SEQ ID NO: 995

SEQ ID NO: 3164 - protein, 700 aa, Yarrowia lipolytica; identical to SEQ ID NO: 361

SEQ ID NO: 3165 - protein, 700 aa, Yarrowia lipolytica; identical to SEQ ID NO: 364

SEQ ID NO: 3166 - protein, 689 aa, Yarrowia lipolytica; identical to SEQ ID NO: 369

SEQ ID NO: 3167 - protein, 662 aa, Candida tropicalis; identical to SEQ ID NO: 32

SEQ ID NO: 3168 - protein, 709 aa, Candida tropicalis; identical to SEQ ID NO: 30

SEQ ID NO: 3169 - protein, 709 aa, Candida tropicalis; identical to SEQ ID NO: 348

SEQ ID NO: 3170 - protein, 709 aa, Candida maltosa; identical to SEQ ID NO: 117

SEQ ID NO: 3171 - protein, 724 aa, Candida maltosa; identical to SEQ ID NO: 55

SEQ ID NO: 3172 - protein, 425 aa, Streptococcus sp.; identical to SEQ ID NO: 3038

SEQ ID NO: 3173 - protein, 425 aa, Streptococcus mitis; identical to SEQ ID NO: 3037

SEQ ID NO: 3174 - protein, 728 aa, Micromonas pusilla
MAFSPVQGRKETTFNRVVDERTRNLQRPSSDLVSANQVDPKADLARERTSATFPSRELAALMQGGEEELKLRERIADAVRTEPVFSKKGKYFMERSELYRTTLEKYLALPRLVRKMGEKSPIAVGRIIRELIDEPGGLDLHLGMFIPTIQGQGDAEQRKYWLPKCARLQCVGTYAQTELGHGTYIRGLETTATYDAEKEEFIIHSPTLTSTKWWPGGMGKTATHAIVMARLLTKGKDHGPHAFVVQIRRNEDHQAMPGVVVGDMGPKMGYNAVDNGFLRFDHVRISRRAMLMKHSIVESDGSYQPPPVAKASYGTMVFVRSDIVMNAALYMKKAVTIATRYNLVRRQSNPGSKNSGQGTSTPELELQVIDYQHSQRTLFPILAKAFAFHCTSDFMRRMYFKYEKLSRATGDFSSLPELHATSSGLKAYCSWATKDAIELCRLSCGGQGFMAVSGFGSTFGNYAPNATYEGDNNVLCLQTARYLLKVARAAAELAACRRGISGAESSEVAPTHATSGSARYLLEGSGGVELGSRLGRAVGLRHIGELLRAYAHASRRQVLELARRAGTSKPDHAISVDMVAWIKAAKAHCEYVVLLNFADSVSDVKSRVSASTAVVLDRLVALHALATMEDRMADFIEDGYLAAEQAAAVRAEVLSLLTELRPDAAALVDSFALDDYFLNSALGAHDGDVYQRLFDEVQDAPFNASHVPPGYAELLHARLVKGAVRSKL

SEQ ID NO: 3175 - protein, 698 aa, Nectria haematococca
MPPPNPDWVKALKPSGPQGSELLEQERAKSAVNVDQLADFLFTKEVLERNAKILSILESDPIFDKSQNYFQGRKDRIEAALARGKALQRLSVKHNWSQDEYQAANDLISEPTPYGLHASMFLKTLEEQGTPAQHKLFLEPAQRYEYIGCYAQTELGHGSNVRGLETTATWNPEDKTFTIHSPHLTASKWWIGSLGKAANHAVVVAQLILNGKVCGPHPFVVPIRDLKTHEPLENIHVGDIGPKFGYNTMDNGFLLFNHVKVPHINMLSRFSGVDPETSKYIRPANPALVYGTLTFVRSSIVLQSGSVLARGVTIATRYCAVRRQFQDRDAASDEVGENQVLNYTMVQQRLLPLLAASYALHFTGRAMIKLYEANQKRMAQKLSAKDNAGRAPGPEELNPGSDLLADLHAISCSLKAFASTTAAEGLEVCRRACGGHGYSAFSGIGSWYADYLPTVTWEGDNYMLTQQVARYLLKSARAVLSGKAVDNSITRVFKEYIRRQDVGAAFDVLDSDQDLVNAFAWRVAFLTFEALKHRDEEKQSWNSLLIDFWRLSTAYAQYQVVKYFHEALQDEETKSSLDANTQEVLHKLFQLFALHHLQSHASEFFTSAATTVRQIQLSRTKRTLALLEEVRPHAVRLVDSWKFPDWQLDSSLGRYDGKVYEDMFHRASEVNPLNDVVFDPYPNSPVLFRKDGTVKSKL

SEQ ID NO: 3176 - protein, 425 aa, Volvox carteri
MIQATTMAAFPPAVHDLLALEGLLSPEERQLRDKVRSYMEANVAPVIADYWERAEFPHPLVPGFAALGLAGGAIKGYGCPGLSILSNAMAVVEIARVDASMSTFLLVHSYLAMLTIGLLGSEEQKQELLPRMAKFELVGCWALTEPSNGSDASALTATATKVPGGWMINGYKRWIGNGTWADVTVVWARNNQDGQVNAFIVRKGNPGLRTAKIENKIALRCVQNADMTFSQCFVPDSARLPEVTSFADTNKVLAISRIMVAWQPVGLSVGVYDMCCRYVTERKQFNTQLGSFQLVQEKLARMGGHIQGMWLACWRLSKLYEEGRMSHEQASLVKAWTSARGREVMALGRELLGGNGILGHFLVAKSFSDLEAIYTYEGTYEVNVLVAGRRITGVSAIRAASPPKGPQAGKKGAKQQQQEAEAERK

SEQ ID NO: 3177 - protein, 694 aa, Selaginella moellendorffii; identical to SEQ ID NO: 2943

SEQ ID NO: 3178 - protein, 694 aa, Selaginella moellendorffii; identical to SEQ ID NO: 2942

SEQ ID NO: 3179 - protein, 669 aa, Selaginella moellendorffii; identical to SEQ ID NO: 2941

SEQ ID NO: 3180 - protein, 415 aa, Selaginella moellendorffii; identical to SEQ ID NO: 2940

SEQ ID NO: 3181 - protein, 415 aa, Selaginella moellendorffii; identical to SEQ ID NO: 2939

SEQ ID NO: 3182 - protein, 669 aa, Selaginella moellendorffii; identical to SEQ ID NO: 2938

SEQ ID NO: 3183 - protein, 695 aa, Ostreococcus lucimarinus; identical to SEQ ID NO: 3033

SEQ ID NO: 3184 - protein, 675 aa, Streptomyces sp.; identical to SEQ ID NO: 3113

SEQ ID NO: 3185 - protein, 435 aa, Streptomyces sp.; identical to SEQ ID NO: 3114

SEQ ID NO: 3186 - protein, 702 aa, Phytophthora infestans
MSGTSCGPARRIAVLSRQLQSTSCAISTRDQTVAELAAERASSSFSPRAMANFIYGGTRQTELRVEAMQLLMSYPEFYNGVGTFDRSLAECREDTVQRLRRLYSLFMEHGGDVEKRETLADIVGIFDLPLWTRNGVHFGLFLGAIMGQGDQEQQDEWMMPTMMLELFGCYGMTELGHGSFTRGFETTATFDMKTDEFVIHTPTDTATKWWIGGAGQTATHTVCFARLVLPNTGADHGVQSFIVPLRDVETHRPLPGVRIGDMGSKMGLQGVDNGWIQFDHVRIPRANMLRRYAQVSREGVFTQTQHKAQLAYAALLVNRGKIVTLSVGILEKAVTIAVRYAAVRRQGLQVKSEDPHTETRLLDYQTHQYRLMPVLARAYAYRLQTRHITRLLQQFDTQGSDISEALLADIHGTMSGFKAFCTWDVQEGIDACRQSCGGNGYSKYTGLAELLADFSVMVTFEGDNTVMAQQTANYLLRSVEKLRCGEKLSGSVLYLEREDASNSRRQWGAEGSADLNNATLLRDALDVYTGRQVLQVAAKLAAANGKTEAERMNSCQVDLVEIARVHVFYNVASAFLQHIEEIEIEASGDNETLLPALEALCQVYICQELDRGAAFLLKEKFMSPFQSNLVRARLMESCARVRDDAVALVDAFMLTNTVLNSSVGRADGSIYEGALAAVRHRMGPTPYFTSAIKPIFDGELLD

SEQ ID NO: 3187 - protein, 661 aa, Phytophthora infestans
MELTDLAPLLLKKERANGDINPSVLTDILRDGKPANNRRKELVAMIERHPVLSDRDMMFRNHTERYTFGLKKVSHFVQFLKDRNITDRNEQKIMYGALGEPLCIDVHDSMFIPTLENQGTDEQRAKWLPLARNYKIFGAYAQTELGHGSNVQGIETVATYDKATQEFIIDSPTLTSRKWWPGGLGKTANHAIVHARLYLDGKDVGVQAFLVQLRSMEDHQPLPGIEVGDIGPKVGFNAIDNGYCAFHKIRVPRDNMMMRYAKVLPDGAFVKPKSDKLVYLTMVHVRASLVENFALTMAKATAITTRFSAARIQGRTPDNKGEFQVLDYQNQQHELFPFIAIAYAAKFAARDMMARHDAAVAIVKRGDAGFGAKLATLHAVSSGLKAWLAEKVSDGVESCRRLCGGHGFTQSGNLAHIFNEIVGANTFEGTFDVLVQQHARYLLKMLAAVKTLDESEPATRFLAKIKIYSDPKLRFSSQRTEDFSDLNLLVEAFEVRATRILLALASQMKATENNGNACMVLMSRVSNAHAELMLLEALVNGVSAIPAGPEQRSLAQLCSLFGVWLITKSLGDFRQHGYFSSQQVDLVRDQIVHLLPIVRKNCVLLTDAWDFSDFELGSTIGRYDGDIYRALVKRAADEPLNKTQVPEGYEKYLKPLIQSDL

SEQ ID NO: 3188 - protein, 450 aa, Sphingobacterium spiritivorum; identical to SEQ ID NO: 3082

SEQ ID NO: 3189 - protein, 408 aa, Corynebacterium genitalium; identical to SEQ ID NO: 3087

SEQ ID NO: 3190 - protein, 831 aa, Chryseobacterium gleum; identical to SEQ ID NO: 3081

SEQ ID NO: 3191 - protein, 452 aa, Chryseobacterium gleum; identical to SEQ ID NO: 3080

SEQ ID NO: 3192 - protein, 425 aa, Volvox carteri; identical to SEQ ID NO: 3176

SEQ ID NO: 3193 - protein, 725 aa, Meyerozyma guilliermondii
MCILPPQFACYKAGFCHKYLNYTMEVKNTIQSGNIPTPALAIQAERAKATFDPELMNHFLEGSKEKSDEIKQMIQQMERDPILQVSSKVYDMTKAEHRLETARKIARLALYIELENFSSFENRMSLVSLMDPQLHTRIGVHLGLFLGCIRGNGTSEQMYYWVLNKEAAYVKQIYGCFAMTELAHGSNVAGLETTATYDVENEQFVINTPHIGATKWWIGGAAHSATHTTVYARLIVKGKDYGVKTFVVPLRDSNHNLNPGVVVGDIGAKMGRDGIDNGWIQFSNVRIPRYNMLQKYCKVSADGEVTEPPNNQLSYSALLGGRVVMVKDSFRWSAKVVTIAIRYAIARRQFKASKAGENDGENQIMNYPLHQRRLIPLLATAYAFSNGANVLDQLSKKTMDSLDHAVSQDDKAGIDKGIEEMKSLFVASGSLKSTCTWSTLNTIEQCRQACGGHGYSSYSGFGKTYNDWAVQCTWEGDNNILGMSIGKQLVKNISGVIKDGNKATGILDFLNNTKQYLNNEIVLKKDQLESLEQVLKAVEVALIRTANQALADLDKNGEDWDYIGARLVELSKMLAHFFMLKSFLEKFNTLEEGPMKLVLKQLAQLYSSSVILEGFSGIFLTFKVLDSDTVSYLSSEYIQKLCADLRPHVIPLTDAFNLSDMIINSSLGNYDGNVYENFFKIVKDRNPAPGSYTAPYEEEFRAHLNRPSLEDRQRNEINEDNEELV

SEQ ID NO: 3194 - protein, 706 aa, Meyerozyma guilliermondii
MSVSTNTVTSLPGPDPQASFRQERENQKFDPVQMHYFLEGSKARAEAIKRLTQQMERDPVLASDSSIYDLNKEQQRELTAVKINRMARYIENDDPKDFNLRMSLFGLFDPQVATRIGINLGLFLSCVRGNGTPEQIEYWTFNKETAGLKSIYGCFGMTELAHGSNVAGLETTATYDEATEEFVINTPHIGATKWWIGGAAHSSTHCSVYARLIVKGKDYGVKTFVVPLRDSNHDLMPGVTVGDIGAKMGRDGIDNGWIQFSDVRVPRFFMLQKFCKVSKEGKVTLPPLEQLSYSALLGGRVSMVLDSYRMSAKMSTIALRYAVARRQFKGSSSSDGKETQLINYPLHQRRLFPYLAQAYVLSAAALKVEHTIEQTLDDLDAAVASNDMPAIMRSIDGMKSLFIDSGSLKSTSTWLGAEAIDQCRQACGGHGYSSYSGFGKAYNDWVVQCTWEGDNNVLAMSVGKPIVRLILEVLDKGKKVRGSTSFLNHTKENLGETPVISNVSDLQDLKKILTAIEVLIMRLGADAVKTIKANGGNQDSVSPQLVVISKLKANHYALEEYIRRVDTHDNLELKPYLLSLGRLYAASMIIDRFAGDFLTYSVLSTKVVAENNSINLPKLCEEVRPHVITYTDSFQLSDMIINSAIGKFDGNVYENYFGIVKANNPPFKTKAPYSGSLEAMLNRPAKEERERFEKIGQAKQFLSKGL

SEQ ID NO: 3195 - protein, 675 aa, Amycolatopsis mediterranei; identical to SEQ ID NO: 2676

SEQ ID NO: 3196 - protein, 438 aa, Homo sapiens; identical to SEQ ID NO: 1362

SEQ ID NO: 3197 - protein, 438 aa, Mus musculus
MSLRGVSAQLLSRRSGLRFPRFPRTWSSAAAHTEKTQIRPAKSSRPVFDWKDPLILEEQLTADEKLIRDTFRNYWQERLMSQILLANRNEVFHRDIVYEMGELGVLGPTIKGYGCAGVSSVAYGLLTRELERVDSGYRSMMSVQSSLVMHPIYTYGSEEQRQKYLPRLAKGELLGCFGLTEPNHGSDPGGMETRARHNPSNQSYTLSGTKTWITNSPVADLFIVWARCEDNCIPGFILEKGMRGSSAPRIEGKFSLRASATGMIIMDSVEVPEENVLPNVSSLAGPFGCLNTARYGITWGVLGAAEFCLHTARQYALDRIQFGVPLARNQLVQKKLADMLTEITLGLHACLQLGRLKDQDKATPEMVSMLKRNNCGKALDIARQARDILGGNGISDEYHVIRHAMNLEAVNTYEGTHDIHALILGRAITGIQAFTVGK

SEQ ID NO: 3198 - protein, 401 aa, Streptomyces sviceus; identical to SEQ ID NO: 2883

SEQ ID NO: 3199 - protein, 679 aa, Providencia rettgeri; identical to SEQ ID NO: 2936

SEQ ID NO: 3200 - protein, 678 aa, Providencia rustigianii; identical to SEQ ID NO: 3070

SEQ ID NO: 3201 - protein, 698 aa, Corynebacterium ammoniagenes; identical to SEQ ID NO: 3088

SEQ ID NO: 3202 - protein, 454 aa, Zunongwangia profunda; identical to SEQ ID NO: 2833

SEQ ID NO: 3203 - protein, 680 aa, Brevibacterium mcbrellneri; identical to SEQ ID NO: 3089

SEQ ID NO: 3204 - protein, 677 aa, Drosophila melanogaster; identical to SEQ ID NO: 2649

SEQ ID NO: 3205 - protein, 677 aa, Drosophila melanogaster; identical to SEQ ID NO: 509

SEQ ID NO: 3206 - protein, 730 aa, Naegleria gruberi
MIGHNQLRRLSILANHLCSGFDVNNQSNIIEENSTSGGGRIYDPTLKTPPTIKTSFSLTQQDVHSIANNLLKPDYVELRQKLLDYFTKNQDYFKMYSGYDAKLEECRQKSHDRALKILSQEFVSPIDILKDPLKISLFLNSIPTDVSSLVKLSVHFNLFGACIAHLGTTEQLDKWLGPNSTFSKELGCFLMSELAHASNVRQLAVTATYDSSRNEFIINTPDEGAQKYWIGNAFKSATSGVLFAQCIVDGVNHGIHSFVVPLRDPKTMKVYDNILIRDVGIKMALNGIDNGMVAFNNYRIPASNLLARYAKINNGKYETTIKNENVRFAKHIGALLQARLGVGSGSINALQMALIVAIRYAHRREQFGPPKSNEWKLIEYKTHQMRLLPLLAESYAYNFFSSYCMKKYEEYMKSGFKEELLKNLHLLASVSKVVISSRNLDIIQECRESCGGQGVLTRNLLPILRVDSEANVTLDGDNHLLLYQISGVLLTEYAKQFKTLPNVKNNVFMSALTNIVGPSVDAINSIYIIGKEGVNDFWRNGLLTHYANTSKDHILSKEFLMGALQYRENRLVHTLASKMYKLTEKYKSLNNNTHTAQYLAHNEASTHSLNCAKAYCDKIIGQIFFEQLDSIKSSMGVYSNVYKIMQTMCQLFVLSIIAKDPFFLAKKVVGASKFKAIKKLREELATSLAGNSLQLIDAFAIPDFVLDGSIGARNFHYITLNGYNHEIQDM

SEQ ID NO: 3207 - protein, 748 aa, Naegleria gruberi
MPAQEKKKVSVIQQALTSDRKIKIDDQVGQKRMDMLKQHLNPVLTTPTPQQKKEAKDTKPPTVAPTKSSEKVAVKPSETFPFNEFSKFISPFTPKEEKSYLRVIQAMKDRPDLFAAPDLDMPRIEQMDYNYERLKYLVLEKRCFSIETLEHDTASFFAGVFAAAYFDQALSTKIMLQFSFWGGTLLSLGTQRHRKYLEKIDNLELMGSYAITELAHGSNVKGIQTTATYCKETDTFEINTPNRESCKFWIGNSRHCHMCLVFAQLYVGNENHGVHCLVVPVRNPSTNEIYDGVTIGDCTVKEGLNNLDNGFLMFNKVHVPRENLLNKYGDVTPEGLYVSEIKSANQRFGSMMSTLTMGRTTICVNSAQVLSKVLFLTLGFSFERRQFGIPNQSEYPVINFQSQKTVLYPMLAKFFAFRFASNQVFHLYVNRTPETTQKLHIMSAGYKAYLTDSTQTCIVKLREKCGGLGYSNLNRIGQAICNHDIYKTFEGDNTVLLQEVSKYLLGNYNKVMGEKYSSVFSSVGYYLLDSLNDNVKSRQLKNSTNLLDPNFYLSLFDVKLEKQVQSAALRFRNILNELNLSTKDNIPKEQKKALNHFNAWNMVQNQLLDAATAYIENELLALFHSKVEECKNPTIKKVLTKQLNLFVVDLLEKNMTYFLTHQLITPEVGKQLVKEKSKLIDSIDYVELLNIVKAVIDQDSIPVPICNNEGLVSGKVSSDPSPIYSSMLKAALSNKQLFGNASAEKLGL

SEQ ID NO: 3208 - protein, 680 aa, Saccoglossus kowalevskii
MPENSLINEAYRLAINMDNLNDNHAHGSAPPESFSDFANKMEPAPSSLSRYLDGDFWEVKEKLRHYIGENELFNLRFDMSLSENREVTLERAKNLLRFQDIQSQFDEQAAHMRGFMNKSLAIGDVVSATDISVGVKMGVMAWLFGGAVMNLGTEQHIERFLLPLKELKFTGMFAMSERGHGSNVRSLQTQAHYDPDTQEFIINTPCEDAEKIFIGNALQGNYACVFAQLIINEESKGPHAFIVPIRDENGLKPGISVIDVGLKEGLNGVDNGLLSFHHVRIPHDHFLNKFGDVSPSGEYTTSIQSNSKRFNAMLAAMVGTRIALAFQATTSMKVRWRPLVKQFGPSNDAEYFILDYQAHQLRLMPHLAACLGLLFAQRYTGEILDTAYHEQKDVPVVDNRYLQALTSGLKAYSTWQSIKCLQTCRECCGGMGYIAENRLSSLKNDSDIFVTFDGDNTVLMQQVAREILDYYSSQFSSSRVKGMLSFMGGGLWSLVQTSLFAVNTLPVVSVGFILKAMLFRDAKQIRTLAARLLNKVSTKKEEPFSAWNSCQHHAVTMAMSFLQKVVLQQFIIAVDKCPYKDDKTILHKFCKLYALDCLYQDRAWFLEQGYIKSYHVKEIRQEYIRMCAETKKDALQVVEAFRLPRNCVHAPIAGIPSLVAPWAYYPDGETEKPPAEISKL

SEQ ID NO: 3209 - protein, 730 aa, Naegleria gruberi; identical to SEQ ID NO: 3206

SEQ ID NO: 3210 - protein, 748 aa, Naegleria gruberi; identical to SEQ ID NO: 3207

SEQ ID NO: 3211 - protein, 438 aa, Homo sapiens [sequence omitted]

SEQ ID NO: 3212 - protein, 408 aa, Sus sp.; identical to SEQ ID NO: 1834

SEQ ID NO: 3213 - protein, 677 aa, Artificial Sequence; identical to SEQ ID NO: 2649
  Description of Artificial Sequence: Synthetic construct

SEQ ID NO: 3214 - protein, 436 aa, Arabidopsis thaliana; identical to SEQ ID NO: 354

SEQ ID NO: 3215 - protein, 541 aa, Myxococcus xanthus
MSDQAPSVKPPAFGPGVVVKGTWHPDYAEVLTPEALEFVAKLARNFGERRLALLERRKTVQAAWSKGARPHFLPETKAVREGDWTVAPLPADLQERRVEITGPVDRKMVINALNSGANVFMADFEDANSPTWDNVVRGQINLRDAVRGTISFTAENGKHYALNPKRAVLFVRPRGWHLPERHIEIDGKPISGSLLDFGLFFFHNAREQLARGTGPYFYLPKMQSHLEARLWNDVFHLAQAELGIPRGTIKATVLIETLPAAFEMDEILYELREHSAGLNCGRWDYIFSFIKTLQSDTRVVLPDRGQVTMDKAFLNAYSQLLIQTCHRRNVHAMGGMAAFIPIKGDAAANDAVMDKVRADKLREVKNGHDGTWVAHPGLVEIARDLFDSHMKGPNQLSDKREDVKIGEAELLKVPSGTRTEEGLRHNIRVGIQYTAAWLGGLGCVPLYNLMEDAATAEISRAQVWQWIHHGASLEDGRKVTLTLFRDALGEEMGRLEKEGAKERYGAAHLERARVLFEQLSTAGTFEDFLTLPAYDALEAQR

SEQ ID NO: 3216 - protein, 427 aa, Myxococcus xanthus
MQPSRRVSLVLSYQYPGKYAFTVLAGAVESDPALADVTLHFPRSRETLLDTIRERVDAGDTVVAAWSFYSASFAPAAEELAWVRERLEGRDVLCIAGGVHATAETLQTLQAGFDLVAVGEGEYSLRALLGRVLRGEVPRETHGVAYLKDGKLVQHGRGEGVQLDDFPPFAARNGQYGAIEITRGCIYACRFCQTPFMSKARFRHRSVANVAHWARELRRSGRRDIRFITPTSMSYGTADESVNLDAVEALLAAVKEAMAPDGRVYYGTFPSEVRPEHVTPEALELLKRYVHNDNLIIGGQSGSERILQSTRRGHDVETVVRATRIAVECGFVPNVDFILGLPGEEPEDVDATVALMEKLAGLGARVHGHTFMPLPGTPFRDAPPGSVDEATQRKLDRLASQGRLYGHWKQQVALAEGIASRRRPRAG

SEQ ID NO: 3217 - protein, 691 aa, Populus trichocarpa; identical to SEQ ID NO: 332

SEQ ID NO: 3218 - protein, 706 aa, Micrococcus luteus; identical to SEQ ID NO: 3093

SEQ ID NO: 3219 - protein, 404 aa, Micrococcus luteus; identical to SEQ ID NO: 3091

SEQ ID NO: 3220 - protein, 402 aa, Micrococcus luteus; identical to SEQ ID NO: 3092

SEQ ID NO: 3221 - protein, 408 aa, Micrococcus luteus; identical to SEQ ID NO: 3090

SEQ ID NO: 3222 - protein, 576 aa, Aspergillus flavus; identical to SEQ ID NO: 3035

SEQ ID NO: 3223 - protein, 686 aa, Aspergillus terreus
MAPQTKQMALLAHARENSTFDSQKLTTIIYDNEENVASRRAAFARVEAALGLDDNMKLPRLYEGLDREGLYIEGVRRARATTQDMLAHNHEHFKSLTERYHLANSSPFGMNFLMFRKTIELQATDAQKRYWLPLIDQMKVNGAYVQTELGHGTFVRGIETTATFDETSGGFIIDSPTLTATKYWPGGLGISCTHVVVAARLRTHGQDHGMHWFVVQIRSLEDYAPVEGVELGDVGMKMAYNGTCNGYARFRRLRVPRDSLLAAHAEVLPDGTYICRSNPAELSKRLYATMLDVRCVMIKCAGFSLAQALTVTTRYSVVREQGKPMFANGDAPEVALLAYKSQHYRLLTLISQAYAILFASKSFDEVYHGFVPERARGHLDRLSYIHGLSTGLKAWATTIASAGAEEARKMCGGHGYVALSGLPDMVATVSATATFEGDNYVMWQQLVRYLFKQIHASCSAAAVDAEMQEYLEGLKPYLREKGSRFQPNTDRLYDPATLLSIFRHRSHRLLAMAHVLVTRESEETTLADAWNKHMMILLSAGHAYAEYIILRAFQDWASKVQTIEPSLHLPVSRLCTLFALTTIVSPVSTFYAVPFTEDGVLSLDQLMHMRATINDLLALLLPDIVALTDAWDFTDASLCSALGCRDGNAYERLMSWTRQLPVNHGDVGGKFWDGEAGIGNVLRTKL

SEQ ID NO: 3224 - protein, 693 aa, Aspergillus terreus
MPPPPPAWVQALKPAGPQGSELLEQERAQSNVNVDKLSELLHTKEALETQDRLVRILSSEPIFDKSENHTSGRTERIQRALARGKRLQQLREQLHWSEKEYIMANDLIGEPTPYGLHASMFLVTLREQSTPEQKKLFLEPAEKYQIIGCYAQTELGHGSNVRGLETRATWNPDDKTFTIHSPTLTASKWWIGSLGRNANHAVVMAQLYVGGKNYGPHPFVVQIRDLQTHQPLENIYVGDIGPKFGYNTMDNGFLLFNHVKIPHVNMLARFSRIDKDTNKYMRPASPSLVYGTMTWVRSNIVLDAGGVLARGVTIATRYCAVRRQFQDRDATGNVGENQVLNYKMVQIRLLPLLASMYALHFTGRGMMRLYEENQSRMKASAASDQDTRGPGPEQLRAGADLLADLHATSCGLKALASTTAGEGLEVCRRACGGHGYSSFSGIGPWYADYLPTLTWEGDNYMLTQQVARYLLKSARAVLEGKGTANDTSQILQAYLARREKGASFDILEKDSDIVAAFAWRTAHLTFEALKLRDVEKRSWNSLLVDFWRLSTAHSQYLVVKNFYEAVTSEQMSAALDAETRTLMYKLFRLYALHTMEREGAEFFASSAVTTRQLRLTQNNAVMKLLDEIRPHAVRLVDAWKIPDWKLDSSLGRYDGEVYPDLFRRASMNPVNDLVFDPYPWNDAVLKNGPKSKL

SEQ ID NO: 3225 - protein, 692 aa, Aspergillus terreus
MRDFTDNLRPSQPAGPDILSQERAQSDLSVEELAHHLLHHNGFLERQSRILPIVQNEPLLDKSQQQNLSRPDLYKQALARAKLLRRLADKHKWDHADYKMAEYLVDDVSPYMLHMEMFSTTIREQASDAQRAYWMPRIEKWQIIGAYAQTELGHGSNVRGLELEARWDHQTKQFILHSPTLTASKWWNGTLGRTANHAIVVAQLLLPRPGAFSAEKNVEYTSHGPHPFIVQVRDMKSHQPLDGIVIGDIGPKYGYATMDNGYMLFDHFRVPHSALLSRYSGVDPETGHYIKPEKAAVVYGSLTAVRANIVQHARLVLARAVTVAVRYTAIRRQFRDRDGDGSGPELAVLDYPTVQIRILPLLATTFALHYTALAMQRIYEGTRREIEAGNFNSLAHMHSMSSGLKSLCTTLVADGIETCRRALGGHGFGGGSGLIQLNNDYLSKPTVEGDNWMISQQTASYIIKKMTTAVGSPNSRYNDELDGQFKEYIRHKQEGKQEYELGILSNDQDIVRSFQLRATALAYDAYQERAVNKKSWNSLLIQLHRLSRTQSQSILVTKFFQALTTDSSLPPSTKEIMWDLFRLFALFTMEADSYEFFSTGVVNREQLDKLPASVHDLMTQIRPHAVKLVDSWMIPDYLLDSALGRYDGRVYEDLFNRAHRLNPLNKLTFNPNYWENEVIMGTPDPRLVSAKL

SEQ ID NO: 3226 - protein, 422 aa, Aspergillus terreus
MNRTLLRAASRHLSTGAAKTPARSFATAFNWEDPLAASELYTEEELAIQDTARQYCQERLQPRVLEAYRNENYDRRILEEMGELGLLGASINGYGCAGVSTVASGLITKEVERVDSGYRSGMSVQSSLAMTAIHEFGTEELKERLLPGLAQGKLAGCFGLTEPNHGSDPGAMETVARAHPSKPGVYLLSGAKTWITNSPIADVLVVWAKLESTGKIRGFVVERDQCPAGTLETPAIKNKTALRASITGMIQLDECPVPVENMFPDVEGLTGPFTCLNSARLGIAFGAMGALEDCLARAREYALERKQFKGNPLAKYQLIQKKLADAATDAAYGTLAATQVARLKDAGKSTPEMISMVKRQNCDRALVNSRILQEVFGGNATSDEYHIARHAANLFVVQTYEGQSDIHALILGRAITGVQAFV

SEQ ID NO: 3227 - protein, 619 aa, Aspergillus terreus
MSLASYIWGEAELNRRQEILKALSQSPIKTVGHNPYRLSRKELWTVRIQQNIELLELKMRLGWDSAALSGCFENFFLKNLHAQMSEEQRAYWIPKAENFEITGCYAQTELGHGSNLKGIETTATFDPITDEIVLNSPTLSSHKYWIGGLGVMATHALVIARLIVAGKELGNHVFLVQIRDLGTHDLLPNVQVYEQGEKSLGTFATMDNGVMKFSHKRIPRAQMLARYASLDRDGTYHKSENKKHAYTSMVIIRSLMSQEIGLDVAKAIVIALKYTNFRRQFNVKDGNETRVIEYASVQNRLYPALCRAIAMVLVGREIKEQVEDLRVDKLENLHLQTVGLKIWATEHGVRDIEVARLSCGGHGGVGNMAAAGLGSMYAQLSPARTYEGDNYVLSQQIGNAVIKHWKRNTEMTIPALSYLTLLRDSQRMSQRLGVGTADSFLAPETQEQILEYRAAILARRHISDTEQGKDTSYDVFQLAMAHADLTYWRSLQNKLCEAPREHETAIKTLVDVFALTSILESLGAFAGTNYLAQEDISSLRDTHHSRIASLSNHVQSIVDALGFTETELNSAFARESQTPYEALLETARQSEMTDNRFIRPTILQARNLWKKYQGSVSKL

SEQ ID NO: 3228 - protein, 403 aa, Unknown; identical to SEQ ID NO: 2261
  Description of Unknown: Acyl-coenzyme A polypeptide

SEQ ID NO: 3229 - protein, 661 aa, Ailuropoda melanoleuca
MGSPVHRVSLGDTWSRQVHPDIESERYIPSFNVERLINILDGGPQNTELRRKVESVIQSDPEFSLKDHYFMTQNEHYVAAVRKTFHLQIIAKRLGWSENSPEFYYAYRAVSGELAFNLHRVFQKSLRSLGSEEQIAKWNPLCNEFQIIASYAQTELGHGTYLQGLETEATYDTATQEFVVHSPTLTATKWWPGDMGRSATHTLVQAQLICSGARRGMHAFIVPIRSLEDHSPLPGVTVGDIGPKMGFDSIDNGFLRLDHVRVPRENMLSRFAQVLPDGTYFKLGSPQTNYFSMVVMRVDLLLGEIIPLLQKACVIAVRYSVIRRQSRIRPSDPEAKILDYQTQQQKLLPHLATAYAFHFLGSNLSEFLHSSYDAILNKDFSHLPELHALSAGIKAMVSDLCLQGTELCRRACGGHGYSNLSGLPSLVTKVTASCTYEGDNTVLYLQTARFLVKNYQQAHPTPGSTLQRSLPQSVAYLATTDLARCPAQKAADFLHPKLYTTAWAHVATRLVKDSVNHLETLMQSGADWDEAWNQTTILHLHAAKAHCYYISVKSFTETLQKLENEPEVQQVIKHLCDLYALHGILTSAADFLHDGFLSGAQVDAVRTAYLDLLRLIRKDAILLTDAFDFTDHCLNSALGCYDGNVYERLFHWAQESPTNTQ

SEQ ID NO: 3230 - protein, 666 aa, Polysphondylium pallidum
MESNNTNSSLNVSSLNKVPQQLSAAIKQQQQQQQQPQKQQPQSTVKPPKVLKPLCLNGTKIDFPVAALKSFMDGPYEPFLDHLRNMFNQPTFSILSDGGDLNSRRRNASMKCKAFLEQSGIAYKDIKSEIGRLMAPAVVIGMLCDFSASVKMGVHVWLYGGSIAHLGTAKHQEFYNDSVRKFEAPGCFAMTELGHGSNIRSLETIATYNHARRSFVIQTPTASARKVFLGNSGEAQFAVVFARLLMPSHAGQQAQDHGLHGFAVRIRDTNKSLFRGVNWSDCGEKMGLNGTDNGYLWFDQFEVPYDALLDAHGSIDVNGVYTSIHKNQGKRFTAMLSALFYTRLAVSGGCVGASQAALSIAINYAFQRRQFGLPQQPEELLIHYSTHQSRLMPSLAGSVIMGVVQMYIEERWAKVSAVDQREVETLICGFKAFSTWESVNALQNARECSGGQGYLASNIIALLRIDADVMLTLEGDNTVLCQQVAKDLITDMQKKGAFGFLMNNITEEMATYFSSGDILSPEFLIYVLGYRESRLCRMAAMRLRKMAKLHGGFSAWNKCLDHLIILAKAHVERRIIEIFYQRMLANAKPEIAGILKLILTTYALYLIDRSRGFYIEHSIISKKRCKQIKNTLVRLCEDMTVNSKDIIQSFGVPKQFQNVPMLNSKF

SEQ ID NO: 3231 - protein, 678 aa, Dinoroseobacter shibae; identical to SEQ ID NO: 2206

SEQ ID NO: 3232 - protein, 695 aa, Penicillium chrysogenum
MPSPPPDWVKALKPSGPQGSELLHQERAQSNVDVERLSELLHTKETLERRASLLALLQPEKVFDKSQNHSLGRVERLQRSLAKAKRLQQLAEEHKWSMQELHAANDLIGEPTPYGLHASMFLVTLREQGTPEQHKLFLERAEKYEIIGCYAQTELGHGSNVRGLETTATWNSNDKTFTINSPTLTASKWWIGSLGRTANHAVVMAQLFIDGKNYGPHPFVVQVRDLETHQPLDNVYVGDIGPKFGYNTMDNGFLLFNNVKIPHVNMLARFCQVDKETNQYAKPAMPSLVFGTMTWVRANIVLDAGGVLARGVTIATRYCAVRRQFQDRDADPHAGETQVLNYKMVQVRLLPLLASMYALHFTGRGMMRLYEENQSRMKAASSPDQESRGAGPEQLRAGANLLADLHATSCGLKALASTTAGEGLEICRRACGGHGYSSYSGIGPAYADYLPTLTWEGDNYMLTQQVARYLLKSARAVLAGKPARNDTSQILQAYLDRRDKGASFDVLDEDKDIVAAFGWRTAHLTFEALKHRDAEQRSWNSLLVDFWRLSTAHSQYLMVKNFYEAVSSPELSGALDPETKGLMHQLFRLFSLHTLEREAAEFFSSGAVTVRQITLTRTTAVLKLLDDIRPHAVRLVDAWAIPDWQLDSSLGRYDGKVYEDLFRRASEENPVNELVFDPYPWNSALLKNEPAKSKL

SEQ ID NO: 3233 - protein, 665 aa, Tribolium castaneum; identical to SEQ ID NO: 974

SEQ ID NO: 3234 - protein, 438 aa, Homo sapiens [sequence omitted]

SEQ ID NO: 3235 - protein, 667 aa, Caenorhabditis briggsae
MSRWIQDGDNVDITNERKKGTFDTERMSAWIHGGPEVLKRRREILSFVKSIDDFKDPVPTEFMSREERILNNARKVVAMTDNTDQIDGSDFFGEGMYYQALTMGRDLHAMSLHYVMFIPTLQGQTDDEQLDEWLTKAISRAVVGTYAQTELGHGTNLSKLETTATYDSATEEFVLNSPTITAAKWWPGGLGKSSNYAVVVAQLYTKGECKGPHPFIVQLRDDETHMPLKGIRLGDIGPKLGINGNDNGFLLFDKVRIPRRALLMRYAKVKPDGTYVAPAHSKLGYGTMVFVRSIMIKDQSTQLAAAATIATRYASVRRQGEISPGKGEVQIIDYQTQQFRVFPQMARAFAFMAAATEIRDLYMTVTEQLTHGNTELLAELHVLSSGLKSIVSWDTAQGIEQCRLACGGHGYSQASGFPEIYGYAVGGCTYEGENLVMLLQVARFLMRAAEGVRKGSAKLADIGAYIGKTGPKTSRLTTHYHYTDADLVADLEHAARKQVFRAYDRLKKAQEHLSPEVAWNSVSVELAKASRWHVRVYLVKNFLNKVALAPQDLKFVLTDVARLYAYDIITSSIGAFLEDGYMSSNQMNEVKEGIYECLAKIRPNAVALVDSWDYDDKELKSVLGRRDGNVYPALLEWAQNSQLNRSDVLPSHTKYLGPMMKDARSKL

SEQ ID NO: 3236 - protein, 611 aa, Caenorhabditis briggsae
MNRYIRDGDNPDITEERMKATFDADRFTEFYHGGAKRLKSRREVEKYIEDHKELQDTHPTPFMSREELIDNSVRKLAGMAKYHKMIDMTNIEKTTYFLQVHVRDSMAFSLHYLMFLPVLQFQASPEQLSEWMPKSLSGTIIGTYAQTEMGHGTNLSKLETTATYDPKSQEFVLHTPTISGAKWWPGSLGKFCNHAIIVANLWTNGKCEGPHPFFVEIRDPVTHKGLPHLKMGDIGPKLSLNGSDNGYLIFDNFRIPRNNMLMRHSKVSFYFRVSKIYMAKAIAFRIAGDELQNIFKVSKMMLRLVGPIKLQKVSKQLRLGEASLLPGIYALSSGLKALVTFEVQGGIEQCRLACGGHGYSHASGIPELSAFSCGSCTYEGDNLVLLLQVAKYLMKVCAQPAEGKICGYLHKKSSATISELSTHKTYSDHQIIQDWEHVTRRVVLQAFQKLRTESATKQKHEAWNSCSVELCKAARWHVRLYIVRILLAKISTAPEDVRPVLRALAKLYIFDLQVSKQGHFMEDRYMSPQQIDQLKSGISEALATIRPDAVSIVDGFAIHEFELKSVLGRRDGNVYPALMEWTKHSKLNQKDVPEAFEKYLAPIMKKIRAKI

SEQ ID NO: 3237 - protein, 661 aa, Caenorhabditis briggsae
LNKSIEPGDNPDLTEERASGTFDTNAMAAVIYGSDKFAQRRREISEAISKIPELADSAPLPFLDRFGKVTEGSRKLSVILENIDKLIDPSSYEEGLHLYTEVMGMEGHPLALHEVMFIPALIAQASDEQQVKWLGRARRREIIGCYAQTEMGHGSNLRALETTATYSPETQEFILHSPTITSLKWWPGALGKSANWAVVVANLTIRDKNYGPHPFMVQLRDEDSHEPLPGITVGDIGSKMAFNGGDNGFLGFRNYRIPREYLLNRHAKVEADGRYVKPPHAKINHSAMIRVRSHMATGQGALLAHALVIAVRYSAVRRQGYLEDKSREVKVLDYQTQQHRLFPSIARAYAFIFCGFETIRLYDQLLIDVQNGNTSGMADLHALTSGLKSVVTYQTGEGIEQARMACGGHGYSMASYISEIYGVAIAGCTYEGENMVMLLQLARYLVKSIEMIQNGKSRELGPMVAYLAEKESEIDLNLRPNEYLKVFEYAARNQTWRATEKYQKLIEKGESKDVAWNNCAVEMTRASRLHTRLYIMSTFINHVGSIVDQKVKGVLIDLLNVHVTYEVMDIGIYVQGLLSSNQMDLIRNQLYVSLETIRPNAVSLVDSFQISDMQLRSVLGRRDGNVYENLFKWAKSSPLNKTDVLPSVTQYLKPMMDKSKL

SEQ ID NO: 3238 - protein, 655 aa, Caenorhabditis briggsae
MSENPDLTNERASGTFDTNAMAAVIYGSEKFAQRRREITEAISKIPEFQDSHPLVFMSREEKISEACRKLAVLSNYWNSLIDTSDEEEALHLYREVLGLEGHPLALHETMFIPSLIAQASDEQQEKWLGRAQRREIIGCYAQTEMGHGTNLRALETTATFDISTREFILNSPTITSLKWWPGALGKSANWSIVIANLIIKEHNYGPHPFMVQLRDEKSHEPLPGITVGDIGPKMAFNGADNGFLGFKNYRIPRENMLMRHSKVTSDGSYIKPPHAKIGYSSMVKVRSRMAMDQGLFLASALVIAVRYSAVRRQGYLEDKSREVKVLDYQTQQHRLFPSIARAYAFIFCGFETIRLYDQLLIDVQNGNTSGMADLHALTSGLKSVVTYQTGEGIEQARMACGGHGYSMASYISEYYGVAIAGCTYEGENMVMLLQLARYLVKSIEMIQNGKSRELGPMVAYLAEKESEIDLNLGPNEYLKVFEYAARNQTWRATEKFQKLRNSGMSNEKAWNQASVELTRASRLHTRLYIMSTFINHVGSIVDQKVKGVLIDLLNVHVTYEVMDIGIYVQGLLSSNQMDLIRNQLYVSLETIRPNAVSLVDSFQISDMQLRSVLGRRDGNVYENLFKWAKSSPLNKTDVLPSVTQYLKPMMDKSKL

SEQ ID NO: 3239 - protein, 672 aa, Caenorhabditis briggsae
MVQNLNKNIQEGDNPDLTSERLTSTFNTNDMAAQIWGSEKRARRRREISAKIAQMPELHDSKPLPFMTREEKIMESARKLTILTEKMGQIIDPTDPAELYHLNNEVLGLEGNPMALHGVMFIPALSAQASDEQQAKWLPRALRREIIGTYAQTELGHGTNLQNLETTATYDLATQEFVLHTPQITALKWWPGNLGKSSNYAVVVAHMIIKAKNYGPHPFMVQLRDEKTHEPLPGITIGDIGPKMAYNIVDNGFLGFNKYRIPRTNLLMRHTKVEADGTYIKPPHAKINYSAMVHVRAYMLTGQAIMLASALNIATRYSSVRRQGQIDKSQPEVKVLEYQTQQHRLFPSIARAYAFQFAGAETVKLYEHVLKEMKSGNVSLMADLHALTSGLKSVVTYQTGEGIEQARMACGGHGYSMASYISEIYGVAIGGCTYEGENMVMLLQLARYLVKSAALVKSGQSSKLGPLVAYLGVKSEPTSLIDRIPNSGFTEYVKTFQHVSKRQTLKAADMFFGLMEKGEKREIAWNKCSVELNRASRLHTRLFIVEAFVRRVNEIADIRIKEALTDLLHLHVNYELLDIASYALEDGFLSASQLDYIRDQVYLYLGKIRPNAVSLLDSWEFSDIELRSVLGRRDGNVYENLFKWAKSSPLNKTDVLPSVTQYLKPMMEKARL

SEQ ID NO: 3240 - protein, 661 aa, Phytophthora infestans; identical to SEQ ID NO: 3187

SEQ ID NO: 3241 - protein, 702 aa, Phytophthora infestans; identical to SEQ ID NO: 3186

SEQ ID NO: 3242 - protein, 707 aa, Clavispora lusitaniae; identical to SEQ ID NO: 2990

SEQ ID NO: 3243 - protein, 661 aa, Branchiostoma floridae
MAQLVNPDLARERSRVSFDVEKLTNVLYGGPDGVKRKRRIESLALTDPDYEHEDFNYLSREEQYANMLKKSLMAAKKAKELGLSGKDMDDYMTSVLDYRAIAMNLHCTMFTITLQQQGDERQRAKWLKLAENFSILGSYLQTEMGHGTVTGPGTGILQVQVQRFCNMVMILAFMISDGSLGLTVTHGVVMAQLYTQGQCMGPHMFIMQLRSLENHKPLPGITVGDIGPKYGCNDGDNGFVRFDQVRIPRDNMLMRFAQVAEDGTYSMVLDPRLTYGTMVNMRVQLTERSNTSLARAVTIAIRYSCVRRQSELTPGEPEPQILDYQTQQYKLFPHLAAAYGFWFTIQNLEAHYERVNSKLQEGDTSGLQELHALTAGLKAYTTLEAHQGIEECRLACGGHGYSHASGLVYLLTSQAVTVTGEGETTVMLLQLARYLVKCYAKSQAGAKLPSTVSYLQMVQSAAVSGGTTRDINNFDVLTKAYQHRAARLVKVATEGVRFKVTSEGQSEAEAWNNSLVSLVKCAEAHSQFFVVKTFVEAVRTVDADDSVRAVLNTLCQLYALHGICEHAGDFLQDGYLTGPDLQLARSEMCSLLSKVRSDAVPLVDAFDFPDQILQSVLGRYDGRVYEHLYEWAKKSPLNKSQVHESYYKYLQPFLQKNRAKL

SEQ ID NO: 3244 - protein, 667 aa, Branchiostoma floridae
MAGQVNPDLAKERQNASFNTQKLTNLLYGGAEKVRRRRYIESLAISDPAYSSDEDPTFMSREELYSWGLKRGITMLRRVKELNITEEDLDTYRNAALQTLGGGIGIALHWIAFTPTIEQQATEEQMRKWLKPAQDVAIVGAYAQTEMGHGTFVRGLETTATYDPSTQEFVINSPTLTSTKWWPGGLGKTANHATVMAQLYTRGKCYGPHNFMVQIRSLENHQPCPGVILGDIGPKMESNGNDNGFARFDHVRIPRENMLMKFARVEADGTYVQPPSSKLAYSNMVYLRGTFVMSAAQALASATTIAVRYSCVRRQSEMKPGEPEPQILEYQTQQYKLFPQLAAAYAFWFAAQFMKQQHGSITASMEKGDMSGLAELHALSAGLKSYTTAVMSRGIDVCRMACGGHGYSHASGLPALFGGATSLCTAEGENTVMMLQTARYLVKCFVQSQAGKTLTGTVAYLSAVQPSPVAGNRNMSDLGTLVAAFQHRAARMVRHAAMQMQGEMQKGKAREDAWNSCSVLLIKAAEAHVHSFVVRNFAETVQTVQTVEVDESVRAVLTSLCQLYSLYGITEHAGDFLKDGYLTGRDIDAASSHLSAMLARVRPDAVALVDAFDLHDKTLHSVLGRYDGRVYEHLYEWAKKSPLNKSEVHESYYKYLQPFLKSNRAKL

SEQ ID NO: 3245 - protein, 660 aa, Branchiostoma floridae
MNPDLKKERDGASFDPEKIVNFLYGGPDRVRRRREVVSLALDDPDFQHEDLNFMSREQQYETQLKKSILVVQKQKELGLVSPEDMGNYNYNGVFKSMSGPFGLHTSMFLPTLRGQATAEQKAKWLKMAENYAIIGTYAQTEMGHGTFLRGLETTSTYDPQTQEFVLNTPTPTGTKWWPGCLGKTSNYCVLMAQLYIHGKSYGPHPFMVQIRSLQDHKPLPGVTVGDIGPKFGYAGNDNGFLRFDNVRIPRDNMLMKYSRVMSFFCYLKTVLTPTTESVFLYLHMYSVETAPRPGRPSCAIDEASVGGPTWGVLQNRQPEPQVLDYVTQQYKLFPYLAAAYAFMLAARSMIFVYFRSMEKIGRGDITVLPELHALSSGLKSLSSWVMNAGIEECRMACGGHGYSHASGIPSIYMEHTPAATYEGENTVLMLQTARYLMKSYNQSLQGEKLAGSVAYLSGVQPVPAAGRTRNVLDLNVLIQAFQHRAARLVHEAALQLKKERQTGKDQPDAWNAAAVDLVKAAKAHSQYFVVKNFADRLTDPALDSAARAVLTRLCQLYALHDIVNSSGDFLEDGYLTGADIRQARRHINALMAKLRPDAVALVDAFDFPDGILNSILGRYDGNVYQHLLEWAKASPLNKTDVHESYYKYLKPFLEANRAKL

SEQ ID NO: 3246 - protein, 667 aa, Branchiostoma floridae
MAGTRTVNPDLRKERESSSFDPDKITNFLYGGPEIVKRKRELESLALNDPDYQHEDLNFLSNEQQYETQLKKGILMTKKIQKLNLTDAQDMMIYRRYIAVGGSDSPSFGLHVSMFLPTLYGQATQEQKDKWLKLAENYVIIGTYAQTEMGHGTFLRGLETTATYDPQTQEFVINTPTITAYKWWPGQLGKTSNYCVLMAQLYIHGKSYGPHPFMVQIRSLQDHKPLPGVIVGDIGPKFGYGPVDNGFLAFHNVRIPRENMLMKYSKVEPDGTYVKPPSTKLAYGTMVLIRANIVMNSGRALAKAVTIATRYSCVRRQSEMKPGQPEPQVLDYVTQQYKLFPYLAAAYAFWLTGQTMMSVYMTFSSQISKGDISVLPELHALSAGLKALTSWVANMGMEECRLACGGHGYSHASGLPRHYANQTPGATYEGENTVMMLQTARYLMKSYNQSLQGEKLAGSVAYLSSVQPVPAASRTRNMLDLGALCDAFRHRAARLVHEAAMQLRNERQAGKDQPDAWNATSVDLVKAAMAHSQYFVVKNFAERLTDSRLDSSISAVLTRLCQLHALHGLVTNSGDFLEDGYLTGTDVRQARRHINTLMAKLRPDAVALVDAFDFPDGILNSILGRYDGNVYQHLLEWAKASPLNKTDVHQSYHKYLKPFLEANRAKL

SEQ ID NO: 3247 - protein, 653 aa, Branchiostoma floridae
MATTVNPDLRKERENASFVPEKITNFLYGGPERVQKKRELASLALNDPDYHHEDLNFMSREQQYETCLKKSLLMTTKIKQLKIDAYIISSLYLHCSAVTGPSPDPLGLHVGMFLPTLYGQATQEQKEKWLNLAENYVIIGTYAQTEMGHGTFLRGLETTATFDPKTQEFILNTPTLTASKWWPGGLGKTSNYCVLMAQLYIQGKSYGPHPFMVQIRSLQDHKPLPGVTVGDIGPKFGYDVIDNGFLALRNVRIPRENMLMKHSKVTPDGTYVKPPSSKLAYGTMVFVRATIVNDSAMALSIATTIAIRYSCVRRQSEMKPGHPEPQVLDYVTQQYKLFPYLAAAYAFWLTGQTMMSVYMTSSSRISKGDISVLPELHALSAGLKALSSWVANVGMEECRLACGGHGYSHASGLPRLYANLTPGATYEGENTVMMLQTARYLMKSYNQSLQGEKLAGSVAYLSGVQPVPAAGRTRNMLDLGALCDAFRHRAARLVHEAAMQLRNERQAGKDQPDAWNAASVDLVKAAMAHSQYFVVKNFAERLTDSRLDSSISAVLTRLCQLHALHGLVTNSGDFLEDGYLTGSDIRQARRHINALMAKLRPDAVALVDAFDFPDGILNSILGRYDGNVYQHLLEWAKASPLNKNDVSVTKHLK

SEQ ID NO: 3248 - protein, 674 aa, Drosophila pseudoobscura; identical to SEQ ID NO: 2802

SEQ ID NO: 3249 - protein, 436 aa, Unknown; identical to SEQ ID NO: 3086
  Description of Unknown: Acyl-coenzyme A polypeptide

SEQ ID NO: 3250 - protein, 433 aa, Unknown; identical to SEQ ID NO: 2391
  Description of Unknown: Acyl-coenzyme A polypeptide

SEQ ID NO: 3251 - protein, 721 aa, Eremothecium gossypii; identical to SEQ ID NO: 62

SEQ ID NO: 3252 - protein, 670 aa, Xenopus laevis; identical to SEQ ID NO: 534

SEQ ID NO: 3253 - protein, 681 aa, Oryctolagus cuniculus; identical to SEQ ID NO: 344

SEQ ID NO: 3254 - protein, 681 aa, Homo sapiens; identical to SEQ ID NO: 342

SEQ ID NO: 3255 - protein, 677 aa, Drosophila melanogaster; identical to SEQ ID NO: 509

SEQ ID NO: 3256 - protein, 694 aa, Petroselinum crispum; identical to SEQ ID NO: 112

SEQ ID NO: 3257 - protein, 664 aa, Glycine max; identical to SEQ ID NO: 93

SEQ ID NO: 3258 - protein, 665 aa, Glycine max; identical to SEQ ID NO: 92

SEQ ID NO: 3259 - protein, 669 aa, Oryza sativa; identical to SEQ ID NO: 987

SEQ ID NO: 3260 - protein, 699 aa, Phalaenopsis sp.; identical to SEQ ID NO: 579

SEQ ID NO: 3261 - protein, 699 aa, Yarrowia lipolytica; identical to SEQ ID NO: 994

SEQ ID NO: 3262 - protein, 701 aa, Yarrowia lipolytica; identical to SEQ ID NO: 995

SEQ ID NO: 3263 - protein, 700 aa, Yarrowia lipolytica; identical to SEQ ID NO: 361

SEQ ID NO: 3264 - protein, 700 aa, Yarrowia lipolytica; identical to SEQ ID NO: 364

SEQ ID NO: 3265 - protein, 689 aa, Yarrowia lipolytica; identical to SEQ ID NO: 369

SEQ ID NO: 3266 - protein, 664 aa, Arabidopsis thaliana; identical to SEQ ID NO: 146

SEQ ID NO: 3267 - protein, 667 aa, Caenorhabditis elegans; identical to SEQ ID NO: 2144

SEQ ID NO: 3268 - protein, 674 aa, Caenorhabditis elegans; identical to SEQ ID NO: 2091

SEQ ID NO: 3269 - protein, 662 aa, Caenorhabditis elegans; identical to SEQ ID NO: 2092

SEQ ID NO: 3270 - protein, 660 aa, Caenorhabditis elegans; identical to SEQ ID NO: 2093

SEQ ID NO: 3271 - protein, 679 aa, Caenorhabditis elegans; identical to SEQ ID NO: 2931

SEQ ID NO: 3272 - protein, 690 aa, Cucurbita sp.; identical to SEQ ID NO: 355

SEQ ID NO: 3273 - protein, 643 aa, Hordeum vulgare; identical to SEQ ID NO: 599

SEQ ID NO: 3274 - protein, 662 aa, Candida tropicalis; identical to SEQ ID NO: 32

SEQ ID NO: 3275 - protein, 709 aa, Candida tropicalis; identical to SEQ ID NO: 30

SEQ ID NO: 3276 - protein, 709 aa, Candida tropicalis; identical to SEQ ID NO: 348

SEQ ID NO: 3277 - protein, 709 aa, Candida maltosa; identical to SEQ ID NO: 117

SEQ ID NO: 3278 - protein, 724 aa, Candida maltosa; identical to SEQ ID NO: 55

SEQ ID NO: 3279 - protein, 664 aa, Arabidopsis thaliana; identical to SEQ ID NO: 68

SEQ ID NO: 3280 - protein, 721 aa, Eremothecium gossypii; identical to SEQ ID NO: 62

SEQ ID NO: 3281 - protein, 670 aa, Xenopus laevis; identical to SEQ ID NO: 534

SEQ ID NO: 3282 - protein, 681 aa, Oryctolagus cuniculus; identical to SEQ ID NO: 344

SEQ ID NO: 3283 - protein, 681 aa, Homo sapiens; identical to SEQ ID NO: 342

SEQ ID NO: 3284 - protein, 677 aa, Drosophila melanogaster; identical to SEQ ID NO: 509

SEQ ID NO: 3285 - protein, 694 aa, Petroselinum crispum; identical to SEQ ID NO: 112

SEQ ID NO: 3286 - protein, 664 aa, Glycine max; identical to SEQ ID NO: 93

SEQ ID NO: 3287 - protein, 665 aa, Glycine max; identical to SEQ ID NO: 92

SEQ ID NO: 3288 - protein, 669 aa, Oryza sativa; identical to SEQ ID NO: 987

SEQ ID NO: 3289 - protein, 699 aa, Phalaenopsis sp.; identical to SEQ ID NO: 579

SEQ ID NO: 3290 - protein, 699 aa, Yarrowia lipolytica; identical to SEQ ID NO: 994

SEQ ID NO: 3291 - protein, 701 aa, Yarrowia lipolytica; identical to SEQ ID NO: 995

SEQ ID NO: 3292 - protein, 700 aa, Yarrowia lipolytica; identical to SEQ ID NO: 361

SEQ ID NO: 3293 - protein, 700 aa, Yarrowia lipolytica; identical to SEQ ID NO: 364

SEQ ID NO: 3294 - protein, 689 aa, Yarrowia lipolytica; identical to SEQ ID NO: 369

SEQ ID NO: 3295 - protein, 664 aa, Arabidopsis thaliana; identical to SEQ ID NO: 146

SEQ ID NO: 3296 - protein, 667 aa, Caenorhabditis elegans; identical to SEQ ID NO: 2144

SEQ ID NO: 3297 - protein, 674 aa, Caenorhabditis elegans; identical to SEQ ID NO: 2091

SEQ ID NO: 3298 - protein, 662 aa, Caenorhabditis elegans; identical to SEQ ID NO: 2092

SEQ ID NO: 3299 - protein, 660 aa, Caenorhabditis elegans; identical to SEQ ID NO: 2093

SEQ ID NO: 3300 - protein, 679 aa, Caenorhabditis elegans; identical to SEQ ID NO: 2931

SEQ ID NO: 3301 - protein, 690 aa, Cucurbita sp.; identical to SEQ ID NO: 355

SEQ ID NO: 3302 - protein, 643 aa, Hordeum vulgare; identical to SEQ ID NO: 599

SEQ ID NO: 3303 - protein, 662 aa, Candida tropicalis; identical to SEQ ID NO: 32

SEQ ID NO: 3304 - protein, 709 aa, Candida tropicalis; identical to SEQ ID NO: 30

SEQ ID NO: 3305 - protein, 709 aa, Candida tropicalis; identical to SEQ ID NO: 348

SEQ ID NO: 3306 - protein, 709 aa, Candida maltosa; identical to SEQ ID NO: 117

SEQ ID NO: 3307 - protein, 724 aa, Candida maltosa; identical to SEQ ID NO: 55

SEQ ID NO: 3308 - protein, 664 aa, Arabidopsis thaliana; identical to SEQ ID NO: 68

SEQ ID NO: 3309 - protein, 721 aa, Eremothecium gossypii; identical to SEQ ID NO: 62

SEQ ID NO: 3310 - protein, 670 aa, Xenopus laevis; identical to SEQ ID NO: 534

SEQ ID NO: 3311 - protein, 681 aa, Oryctolagus cuniculus; identical to SEQ ID NO: 344

SEQ ID NO: 3312 - protein, 681 aa, Homo sapiens; identical to SEQ ID NO: 342

SEQ ID NO: 3313 - protein, 677 aa, Drosophila melanogaster; identical to SEQ ID NO: 509

SEQ ID NO: 3314 - protein, 694 aa, Petroselinum crispum; identical to SEQ ID NO: 112

SEQ ID NO: 3315 - protein, 664 aa, Glycine max; identical to SEQ ID NO: 93

SEQ ID NO: 3316 - protein, 665 aa, Glycine max; identical to SEQ ID NO: 92

SEQ ID NO: 3317 - protein, 669 aa, Oryza sativa; identical to SEQ ID NO: 987

SEQ ID NO: 3318 - protein, 699 aa, Phalaenopsis sp.; identical to SEQ ID NO: 579

SEQ ID NO: 3319 - protein, 699 aa, Yarrowia lipolytica; identical to SEQ ID NO: 994

SEQ ID NO: 3320 - protein, 701 aa, Yarrowia lipolytica; identical to SEQ ID NO: 995

SEQ ID NO: 3321 - protein, 700 aa, Yarrowia lipolytica; identical to SEQ ID NO: 361

SEQ ID NO: 3322 - protein, 700 aa, Yarrowia lipolytica; identical to SEQ ID NO: 364

SEQ ID NO: 3323 - protein, 689 aa, Yarrowia lipolytica; identical to SEQ ID NO: 369

SEQ ID NO: 3324 - protein, 664 aa, Arabidopsis thaliana; identical to SEQ ID NO: 146

SEQ ID NO: 3325 - protein, 667 aa, Caenorhabditis elegans; identical to SEQ ID NO: 2144

SEQ ID NO: 3326 - protein, 674 aa, Caenorhabditis elegans; identical to SEQ ID NO: 2091

SEQ ID NO: 3327 - protein, 662 aa, Caenorhabditis elegans; identical to SEQ ID NO: 2092

SEQ ID NO: 3328 - protein, 660 aa, Caenorhabditis elegans; identical to SEQ ID NO: 2093

SEQ ID NO: 3329 - protein, 679 aa, Caenorhabditis elegans; identical to SEQ ID NO: 2931

SEQ ID NO: 3330 - protein, 690 aa, Cucurbita sp.; identical to SEQ ID NO: 355

SEQ ID NO: 3331 - protein, 643 aa, Hordeum vulgare; identical to SEQ ID NO: 599

SEQ ID NO: 3332 - protein, 662 aa, Candida tropicalis; identical to SEQ ID NO: 32

SEQ ID NO: 3333 - protein, 709 aa, Candida tropicalis; identical to SEQ ID NO: 30

SEQ ID NO: 3334 - protein, 709 aa, Candida tropicalis; identical to SEQ ID NO: 348

SEQ ID NO: 3335 - protein, 709 aa, Candida maltosa; identical to SEQ ID NO: 117

SEQ ID NO: 3336 - protein, 724 aa, Candida maltosa; identical to SEQ ID NO: 55

SEQ ID NO: 3337 - protein, 664 aa, Arabidopsis thaliana; identical to SEQ ID NO: 68

SEQ ID NO: 3338 - protein, 408 aa, Corynebacterium efficiens; identical to SEQ ID NO: 3099

SEQ ID NO: 3339 - protein, 410 aa, Corynebacterium efficiens; identical to SEQ ID NO: 2797

SEQ ID NO: 3340 - protein, 420 aa, Corynebacterium efficiens; identical to SEQ ID NO: 2796

SEQ ID NO: 3341 - protein, 429 aa, Uncinocarpus reesii
MNSSILRHTARGALNASRATSSNITKRCASSSAARFDWQDPLNAANLYTADELAIAETARQYCQERLMPRVLEAYRKEDYDKTMLQEMGELGLLGATIDGYGCAGVSTVASGLITKEVERVDSGFRSGMSVQSSLAMTGIHEFGTKEQKEKYLPELAKGKLIGCFGLTEPNHGSDPGSMETVARPHPTKKGYLSLTGAKTWITNSPISDLFLVWAKLEATGKIKGFIIQRDQCPTGTLETPTIKNKTALRASITGMIQLDNCPVPEENMLPDVEGLVGPFTCLNSARLGIAFGTMGALEDCIDRARTYSLERKQFKGNPLAKYQLIQKKLADAATDAAYGTLAAVQVARLKDEGKCTPEMISMIKRQNCDRALVGARTLQEVFGGNAASDEYHIGRHVANLFVAQTYEGQSDIHSLILGRAITGVQAFC

SEQ ID NO: 3342 - protein, 693 aa, Uncinocarpus reesii
MSPTPDWVTKLRPSGPQGSELLAQERAKSNVSVDKLAELLHTRETLQRQERILEIMEKEPVFDKSQNHSLGRVERLKRSLGKAKRLQNLRTQHGWSQEDFHMANDLLAEPTPYGLHASMFLVTLREQGTPEQHKLFLTRAENYEYIGCYAQTELGHGSNVRGLETTATWDPTDKTFVIHSPTLTASKWWIGSLGRTANHAVVMAQLIIEGKSYGPHPFVVQVRDLKTHEPLENVHVGDIGPKFGYNTMDNGFLLFNHVKIPHVNMLARFSRVDPDTGKYIRPASPSLVYGTLTWVRSTIVLQSGGVLARGVTIATRYCAVRRQFQDRDAPASEVGENQVINYKMVQIRLLPLLAATFALHFTGRGMMALYQQNQSLMKATEKGTKTRGAGPEQLNPGADLLADLHATSCGLKALGSTIAVEGLEACRRACGGHGYSSYSGIGPWYSDYLPTATWEGDNYMLTQQVARYLLKSARSVIAGKPANNDTCRVLKSYLARRDVGAAFDVLDNDKDIVDAFAWRTAYLTFEALKHRDVEKRSWNSLLVDFWRLSTAHSQYLVVKNFYEAVSSPATAAALGPETMTVMHKLFRLHALHTLEREASDFFTSGAVTTRQIVLARTKAVMALLEEIRPHALRLVDSWKFPDWQLDSALGRYDGKVYEDLFHRASELNPVNAMTFDPYPGHEALLKNERTSKL

SEQ ID NO: 3343 - protein, 692 aa, Uncinocarpus reesii
MAHKVDWSAALRPASPDGATIIGEERARSNISVDSLANYLLTPEFLKQQDRVLKEVLKEPVFKKTNQANLSRPDRYKLGLARGKKLRQLQDKLGWSEDDYHMAVYLCDDVLPYHLHTAMFVTTVSQQGNDAQRAYWMPKIEAWEIIGAYAQTELGHGSNVRGIELEAKWDPKAKEFVLHSPHLTASKWWNGTMGRTATHAIAVAQLMLPVSGHGAETKYQSYGPHPFIVQIRDSKTHQPPGSIIIGDIGPKYGYASMDNGYMLFNNHRVPHDAMLSRYSRVDPGTGKYTKPENPEVVYGTLTHVRAAIVMEARLSLARAVTVAVRYLSIRRQFKDKDSTNPSDPEMSVLDYPTVQIRILPLLATAFALHYSGKAMGELYTRTRKNIEEGDFETLAELHSTSSGLKSLATDLTASGIETCRRAMGGHGFGASGLVQLNANYLSKPTVEGDNWMITQQVARYLIKKAKALSGSVKSRATTRTEENLERYMYARQKTFNLGIFQDDASILQAYEWRVAYLVFKAYEAREIQKKPWNSLLIDFHKLSRAYSQSILVFNFHQAIQPTNPDFAHLDSTTRTVLRELFHLFAFTTMDAEAREFSSSGAVSNEDLDALPARVLELMGRIRPHAVRLVDAWKIPDFVLDSALGRYDGKVYEDLFDRAHRQNPLNNETFNPDYRTDEIVLGSGDAGQILSKL

SEQ ID NO: 3344 - protein, 692 aa, Uncinocarpus reesii; identical to SEQ ID NO: 3343

SEQ ID NO: 3345 - protein, 693 aa, Uncinocarpus reesii; identical to SEQ ID NO: 3342

SEQ ID NO: 3346 - protein, 429 aa, Uncinocarpus reesii; identical to SEQ ID NO: 3341

SEQ ID NO: 3347 - protein, 698 aa, Nectria haematococca; identical to SEQ ID NO: 3175

SEQ ID NO: 3348 - protein, 662 aa, Nematostella vectensis
MNPDIARERSQASFSVQELINLLDGGKQNTERRRYVESLLSQEPLFQKEQDFFLSREEAFDLVGQRALRVFQIVKENKITSREDNRHLSRGIDLTLPSDLHRVMFMPTIKLMGTKEQQEKWLPLAEMHQILGTFAQTELGHGTFVRGLETTATYDKQTQQFVLHSPSLTASKWWPGNLGHSTNYCIVVARLIIDDKEYGLHYFLLQTRDLKTHQPLPGVTIGEIGPKTSRYYNVNDNGFLLLDHVRVPREQMLMGLAQVNSKGEFIRKSSKGGEKAVYAPMMLIRAGIPFNVFYQLSRAMTIAIRYSTVRRQSEIKPGHGEVQILDYKSQQDKLFPGLALAYATWFAASGVYKEFLNQSENWSKGNFSFLQELHALTSGMKAFSTSRALGQVETCRLACGGHGFSAFSNLPELHDLISAGCTYEGENTVLMLQVARFLVKCVAKGRNGSDLHSTVTYLKGAGSKGTFHTTADEFLDPRVQVELYREASFRLVTDTEHRLKAKVKSGIDPAIAFNELSVDLIRCANAHMSYLVVKYFIEALDTDFAKASHPIKSVLKSVCDIFALHGISEESGRFLEVSVITPNQVAIVRDQIMELFSKIRPDAVALVDAFDYSDFVLNSALGRYDGQVYQRLFELAQKSELNKKKVQPSAKKYLQELQKSKL

SEQ ID NO: 3349 - protein, 661 aa, Nematostella vectensis
MNPDIARERSKASFDIQELTYFLDGGKEKTSRRRYLESLLSNDPVFEKDQDWFYGREGSYENSLRKGVHFIDIVRTHKITDKYELQVLERAIGYPLPTLLNDLMFIPTIKTLGTKRQQEKWIPLAKSYQILGTYAQTEMGHGTFIRAIETTATYDTTTQEFVLHSPSLTAAKWWPGSLGHTCSHAIVLAQLYIGKKSYGIQFFMLQIRDPVTRRPTPGVKLGDIGPKGSFLINSQENGYLLLDHVRVPRDHMLSALAEVMADGTFVKSSNEDADKVLYSIMLYVRSTIPQDAYFIASRAITIAVRYSAVRRQSELKPGQGELQILDYSTQQDKLLPSLATAYAYKFASDRIRIEYERANTKWTTGDFSNLPELHVLTSAMKAYTTSGARLLADTCRLGCGGHGFSMFSLLTELFAVASAACTYEGENTVLYLQVARFLLKCVSKARLEPRLPPSVSYLLDESTRDWRCTCSSPRQLDSQTQLRIYKARASRLINMTADKMQADVILGMDPVDSWNKNSVDLVRCAKAHSSYLIVQFFLDALSQSNSSREIASVLKSQSDLYALYGIVEDSGSFMECGVLTVNQIAMIRDQVYSLYQIIRPDAVALVDAFDYSDFVLNSALGRYDGQVYQRLFELAQKSPLNKSPVQPSAKKYLPQLHKSKL

SEQ ID NO: 3350 - protein, 695 aa, Penicillium chrysogenum; identical to SEQ ID NO: 3232

SEQ ID NO: 3351 - protein, 689 aa, Penicillium chrysogenum
MPDFTDNLRPSQPDGPTTLARERQKSNIATEELGQHLLGSDGFLVRQARILPIIQQEPLFSKDQQQNLSRPERFKLGVARAKLLRQMKDTHKWSHLEYQMAEYLVDDVSPYFLHMEMFITTIREQASEEQQAHWLPLIELWKIIGAYAQTELGHGSNVRGLELEARWDNRTKEFVLHSPTLTASKWWNGSLGRLANHAIVVAQLLLPDPSSPDQYVSHGPHPFIVQVRDMKTHQPLNGIVVGDIGPKYGYITMDNAYMLFDQFRIPHSAMLSRYSKVDLNTGIYTKPEKPALVYGSLTYVRSNMVHRARLVLARAVTVAVRYSSVRRQFQDRDGDKTGPEMSVLDYPTVQIRILPLLATTFALHYTGLAMQTVYKNARQDIEEGNFNSLAHMHSMSSGLKSLCTIFAADGIETCRRAMGGHGFGGGSGLIQVNNDYLSKPTVEGDNWMITQQVAAYVIKKMTAAVGSPDTPGIDETDARFKEFIRNKRRPESEKRTYDILNSDLDIVKSFELRATAMASSTKLIRVIKKRNWNSLLIQLHKLSRAQSESIIVATFFDALSNDKTLSAPTKNVLWDCYRLFALYSMENESFEFLRTNAVSQTDLDSLASRVQDLMARIRPHAVTLVDSWMIPDYLLDSALGRYDGRVYEDLFNRAHRLNPLNRITFNPNYWEDEIVKGSGDNGRGILSKL

SEQ ID NO: 3352 - protein, 682 aa, Drosophila yakuba; identical to SEQ ID NO: 3072

SEQ ID NO: 3353 - protein, 677 aa, Drosophila yakuba; identical to SEQ ID NO: 3073

SEQ ID NO: 3354 - protein, 677 aa, Drosophila yakuba; identical to SEQ ID NO: 3071

SEQ ID NO: 3355 - protein, 738 aa, Lachancea thermotolerans; identical to SEQ ID NO: 2744

SEQ ID NO: 3356 - protein, 440 aa, Ricinus communis
MTIYASSKNQDDLDHSQKSSYFNLPPLNVSIAFPQATPASIFPPCASDYFQLDDLLTPEEQAIRIKVRQCMEKEIAPIMTEYWEKAKFPFHVIPKLGTLRIAGGTIKGYGCPGLSLTGSAVATAEVARVDASCSTFILVHSSLAMLTIALCGSEAQKQKYLPSLAQLSTVACWALTEPEYGSDASALKTTARKVEGGWILDGQKRWIGNSTFADVLVVFARNTSTEQINGYIVKKDAPGLTATKIENKIGLRMVQNGDILLKQVFIPDEDRLPGVNSFQDTNKVLAVSRVMVAWQPIGISMGIYDMCHRYLKERKQFGAPLAAFQINQQKLVQMLGNVQAMVLVGWRLCKLYETGKMTSGHASMAKAWITSKARETAATGRELLGGNGILADFLVAKAFCDLEPIYTYEGTYDINTLVTGREVTGIASFKPAALSNRSRL

SEQ ID NO: 3357 - protein, 751 aa, Zygosaccharomyces rouxii; identical to SEQ ID NO: 2288

SEQ ID NO: 3358 - protein, 649 aa, Trichoplax adhaerens
MDAPLLKERERATFNVTELIHLLNGSEEETKRRKELESWLYNNPVFRQDDRYQISREEVYERGLQKTRELVNLCRRKNIKFDSLDFARLNISTLEELPFFLHVIMFIPTIRGQGTEEQKRKWLPLAEDLKILGTYAQTELGHGTFLRGLETKATYDVSSREFIVNSPTITSMKWWPGGLGKTCNYAVIAAQLYTKGKCYGIHMFIVQLRSLEDHKPLPGVTIGDIGNKYGFHTVDNGFLRLDNVRIPYENMLMRYAKACDYIPPVNPKINYGTMTSIRVDLVKDASVILAAASTIAIRYSAVRHQTEIRPGEEPPVLDYITQQFKLFPQIATAIAFHFAGDYMHRIYDKVQSEIFDGHLSAITELHGISAGLKAFTTDTSIAGVEICRRACGGHGYSNASGFQRFYENWLGSATYEGENTVMYLQAARYLFKCYDNPKEAPETMSYLRYPQNKMEWNVKSADDVSNYATLITAFEQRALSKISSTAKKLKNLTHYGMNRNDAWNAASVDILHSIKAHCHYFIVKNYMQSLNHLKMSSPLRQVMTAVALLYANYGIDEHAGDFLESGFMNGKQINLVRAKILQLLKEIRVNAVAIVDSFDFDDRFLRSALGAYDGNVYNRLFKWAKLSPLNKTEVHSSYKYLRRILQSKL

SEQ ID NO: 3359 - protein, 500 aa, Trichoplax adhaerens; identical to SEQ ID NO: 2658

SEQ ID NO: 3360 - protein, 405 aa, Streptococcus uberis; identical to SEQ ID NO: 2738

SEQ ID NO: 3361 - protein, 667 aa, Sorghum bicolor; identical to SEQ ID NO: 2858

SEQ ID NO: 3362 - protein, 667 aa, Sorghum bicolor; identical to SEQ ID NO: 2858

SEQ ID NO: 3363 - protein, 678 aa, Rhodobacterales bacterium; identical to SEQ ID NO: 3110

SEQ ID NO: 3364 - protein, 691 aa, Physcomitrella patens
MADGVEEQLIAMRGFLDGEVAQRRLDRLASHFSEENILKEEQLSREVCAKLIRRSVNSSVLASLMAGCYPADREKIFNFFINRPDLETPVEIAKTEHRELVYMQLTALVNEGGVNAMKYLMEDPARYFTIMEAVGFIDVSLGIKFGVQFSLWGGSVVNLGTQKHRDKYLEGISNLKYPGCFAMTELHHGSNVQGIQTTATFDRMTDEFVINTPNEGATKWWIGNAAVHGKIASVFARLQLPSPDSHLDTDMGVHAFIVPLRSMEDHSVLPGIEIRDCGYKVGLNGVDNGALRFHNVRIPRDNLLNRFGDVSRDGEYSSTLPTINKRFAATLGELVGGRVGLAYGSVGVLKAACTIAIRYSLIRQQFGPPNKEEISILDYQSQQQKLMPMLSSAYAFNFATEYLVERYAEMKRTHDDDIVADVHALSAGLKAYITSYTAKSLNTCRESCGGHGYAAVNRFGSLRNDHDIFQTFEGDNTVLLQQVAGDLLKQYKRKFEGGALSVTWTYLRDSMTTYLSQTNPVVTHREGYSHLRDPRFQLDAFQYRTARLLHTAALRLRKHSKRLGSFGAWNRCLNHLLTLAESHIESVILAKFTEAIERCEDRNTRKVLNMLRDLYALDRIWKDIGTYRNQDYIAPNKAKAIHRLVEYLSFELKGVAGSLVDGFGIPDVLLRAPIGLQSGQYTEYSHHIGFE

SEQ ID NO: 3365 - protein, 667 aa, Physcomitrella patens
MQDGNGLDHLAGERAMAQFDLQAMKVYLAGGQREYEISTKMAQLVANDPVFSKEDRVRLARKDLYKNSLRKAGHAWKTILEKGLSEVEGLKLRHFVDEPTYTDLHWGMFIPAIKGQGTEEQQHKWLPLAYKMAIIGCYAQTELGHGSNVQGLETTATFDPTTDEFIMHSPTVTSTKWWPGGLGKASTHALVYARLITDKKDHGIHAFIAPIRSLEDHTPLPNVTVGDIGVKFGNGGYNTMDNGFLRFDHVRIPRENMLMRLATVTKDGKYVRSNKPRQLGYGAMVFVRQGIVIDASIYLSRAVTIAVRYSAVRRQFGNKDEPGELQVIQYRTQQSRLFPLLATAYAYRAVGFWMKSLYADVMKRLNDNDFSTLPEVHACTAGLKSITTSVTADGIEECRKLCGGHGFLCASGLPELYAAYVPACTYEGDNTILLLQVARFLLKTLSQVSKVRPVGTAAYLGNIKQLSTQNCKVSQGHDWLNTSVLLEAFEARSARQAAAVALRLAKGSGSEAEFQENTPELVESARAHCQLILVSKFIEQLQTGTPEGIRKQLEVLCYTYAFSQLIDNAGDFLATGYVTGNQIALAKEELKHMFDKIRPNAVALVDAFDHTDDYLGSALGRYDGDVYTHLYKGAFKESLNDTVVVDGYEEYLKPVLTQNLWAPHSKL

SEQ ID NO: 3366 - protein, 483 aa, Physcomitrella patens
MTVTSPELMESLFRIEPIEGFGVTTILRRWVEFACETWSYVTAALERIPTLAIGLPPLDIRSAFPQATPASIFPESVSDYFQLDDLLSSEDVALRKRIRETMEKHVAPVMTKYWEKAEFPFECVPHISSLMVAGGTTKGYGCPGLSVLSSALAMSEIARVDASCSTFVLVHSSLCMATLAMLGSEEQKLKYLPGLARLDLIGCWALTEPGYGSDASSLNTTAKKVEGGWLLNGQKRWIGNATFADVAVLFARNTQTNQINGFIVKKGTPGYRATKIENKIGLRMVQNGDIVMENAFVPDKDRLPGINSFADTNKVLAVSRIMVAWQPIGIAMGVYDICHRYLLERKQFGAPLAALQINQEKLVRMLGNIQAMFLLGWRLCKIYEAGKMTPGQASLCKAWNTKRARETVALGRELLGGNGILADFLVAKAFCDLEPIYSYEGTYEINALVTGREITKIAAIKPSGGKTKTTATSEGLVRNTTKN

SEQ ID NO: 3367 - protein, 682 aa, Physcomitrella patens
MDEMRGLLASEVAQRRLDRLASHFCEANLAKEEKVSREVCAKPFQRSVNPTILANLMAGGYPADRQKIFDFFISRPDLETPVEIAKAEHRELAFKQLKALVNEASIHPMKLLMEDPARYFTITEAIGFIDVSLGVKLGVQFSLWGGSVVNLGTQKHRDKYLEGISNLKFPGCFAMTELHHGSNVQGIQTTATFDRMTDEFVINTPNDGATKWWIGNAAVHGKFASVFARLKLPCPDSHLDTDMGVHAFIVPIRSMEDHSVLPGIEIRDCGYKVGLNGVDNGALRFRNVRIPRDNLLNRFGDVSRDGGYTSKLPTINKRFAATLGELVGGRVGLAYGSVGVLKAASTVAIRYSLLRQQFGPPNKEEVSILDYQSQQQKLMPMLSSAYAFHFATEYLVARYAEMKKTHDDEIIADVHALSAGLKAYITSYTAKALNTCRESCGGHGYAAVNRFGTLRNDHDIFQTFEGDNTVLLQQVAGDLLKQYKRKFTGGALSVTWTYLRDSMSNLSQTNPVATHREGYTHLRDPRFQLDAFQYRTARLLHTAALRLRKHSKRFGSFGAWNRCLNHLLTLAESHIESVILAKFNEAIERCEDRQTRKVLNMVRDLYALDRIWKDIGTYRNQDYVSPNKAKAIHRLVEYLSYELKGAAGSLVDGFGIPDALLRAPIGLQSGQYSEYSHYVGFE

SEQ ID NO: 3368 - protein, 676 aa, Phaeobacter gallaeciensis; identical to SEQ ID NO: 3105

SEQ ID NO: 3369 - protein, 679 aa, Rhodococcus opacus; identical to SEQ ID NO: 2258

SEQ ID NO: 3370 - protein, 419 aa, Kocuria rhizophila; identical to SEQ ID NO: 2732

SEQ ID NO: 3371 - protein, 704 aa, Kocuria rhizophila; identical to SEQ ID NO: 2216

SEQ ID NO: 3372 - protein, 411 aa, Tetrahymena thermophila; identical to SEQ ID NO: 2953

SEQ ID NO: 3373 - protein, 420 aa, Tetrahymena thermophila
MERVQSISQQLYTTDSLDILEYNFLYDEEENIIRKKFREVIQRDIKPHINQYIEKAQFPTFVRQKLKEFGLFKLFVGPPFGEGRRTRLIGILISEMAMIDSGLSLFMLVQWSVLMTTIEWFGSEAQKQLYLPKLIDCDQIGGWALTEPNYGSDASGLESNVKEIDGKQIFKYNHIICKKSGFILNGTKRWIGNGNGDIVVVWAKNQTTKQIEGFIVELTQKGVTRQVIEHKLAVRMVQNYHLTFENVFIPVNMKLPLATSFQESTNKILKHSRIVAVWISSGIARGVCERALQYIEPKQKPKKKVLSMISNTQSVLLMAWRVSELYDSKQLTLGQVALAKSYATTRTREICTQAKDLLVKNFNNQIKQEGAGIYEDDYILKAMLDIEATHTYEGTYDINALVAGRELTGLSAFKARNNKQ

SEQ ID NO: 3374 - protein, 420 aa, Corynebacterium efficiens; identical to SEQ ID NO: 2796

SEQ ID NO: 3375 - protein, 410 aa, Corynebacterium efficiens; identical to SEQ ID NO: 2797

SEQ ID NO: 3376 - protein, 432 aa, Corynebacterium efficiens; identical to SEQ ID NO: 2798

SEQ ID NO: 3377 - protein, 680 aa, Rhodococcus erythropolis; identical to SEQ ID NO: 3094

SEQ ID NO: 3378 - protein, 667 aa, Branchiostoma floridae; identical to SEQ ID NO: 3244

SEQ ID NO: 3379 - protein, 661 aa, Branchiostoma floridae; identical to SEQ ID NO: 3243

SEQ ID NO: 3380 - protein, 660 aa, Branchiostoma floridae; identical to SEQ ID NO: 3245

SEQ ID NO: 3381 - protein, 667 aa, Branchiostoma floridae; identical to SEQ ID NO: 3246

SEQ ID NO: 3382 - protein, 653 aa, Branchiostoma floridae; identical to SEQ ID NO: 3247

SEQ ID NO: 3383 - protein, 402 aa, Corynebacterium striatum; identical to SEQ ID NO: 2910

SEQ ID NO: 3384 - protein, 691 aa, Corynebacterium striatum; identical to SEQ ID NO: 2909

SEQ ID NO: 3385 - protein, 677 aa, Drosophila sechellia; identical to SEQ ID NO: 2994

SEQ ID NO: 3386 - protein, 728 aa, Micromonas pusilla; identical to SEQ ID NO: 3174

SEQ ID NO: 3387 - protein, 402 aa, Gemmatimonas aurantiaca; identical to SEQ ID NO: 2881

SEQ ID NO: 3388 - protein, 684 aa, Gemmatimonas aurantiaca; identical to SEQ ID NO: 2260

SEQ ID NO: 3389 - protein, 429 aa, Picea sitchensis
MANDRTSHLGLPAMDISLAFPQATPASKFPPCVSDYFQLDAFLTPEERDIRKKVREVAETEIAPIIVKYWERAEFPFEIVPKLATLKVSGGTIKGYGCPGLSTLGSALALSEVARVDASCSTFLMVHTCLAMLTISMCGSEDQKTKYLPSLAQLHTISCWALTEPNYGSDASSLNTIATKVEGGWKLDGQKRWIGNSTFADILVVFARNITTNQINGFIVRKGTPGLRVTKIENKIGLRCVQNGDILLKGVFVADEDRLPGIDSFQDTSKVLAVSRIMVSWQPIGIAMGVYDMCHRYLQERKQFGVSLNSFQISQEKLIRMLGNIQAMNLMGWRLCKLYDDGKMTPGHASLTKAWNTLKAREVVSLGRELLGGNGILTDFLVAKAFCDLEPIYSYEGTYEVNSLVTGREVTGTASFKAPPARKLLTAKL

SEQ ID NO: 3390 - protein, 660 aa, Picea sitchensis
MEDLARERAETTFDVEAMKIIWAGGRQAFELQHKLASIVANDPVFRKDNKPNMTRKELFIGGIRKAAHCRELALELGLSEDDARTLRTLRGEKAYDDLHWNMFIPVLRTQATAEQQKKWLPLATSMSVIGCYAQTEIGHGSNVQGLETTATFDPSTDEFILNSPTLTSTKWWPGGLGKVATHAIVHARLILDKDYGVHAFIVQIRSLEDHKPLRTITVGDIGQKFGNGGNNTVDNGFAQFNNTRIPRDNLLMRMAIVTKEGKYVRQNVPKQMLYGGMIAARQIILMEASMDLSHAVTIAVRYSAVRRQFSLDDGNREIQVLDYPTQQQKIFPLLASAYAFRFVGQWMESLYSEVMYQFENNNFSALAEIHACTSGLKALTTSVTADAIEKCRKACGGHGYLCASGLPELFAAYIPSCTYEGDNTLLFIQVGKFLVKTILNMKTSFRPQGTTQYLADLDLLTKKNCEVSDEDDWLSSNVILGAFKARAARLALSISRQILKFPNQDAGFEELSVNLVSVAQAHCQLIVLSKFIDKVHGAIPGLNVKKQLQLLCNTYGLSLVCEHVEDFLVTGYLTKRQANLARHQLRSLLSHVRPNAIALVDSFDHTDHYLGSVLGRYDGDVYTHLYMEALKDPFNNSAVTEGYKEYIEPIIKQRLQSSKL

SEQ ID NO: 3391 - protein, 420 aa, Tetrahymena thermophila; identical to SEQ ID NO: 3373

SEQ ID NO: 3392 - protein, 440 aa, Ricinus communis; identical to SEQ ID NO: 3356

SEQ ID NO: 3393 - protein, 832 aa, Flavobacteriales bacterium; identical to SEQ ID NO: 3100

SEQ ID NO: 3394 - protein, 681 aa, Unknown; identical to SEQ ID NO: 342
  Description of Unknown: Acyl-coenzyme A polypeptide

SEQ ID NO: 3395 - protein, 685 aa, Drosophila mojavensis; identical to SEQ ID NO: 3061

SEQ ID NO: 3396 - protein, 676 aa, Drosophila mojavensis; identical to SEQ ID NO: 3059

SEQ ID NO: 3397 - protein, 677 aa, Drosophila mojavensis; identical to SEQ ID NO: 3060

SEQ ID NO: 3398 - protein, 725 aa, Drosophila mojavensis; identical to SEQ ID NO: 3058

SEQ ID NO: 3399 - protein, 454 aa, Toxoplasma gondii; identical to SEQ ID NO: 1995

SEQ ID NO: 3400 - protein, 454 aa, Toxoplasma gondii
MGRAGRNIRAEGRLVQLSGQVKREPVDSTLCSKNSDGKSSNDNSSDELQDGKPAADMRHGKTGGGPIYALDFMHFDSLLTPRERTLRGRVQNIVSRYVEHAVLPLYEEAAFDSELVEICKKFGPAGLQIKGYGCPGLTHTEAILMAMEMARVDASFSTFYLVHCGLAMQSIAVAGTQEQKAMWLPKMSRLECIGSFGLTEPNHGSDATGLRTSAKKVEGGWILNGQKRWIGNATFSDIVVVWARDVHSEKILGFIVEKDFPGFSATKIENKVSLRIVQNADIVLKDCFVPDSHRLQHEGFSGATAQVLESSRAVVAAECVGVLLGAYDNALKYCTERKQFGRELATFQLVQERLMRVLGMLQGVLLLVLRLGRLMDEGKPHMMAHIALAKATCSRVAREGIALCREVLGGNGIVTDFGVAKFHADIEALYTYEGTYDINMLIAGRAVTGRSAFK

SEQ ID NO: 3401 - protein, 436 aa, Zea mays; identical to SEQ ID NO: 3086

SEQ ID NO: 3402 - protein, 433 aa, Zea mays; identical to SEQ ID NO: 2391

SEQ ID NO: 3403 - protein, 678 aa, Providencia alcalifaciens; identical to SEQ ID NO: 2911

SEQ ID NO: 3404 - protein, 645 aa, Caenorhabditis elegans; identical to SEQ ID NO: 1372

SEQ ID NO: 3405 - protein, 674 aa, Caenorhabditis elegans; identical to SEQ ID NO: 2091

SEQ ID NO: 3406 - protein, 667 aa, Caenorhabditis elegans; identical to SEQ ID NO: 2144

SEQ ID NO: 3407 - protein, 662 aa, Caenorhabditis elegans; identical to SEQ ID NO: 2092

SEQ ID NO: 3408 - protein, 660 aa, Caenorhabditis elegans; identical to SEQ ID NO: 2093

SEQ ID NO: 3409 - protein, 679 aa, Caenorhabditis elegans; identical to SEQ ID NO: 2931

SEQ ID NO: 3410 - protein, 425 aa, Penicillium chrysogenum
MMNRSLLRAAARSIQAGPTSVAGRRYASSAVFNWEDPLAAAELFTDEELAIQDTARQYCQDKLAPRVLEAYRNEDYDRRILEEMGDLGLLGASIEGYGCAGVSTVASGLITKEVERVDSGYRSGMSVQSSLAMTGIYEFGTEEQKQRFLPSLAKGTLAGCFGLTEPNHGSDPGSMETVAREHPTQKGMYLLSGSKTWITNSPIADVALVWAKLESTGKIRGFIVERERATPGSYETPAIKNKSALRASITGMIQMDNCPVPAENMLPEVEGLKGPFTCLNSARLGIAFGAMGALEDCLARAREYSLERKQFKGNPLAKYQLIQMKLANAATDAAYGTLAAVQVARLKDAGKATPEMISMIKRQNCDRALANSRILQEVFGGNAASDEYHIARHVANLFVVQTYEGQSDIHALILGRAITGKQAFV

SEQ ID NO: 3411 - protein, 695 aa, Penicillium chrysogenum; identical to SEQ ID NO: 3232

SEQ ID NO: 3412 - protein, 689 aa, Penicillium chrysogenum; identical to SEQ ID NO: 3351

SEQ ID NO: 3413 - protein, 404 aa, Paramecium tetraurelia; identical to SEQ ID NO: 3034

SEQ ID NO: 3414 - protein, 719 aa, Leishmania major; identical to SEQ ID NO: 782

SEQ ID NO: 3415 - protein, 748 aa, Saccharomyces cerevisiae; identical to SEQ ID NO: 976

SEQ ID NO: 3416 - protein, 649 aa, Trichoplax adhaerens; identical to SEQ ID NO: 3358

SEQ ID NO: 3417 - protein, 674 aa, Drosophila willistoni; identical to SEQ ID NO: 3052

SEQ ID NO: 3418 - protein, 677 aa, Drosophila persimilis; identical to SEQ ID NO: 2995

SEQ ID NO: 3419 - protein, 677 aa, Drosophila pseudoobscura; identical to SEQ ID NO: 2803

SEQ ID NO: 3420 - protein, 649 aa, Drosophila simulans; identical to SEQ ID NO: 3051

SEQ ID NO: 3421 - protein, 677 aa, Drosophila simulans; identical to SEQ ID NO: 3050

SEQ ID NO: 3422 - protein, 676 aa, Drosophila willistoni; identical to SEQ ID NO: 3053

SEQ ID NO: 3423 - protein, 695 aa, Drosophila virilis; identical to SEQ ID NO: 3057

SEQ ID NO: 3424 - protein, 697 aa, Drosophila virilis; identical to SEQ ID NO: 3054

SEQ ID NO: 3425 - protein, 676 aa, Drosophila virilis; identical to SEQ ID NO: 3055

SEQ ID NO: 3426 - protein, 677 aa, Drosophila virilis; identical to SEQ ID NO: 3056

SEQ ID NO: 3427 - protein, 695 aa, Drosophila grimshawi; identical to SEQ ID NO: 3067

SEQ ID NO: 3428 - protein, 722 aa, Drosophila grimshawi; identical to SEQ ID NO: 3062

SEQ ID NO: 3429 - protein, 677 aa, Drosophila grimshawi; identical to SEQ ID NO: 3063

SEQ ID NO: 3430 - protein, 676 aa, Drosophila grimshawi; identical to SEQ ID NO: 3064

SEQ ID NO: 3431 - protein, 677 aa, Drosophila erecta; identical to SEQ ID NO: 3069

SEQ ID NO: 3432 - protein, 677 aa, Drosophila erecta; identical to SEQ ID NO: 3068

SEQ ID NO: 3433 - protein, 671 aa, Drosophila ananassae; identical to SEQ ID NO: 3076

SEQ ID NO: 3434 - protein, 677 aa, Drosophila ananassae; identical to SEQ ID NO: 3074

SEQ ID NO: 3435 - protein, 675 aa, Drosophila ananassae; identical to SEQ ID NO: 3075

SEQ ID NO: 3436 - protein, 433 aa, Zea mays
MGSLGGSAGAGDGGKVGLPALDVTLAFPQATPASLFPPAVSDYYQFDDLLTDEEKALRKKVRGIMEKEIAPIMTEYWEKAEFPFHAIPSLASLGLAGGTIKGYGCPGLSLTASAISIAEVARVDASCSTFILVHSSLAMSTIALCGSEAQKQKYLPSLTQFKTIGCWALTEPDYGSDASSLRTAATKVPGGWHLDGQKRWIGNSTFADVLIILARNADTNQLNGFIVKKGAPGLKATKIENKIGLRMVQNGDIILNKVFVPEEDRLTGINSFQDINKVLAMSRIMVAWQPIGISMGVYDICHRYLKERKQFGAPLAAFQLNQEKLVRMLGNIQAMLLVGWRLCKLYESGKMTPGRSSLGKAWTSKKAREVVSLGRELLGGNGILVDFLVAKAFCDVEPIFSYEGTYDINSLVAGREITGIASFKPAVSAKSRL

SEQ ID NO: 3437 - protein, 667 aa, Zea mays; identical to SEQ ID NO: 2842

SEQ ID NO: 3438 - protein, 667 aa, Zea mays; identical to SEQ ID NO: 2842

SEQ ID NO: 3439 - protein, 465 aa, Homo sapiens
MHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 3440 - protein, 432 aa, Homo sapiens [sequence omitted]

SEQ ID NO: 3441 - protein, 696 aa, Tribolium castaneum; identical to SEQ ID NO: 2800

SEQ ID NO: 3442 - protein, 681 aa, Nocardia farcinica; identical to SEQ ID NO: 2229

SEQ ID NO: 3443 - protein, 702 aa, Malassezia globosa
MKTLAEERANPPFDVEAMAVANHGSKERLDYKRKVMSEIERLPAFFNDDFYDLTKDQLRERTFIKIGHIVDWLQNEDMDTFRQRLEVLSVADPGFWTRFGVHLGLFTNCLRSGCTSSQFAYWVRKGMLNCHKFYGCFAMTELTHGSNVQGIQTTATFDPNTDEFIINTPDLNATKWWIGGAAHSATHSAVYARLIISGKDYGVKTFVVQLRDPLSFSNMPGVTIGDIGKKMGRDGIDNGYIQFSNVRVPRAHMLMRHCQVTRDGQVSEPPLQQLAYGALLTGRVMMAIDSSNIGKKAITIAGRYAAVRRQFKSDAKSEVETKLIDYPIHQRRLMPLLAQSIAFQYTGYQLAHMLEETTRALDALEPGDPKLEGVIELLKSTHASSAGLKAFCTWATLSAIEVCRQSLGGHGYSSYTGLAPLYADFAVHCTWEGDNTILALQLGRALVSAYGESQNGKKQGQALAYLNDIDASLNGRCQSQEELNTLAGVEAGWLTASAHFVKVAYDEFQRCIKAGDSRERAAEKCSQLRFVAASVHTSGFIFRQFRAAVESMPDRGDGVKKALTTVALLYGLWQMEEKSGFLLRSGWLKPEQFDFVARRVSELCAEVRAFAIPMIDSFSYTDFVINSPFGRFDGDVYRAYFDMIRRNNPPLKPHPYRDSLVLPLLNRVIPEQDDVAEAMNLDEDIEEIQNDIKEALASQQKN

SEQ ID NO: 3444 - protein, 654 aa, Coccidioides immitis
MRIMPPRNISNKPNETPLSVFLWGGKDKFEARKQLLEALTTNPIFSKRAVTVPSLSRKDAWVRAVHQARELIALKQKEKWSHEQFRQAVVMLDYFLPVQPQFRIFLSNMERQMSDEQKAIWMPKAERLEIFGSYAQTELGHGSNVRGIETTATFDRDADEFVINSPTLSSTKYWIGATGIWATHSLVVARLIIHAKDYGNHLFLIQLRDLDTQELMPGVEIYELGPKAFQGMVGVDNGAMQFHNVRIPRSQMLARNAQVLRDGTYVPPKNTKHSYGSMVTVRAIMVEATGYELLKAVSVAYHYTTFRKQFWRKGQEEETTVFDYASVKYRLLPLLAQGTALVLVGQNIKQAFDEYSKLVINTGDFSQLEDLHLQTVGAKVYSTDITARGVETCRIACGGHGYSALSGFGRMYAHTVNAVTYEGDNYVISQQVPRAILKHYNGRTESTVPSLSYLSFIRNPDAAGILTAASESDWFKLENQQWVLERRLATLVRAHLDATVCGKDTSFTVHELTMAHCDFVYWRGFWDVVRKTVGSEFYGPLEALAHVFSLSILQTAYKDVYSPHSLTEHQRKTLVSAYDQAIETLAEHSKSIIEAYGFTDFEMDSALARPDMDPYEALWQGARQSEMNNFREIWPLIVDARKIWRRLEEEKAKL

SEQ ID NO: 3445 - protein, 693 aa, Coccidioides immitis; identical to SEQ ID NO: 218

SEQ ID NO: 3446 - protein, 695 aa, Aspergillus nidulans; identical to SEQ ID NO: 3024

SEQ ID NO: 3447 - protein, 696 aa, Aspergillus nidulans; identical to SEQ ID NO: 862

SEQ ID NO: 3448 - protein, 619 aa, Aspergillus terreus; identical to SEQ ID NO: 3227

SEQ ID NO: 3449 - protein, 422 aa, Aspergillus terreus; identical to SEQ ID NO: 3226

SEQ ID NO: 3450 - protein, 693 aa, Aspergillus terreus; identical to SEQ ID NO: 3224

SEQ ID NO: 3451 - protein, 692 aa, Aspergillus terreus; identical to SEQ ID NO: 3225

SEQ ID NO: 3452 - protein, 686 aa, Aspergillus terreus; identical to SEQ ID NO: 3223

SEQ ID NO: 3453 - protein, 680 aa, uncultured bacterium
MSLIRLQSFAEGHWFSGDGDGSLLVSAIDASPVAEITARGLDFAGMMRFARAKAGPALRRLTFHERASLLKAVAQALTARKEELYALSALTGATRADSWIDIDGGIGTLFVYASKGKRELPNETFLIDGAVEGLSKNGTFLGQHIYVPREGVAVQINAYNFPVWGMLEKLGPSILAGLPVIAKPASATAWLAEKAARIIIESGILPEGAFQFIAGSTGDLFEHLTSQDHVAFTGSLATSTALQAHPVILKNAVHFTAERDSLNCSILGPDAVPGTPEFDLLIKEVAREMSTKAGQKCTAIRRIIVPAAEADAVANALSKRLSSLAIGDPRVETTRIGPLASLAQRADVRAQIARLQEECEILHGAPDKLDLPGLDTEKGAFLSPVLLAARDSRAAERPHDTEAFGPVATLLTYRDLDEAIGLARKGDGSLAGSLVTADAQIAREVVFGTGAFHGRLLLLNAECAAESTGHGSPMPHLVHGGPGRAGGGEELGGMRAVHHQMQRVALQGSPAFLTAITKSYVKGTPEPAAPAHPFRLPFEDLVPGQSYHSPERVISLGDIEHFAHFTGDTFYAHMDEEAVKGHPFFPGRVAHGYLLLSFAAGLFVEPERGPVLANYGLDNLRFLKPVAPGEAIRVRLTVKSKSPRNTDYGEVRWDVEIRTGAGDIAATYELLTMNAYREAS

SEQ ID NO: 3454 - protein, 735 aa, Sclerotinia sclerotiorum; identical to SEQ ID NO: 2998

SEQ ID NO: 3455 - protein, 698 aa, Botryotinia fuckeliana; identical to SEQ ID NO: 2999

SEQ ID NO: 3456 - protein, 433 aa, Oryza sativa; identical to SEQ ID NO: 2013

SEQ ID NO: 3457 - protein, 667 aa, Unknown; identical to SEQ ID NO: 2144
  Description of Unknown: Acyl-coenzyme A polypeptide

SEQ ID NO: 3458 - protein, 662 aa, Unknown; identical to SEQ ID NO: 2092
  Description of Unknown: Acyl-coenzyme A polypeptide

SEQ ID NO: 3459 - protein, 660 aa, Unknown; identical to SEQ ID NO: 2093
  Description of Unknown: Acyl-coenzyme A polypeptide

SEQ ID NO: 3460 - protein, 679 aa, Unknown; identical to SEQ ID NO: 2931
  Description of Unknown: Acyl-coenzyme A polypeptide

SEQ ID NO: 3461 - protein, 674 aa, Unknown; identical to SEQ ID NO: 2091
  Description of Unknown: Acyl-coenzyme A polypeptide

SEQ ID NO: 3462 - protein, 664 aa, Vitis vinifera
  MOD_RES (41)..(41): Leu or Ile
MEGIDYHEGERSKAEFDVEEMKIVWAGSREVFEVSDRMGRXVASDEAFRKDNRTMLSRKDLFKNTLRKAAHAWKRIIELRLSEQEASWLRFYIDEPAFTDLHWGMFVPAIKGQGTDEQQQKWLPLAYKMQIIGCYAQTELGHGSNVQGLETTATFDSQSDEFVIHSPTLTSSKWWPGGLGKVSTHAVVYARLITDGQDHGVHGFIVQLRSLEDHLPLPGITIGDIGMKFGNGGYNSMDNGVLRFDHVRIPRDQMLMRVFQVTREGKCVQSNVPRQLVYGTMVFVRQTIVSDASSALSRAVCIATRYSVVRRQFGSQNGGPETQVIDYKTQQSRLFPLLASAYAFRFVGQWLKWLYMDVTQRLQANDFSTLPEAHACTAGLKSLTTSATADGIEECRKLCGGHGYLCSSGLPELFAVYVPACTYEGDNIVLLLQVARFLMKTVSQLGSGKQPVGTTAYMGRVADLMQCCCAVQRAEDWLNPSVILEAFEARSARMSVACAQNLSKFANSEEGFAELSADLVEAAVAHCQLIVVSKFIEKLQEDIPGKGVKRQLEILCNIYALYLLHKYVGDFLSTSCITPKQASLANEQLRSLYAQARPNAIALVDAFNYTDHYLSSILGCYDGNVYPKLYDAAWKDPLNASVVPDGYQQYIRPMLKQQLRNARL

SEQ ID NO: 3463 - protein, 2246 aa, Vitis vinifera
  MOD_RES (458)..(458): Any amino acid
  MOD_RES (473)..(473): Any amino acid
MDSRKSIEDQFSKLHPSLPVSTRIGIVGGGPSGLSAAYALAKLGYSNVTVLEKYQTVGGMCESAEIEGNIYDLGGQVLAANSAPVIFHWAKEIGSELEEMDSHKLTLIDSSTGKHKDIKVADDYVSVISLTLELQDKAKDSGRIGVHAVSEIASDLTPEFLEARGFKSVPKSVACGYTASGYGFVQDMPYAYIHEFTRTSMAGKIRRFKGGYMNFWKKLSEMLPIEVRCNTEVLAVRRSSAGVSVDVKNSNGEVEVIEFDEIIISGSFPFKNGKTYRAPPSSSAEPETGVMDMNELEKKLFSKVQTIDYYTTVLKIKGLEHIPVGFYYFEEFMDDPATIGHPVAMQRFYNNTDVFLFWSYGNSVDIKGPTVTELAINTAKNMGGEIEEVVLQRRFKYFPHISSQDMKEGFYEKVESELQGMRNTYYVGGLMAFELTERNASYAVALVCKHFANDTPSXTFPYVKRLFPLQSDXWGGNPKILDEFPGVKFPDIASLDGYLKHWGTHEVIQNKTLYTWINEEGVVVSQRTYRELHANASCIAHNLLLNQKPLFKPGDRVLLVYIPGLDFIDAFFGCLRAKLLPVPVLPPDPLQRGGQALLKIENIAKSCNALAILSTIRYHAGVCAGSVKSLISFTGKNGKNSARWPNLPWLHTDSWIKYSRNLLQEDIADQSEPQPDDLCFLQFTSGSTGDAKGVMITHGGLIHNVKLMRRRYKSTSKTVLVSWLPQYHDMGLIGGLFSALVSGGSAVLFSPMSFIKNPLLWLQTMSKFQATHSAGPNFAFELVVRRLESGKDTVHNYNLSSMIFLMVAAEPVRQNTLKRFVKLTSPFGLCEEVLAPGYGLAENCVFVSCAYGEGKPILVDWQERVCCGYVDTENADVDIRVVDPETGEEQEEVGKEGEIWISSPSAGVGYWGREELSGKTFRNELQNHPGRRYTRTGDLGRIIDGKLFITGRIKDLIIVAGRNIYAADVEKTVESSSELLRPGCCAVIGVPEEILSQKGISLPDHSDQVGLVVIAEVRDGKHVGKDVIEQIQAHVAEEHGVTVASIKLIKPKTISKTTSGKIKRFDCIRQFSDGTLSLVPEPILSKKVLHRSFTTGTCREGNTPRPELNKYPLTNPRLSKEDIVEFLKGLVSEQTGIPIKNIFASESLSSYGIDSIGVVRAAQKLSDFLGVPVGAVDMFTATCIADLANFSENLVRKSHHQYMTTPSYVPEPETDLSELVMEIAPSHKLGIWFFQLLALIYISVLLIIPAYLSVSAFISLLSTCCNLIDGTSWLDYLISLAFAPLAWLLCIFSTCICIAYLGNSFLQPNYALTPEISIWSKDFVKWWGLYKVQEVASKVLAVHLRGTVFLKCWFEMLGARIGSSVLLDTIDITDPSLVSIGDGAVIAEGALIQSHEVKNGILSFLPIRIGQNCSVGPYALIQKGSVLAEGAEVQASQKSEGGTSVFQSNKANNVPKGSVLPKDSRNAQIEAIYHFLGIYMVGFLSSLAAALFYFLYLWLSRSPPSFQHFTFLCISGAFHWFPFTIIAYTTMFSSASLSPPYFAISVAVAYLAHGLILSFLTCTMTRFLARKPDTKQSHMKTWLRHRIMIACHLRFAKLLSGTEALCIYLRLLGAKIGSHCSIRAINPVSEPELISIGAGVHMGDFSRIIPGFYSSSGFTCGQIKVEDNSVVGSQSLVLPGSVLQKDVILGALSVAPMNSVLQRGGVYIGSQTPVMIKNTLHALDQRIEEMDVKYKRIVGNLAANLAVTTMKVKSRYFHRIGVGGKGILKIYDNIKGFPDHKIFQPGKSYPVLIRHSNSLAADDDARIDARGAALRILPDEPGSDSPLLDLTLKTGNAFYARTIADFATWLVCGLAAREEHVKRIPRVRDAVWASLRRADSFAELHYYSNICRLFRFKDGQEMYVKFKLRPYDEKFSEDSGKIEPIGILPPETGAIPRDDTDTRPLLFLAEDFQQRVNSAGGVRYVFQMQFQPVPGDEATCDSALDCTKPWDENEFPHIDVGEIIVDQMLTREESEQLEFNPFLQCHEVDVIRASSSSQSASIDHGRSLIYEICQHLRNREPLPEAWRIFLEQSDFKVDLSGCPMAAALQKKDVQNVTLSRTWYQTLWVIFAQPLLQTVLPYFIMGLVVFAPLNWVFYWKNTKKLPLHWLMGSNIELNEGAYVDSMGAVLNPEMVEIERGGCVGREALLFGHIYEGEGGKVKFGKISIGEGGFVGSRAVVMPGVRVETGGSLSDLSLAMKGEIVKPR

SEQ ID NO: 3464 - protein, 682 aa, Physcomitrella patens; identical to SEQ ID NO: 3367

SEQ ID NO: 3465 - protein, 483 aa, Physcomitrella patens; identical to SEQ ID NO: 3366

SEQ ID NO: 3466 - protein, 667 aa, Physcomitrella patens; identical to SEQ ID NO: 3365

SEQ ID NO: 3467 - protein, 691 aa, Physcomitrella patens; identical to SEQ ID NO: 3364

SEQ ID NO: 3468 - protein, 830 aa, Kordia algicida; identical to SEQ ID NO: 3102

SEQ ID NO: 3469 - protein, 677 aa, Hoeflea phototrophica; identical to SEQ ID NO: 3101

SEQ ID NO: 3470 - protein, 676 aa, Phaeobacter gallaeciensis; identical to SEQ ID NO: 3104

SEQ ID NO: 3471 - protein, 674 aa, Oceanibulbus indolifex; identical to SEQ ID NO: 3103

SEQ ID NO: 3472 - protein, 702 aa, Malassezia globosa; identical to SEQ ID NO: 3443

SEQ ID NO: 3473 - protein, 662 aa, Nematostella vectensis; identical to SEQ ID NO: 3348

SEQ ID NO: 3474 - protein, 661 aa, Nematostella vectensis; identical to SEQ ID NO: 3349

SEQ ID NO: 3475 - protein, 846 aa, unidentified eubacterium; identical to SEQ ID NO: 3095

SEQ ID NO: 3476 - protein, 698 aa, Corynebacterium glutamicum; identical to SEQ ID NO: 2275

SEQ ID NO: 3477 - protein, 676 aa, Rhodobacterales bacterium; identical to SEQ ID NO: 3107

SEQ ID NO: 3478 - protein, 682 aa, Stappia aggregata; identical to SEQ ID NO: 2912

SEQ ID NO: 3479 - protein, 1119 aa, Strongylocentrotus purpuratus
MATTTKKKTSSLWYGADPLLFISNTMIGITLSLIPLCSNLPLLLADLAFMGFFMGIIDTTANVSLLKIYGKLVSPFLQALHFCYGLGAVISPLLAEPFLLNTDCTLLVTNGTASSSDDAASVTAEAVTLSSLEDAQSQTNVKYAFWIMAAFQIPIVSLVLALNIRRYCCSPPSDKSFITVLNRSNYVDLDADQDIAKPESPKKNHTRCLQTDRSKIVVFTVLISFLLIIYDGLQAAYGGYIFEYAVKNIAINLSATDGAYLTSVYWGSFALGRLISIPISTFCSLSVMLMVNLIGCFVALCLELLVRDSLVVLYVGSGIFGLFLSSIYPSSIAYAEQHIRMSGLVTSCIVIGAATGEMTFPVIVGRLIFPIQPLFFLAFCAGACCLGILVFIALQIVSYCTAEKAKPIPLAEGAYMWCRSCCLASRESLLFGDSKYYTTLTDTNSAYKVIATKEQFPLPKVERVPAAACAYPSGSVAGSGRPRLVAYLLGVVCYCEHESIIASDPHFDQTGRCTLSPAEAYDLSIKRSVRWVAIQEKYNLYQPDDGAVVGRCMNQDVGLFIHQLMFIPTIERLGTEEQKAKWLPIARQYKIIGTYAQTELGHGTNLNGLETTATYDEKAQEFVLNAPTLTAMKWWPGGLAKSCTHVILIAQLIVGGKKHGPHCFIVQVRSLETHQPLPGVTLGDIGRKSSFDAIGNGFLIVDHVRIPRLNMLMKYAEVTHDGVYNRRGNPKLTYGSMILVRTKIVEAASYEIGKAVTVATRYSVIRRQGSIDKNGPEVPILDYQTQQHKLFPGIAATYAFKFVSLRLKTLYLKNEANLQKLNFTLLPELHALASGLKALTTREATLHIETCRFACGGHGVMLQSGLPDMYNKFSAACTYEGENTVLLLQVAGYLMKTLSKAQAGETIQGLGAYLTEEPQSSWSCDQADQSLNAQLIIDAYKHRAQWLTRKAGEQLAQKMGQGLSQQQAWNKSSIDLVKASHAHTQYFIVKAFFDGVQHVEVSQDTAAILNTLSFLYAIYHIEQNSGEFIADGYMSNEQLSWLHNHYLDLLAVIRPNAVALVDAIDIRDEFLQSTLGSYDGNVYQRMYDYAKTSPRNRTEVHETYYKYIRPLLKGMIAKL

SEQ ID NO: 3480 - protein, 1106 aa, Strongylocentrotus purpuratus
YGADPLLFISNTMIGITLSLIPLCSNLPLLLADLAFMGFFMGIIDTTANVSLLKIYGKLVSPFLQALHFCYGLGAVISPLLAEPFLLNTDCTLLVTNGTASSSDDAASVTAEAVTLSSLEDAQSQTNVKYAFWIMAAFQIPIVSLVLALNIRRYCCSPPSDKSFITVLNRSNYVDLDADQDIAKPESPKKNHTRCLQTDRSKIVVFTVLISFLLIIYDGLQAAYGGYIFEYAVKNIAINLSATDGAYLTSVYWGSFALGRLISIPISTFCSLSVMLMVNLIGCFVALCLELLVRDSLVVLYVGSGIFGLFLSSIYPSSIAYAEQHIRMSGLVTSCIVIGAATGEMTFPVIVGRLIFPIQPLFFLAFCAGACCLGILVFIALQIVSYCTAEKAKPIPLAEGAYMWCRSCCLASRESLLFGDSKYYTTLTDTNSAYKVIATKEQFPLPKVERVPAAACAYPSGSVAGSGRPRLVAYLLGVVCYCEHESIIASDPHFDQTGRCTLSPAEAYDLSIKRSVRWVAIQEKYNLYQPDDGAVVGRCMNQDVGLFIHQLMFIPTIERLGTEEQKAKWLPIARQYKIIGTYAQTELGHGTNLNGLETTATYDEKAQEFVLNAPTLTAMKWWPGGLAKSCTHVILIAQLIVGGKKHGPHCFIVQVRSLETHQPLPGVTLGDIGRKSSFDAIGNGFLIVDHVRIPRLNMLMKYAEVTHDGVYNRRGNPKLTYGSMILVRTKIVEAASYEIGKAVTVATRYSVIRRQGSIDKNGPEVPILDYQTQQHKLFPGIAATYAFKFVSLRLKTLYLKNEANLQKLNFTLLPELHALASGLKALTTREATLHIETCRFACGGHGVMLQSGLPDMYNKFSAACTYEGENTVLLLQVAGYLMKTLSKAQAGETIQGLGAYLTEEPQSSWSCDQADQSLNAQLIIDAYKHRAQWLTRKAGEQLAQKMGQGLSQQQAWNKSSIDLVKASHAHTQYFIVKAFFDGVQHVEVSQDTAAILNTLSFLYAIYHIEQNSGEFIADGYMSNEQLSWLHNHYLDLLAVIRPNAVALVDAIDIRDEFLQSTLGSYDGNVYQRMYDYAKTSPRNRTEVHETYYKYIRPLLKGMIAKL

SEQ ID NO: 3481 - protein, 718 aa, Ustilago maydis
MSSWTDDLTMDTMAKERANPPFDVRKMSIEHHGSESDLIKKEKFMLEASRDPVFYSGDIYDLTKEQIRERTMQRIQRLAHYVTSESVDDFQKRMELMSLLDPGLWTRLGVHYGLFLGAIRSAATPNQFSYWMEKGVVSCQGMFGCFGMTELAHGSNVAGLETTAHFDGQTDEFIIHTPNLGATKWWIGGAAQTATHCSVFAQLIVKGKRYGTKTFIVPLRDPKSFQLLPGINIGDIGKKMGRDGIDNGYIQFTNVRIPRAYMLMKHTQVTRDGEVREPPLQQLTYGALLQGRTAMVADAANTAKKALTVSVRYAAARRQFKSDAKAELETQIIDYPIHQRRLMPLVAQAVAFGYTALELQRLFNETSQALEALEPGDPNLDATIEKLKETHSTSAGLKAFCTWATLETIDRSRQACGGHGYSSYNGFANMYSDFAVHCTWEGDNTILALQAGRFLISAFQDALDGKKQVSQGTKYMNDLNKVLSAKCESNDALDTLDGIDRGWATVAAHAVKKATEDYRACLKAGRSKEQAFEDCSQVRFVAASIHTSGYIFRQFRAAVERVEKSDDGVREHLELLAKFYGLWQMEEKAAFFLRSGWLTPEQLDYASAKVTEYCAKTRSFAIPLIDSFAISDHVLNSPIGRYDGDIYREYFRMVRRNNPQLKEHPYFERLIRPFIERQLPEVEDFDEAIGIDDEIEEIKQDREEAEAEAKAQAAGKKE

SEQ ID NO: 3482 - protein, 688 aa, Ustilago maydis
MAPPRYIELPAGLKPAGTPGSELLAYERSKASFDPKALAEYIHGKEFLELQENIVEILSSDPVFDKTSDYYYGRADKFRRAMLKDKRLAQLAAEHGWGQKENAMAEKLADLPGPMGLHKSMFLTTLYNQGSDEQRKAFYEPASKYEIIGCYAQTELGHGSNVQGIETTATWIPESQEWEIHSPTLTASKWWIGGLGRSADHAVVMAQLIIKNKSYGPHPFVVPIRDIKTREMLPGRTIGDIGPKAGYNTTDNGFMLFEHVRIPHFNLLARFSKVEPETGKYLPPPNAKLAYGTLTWVRANIVREASTVLMRAVTIAIRYCAVRRQFADRDAPKFGHDGKPLETQVLDYTMVQIRLFPILAQAFAFHYTSRFMFDLYEQNQANIESGDLSLLADTHASSSGLKSLTTLYASDAIEVCRKACGGHGYSMASGLPDFYANYLPNATWEGDSYMLSQQCTRYLFKTMRGIKSGRGKVDKNITTDYMKRYLENKEEKANIQYSGDLYDPLFFMRAFGHRAAYLTEQTLALRDDAKRSWNSLLVELYRCSKAHSQYLLARNFGMAILKDDKLNSQPALRQIVQKIFLLWACHTMEQESADFLASGYINGQQFHLLGSKVQEIMTELRPNAVAIVDAFAVPDYLLNSALGRSDGNVYEALFDFALREPLNSAKWNVDIHDLETTDFDSDLPRAKL

SEQ ID NO: 3483 - protein, 718 aa, Ustilago maydis
MASTRPAPETLQPQDIQQERTACSFDVDTMSCILPGSKAERDNARWLLSLLKSDADRTFDKEDRVFQSRNERFFNGQKIALRYFEIRNRHGLDKKDADLLRLYTDEYLPIQVAESMAQPTLMRQASAEQWSEWGPMVRSGRWIGCYMQTELAHGSNLSALRTTATLDIDTDEWVIHTPEPSAGKVWIGGSGLTATYGIVMANLIIKRKSYGMHPFLVHLRSLQDHTLLPGRHIMEMGCKLGAPAMDNGYICFDNVRIPRTHLLQRFQTVSKDGMYEKRNAAAQVMTRGTMTLVRVGLCEIAAHHLARAATIAIRYAVVRRQGTSATKPDQLEPKILDYASVQTRVLTALASAYAITFAGQHLRRLYNEMIAEIDKTGNSGLLPIVHGYSSVLKAVCTNESLAGIERCRRSMGGHGFSQASGFDFERNQPNAGLIYEGENSMLLAGPSAQFLIKQLHETRKGKGKAIRPELAYLEWISGASGAVEDISKRMQTITAEQFEKPRVLLDLLGCRAALLVDRLAQHRSESHSREDGVYEHIDTNLAVRASTAHGVYLLAYAFHDLVEQLMSSDATSTKVRFGVSVQHTHVAALDNLLRFYLLQNCLLSQDALGDLLELGLLSGAQLDKLRRSAARLLSGPIRRDALGLVESFDMDDWYLCSPLGSSDGRAYERMIEWMKLEPLNHTGERGARDEKGVVKGYTDGIGRLIRGEAVPFTERARL

SEQ ID NO: 3484 - protein, 743 aa, Ustilago maydis
MSNSDPKATTFQPLNEPVGGWPAAKVTLPIPMGEVAARTSQDIAKARAAAEFNPERIEDTLRDARIDNDSRKKVMTILSEDPIFGNWKKRMIHMNREQQMRQSHFACRRLLELGDKHGWTTHEIIEAALTLDLQSPITIHWVAFVPVIFGQGSAEQIERWGQKAMNHEIMGCYMQTELGHGTNVQQLETTCTYDEASDNFILHSPTLTSTKWWAGGLGTTATHGVVQAQLIIKGKRYGPHLFFTQLRDMDSGKLLDGIVAGDIGPKTYGAFGGLDNGWARFNHFKIPRDHMLSKHASVKKGGEYVKPPSDKLSYGGMIFIRSQMIDRTGWMLSRGVTIATRYAWVRRQFRDPSSKDINDAERSVLSYPSTARRLLPLLAKAYAYILAGRRMRTLYEDMAQQLDEGNTELLADVHVASSSLKAYCTKQALDGIEECRQALGGHGFSAYAGFTSVFPEQAPAVTYEGDNIVLASQVGRAMLKISGELDSNANTKVAATSGFLKAISQKGAIAFTQPQSASDWYKPEVYSAALGLRAAQLVVDLRAEIKSGRPFVDLSFECIEVAKSHAEFVVDLWFGEGIRDDAERLGEKECKWLQKLVTLHALSALSRNITPLVLPASAGRNLAGYATNQAILTPESVILLEKAIRDLVSEILPQVIGLSDGFGWLDWELGSSLGRKDGRVYEQLMADAEANPLNHPGAVPGLDSIDKVGVYKYGSNNIGKGVPDWYSTEIGPMLKAAAERSNL

SEQ ID NO: 3485 - protein, 836 aa, Psychroflexus torquis; identical to SEQ ID NO: 2921

SEQ ID NO: 3486 - protein, 633 aa, Cricetulus griseus
MAMRELVEGECGGANPLMKLATHFTQDKALRQEGLRPGPWPPGASAAETVSKPLGVGSEDELVAEFLQDQNAPLVSRAPQTFKMDDLLAEMQEIEQSNFRQAPQRAPGVADLALSENWAQEFLAAGDAVDVAQDYNETDWSQEFIAEVTDPLSVSPARWAEEYLEQSEEKLWLGEPEGSSTTDRWYDDYHPEEDLQHTASDFVSKVDDPKLANSEIGEGQVSLESAAGSGRAQAEQWAAEFIQQQGTSEAWVDQFTRSGNTSALDVEFERAKSAIESDVDFWDKLQAELEEMAKRDAEAHPWLSDYDDLTSASYDKGYQFEEENPLRDHPQAFEEGLRRLEEGDLPNAVLLFEAAVQQDPKHMEAWQYLGTTQAENEQELLAISALRRCLELKPDNRTALMALAVSFTNESLQRQACETLRDWLRYSPAYAHLVTPGEEGASGAGLGPSKRVLGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSALLAMFGLPQ

SEQ ID NO: 3487 - protein, 698 aa, Corynebacterium glutamicum; identical to SEQ ID NO: 2275

SEQ ID NO: 3488 - protein, 695 aa, Aspergillus nidulans; identical to SEQ ID NO: 3024

SEQ ID NO: 3489 - protein, 696 aa, Aspergillus nidulans; identical to SEQ ID NO: 862

SEQ ID NO: 3490 - protein, 718 aa, Ustilago maydis; identical to SEQ ID NO: 3481

SEQ ID NO: 3491 - protein, 688 aa, Ustilago maydis; identical to SEQ ID NO: 3482

SEQ ID NO: 3492 - protein, 718 aa, Ustilago maydis; identical to SEQ ID NO: 3483

SEQ ID NO: 3493 - protein, 743 aa, Ustilago maydis; identical to SEQ ID NO: 3484

SEQ ID NO: 3494 - protein, 664 aa, Unknown; identical to SEQ ID NO: 93
  Description of Unknown: Acyl-coenzyme A polypeptide

SEQ ID NO: 3495 - protein, 665 aa, Unknown; identical to SEQ ID NO: 92
  Description of Unknown: Acyl-coenzyme A polypeptide

SEQ ID NO: 3496 - protein, 664 aa, Unknown; identical to SEQ ID NO: 146
  Description of Unknown: Acyl-coenzyme A polypeptide

SEQ ID NO: 3497 - protein, 515 aa, Saccharomyces cerevisiae
MSKLGQEKNEVNYSDVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKFYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAEAKHASELSSNSKF

SEQ ID NO: 3498 - protein, 419 aa, Drosophila melanogaster
MIAQSVISKLRPCARRLASTSSKAAAPKFNWQDPLNLESQLTEEEVAIRDAFRGYCQAELQPRVKMANRLETFDKKIMEEIGSLGVLGCTIKGYGCAGVSSVAYGLLTREVERVDSAYRSAVSVQSSLAMGAIYDFGSEEQKQRYLPSMAEGKLIGAFGLTEPNHGSDPAGMETRAKYDSKSKTYILNGSKTWITSAPIADVIVVWAKCEDGKVRGFLVDRKISGKGLETPKIEGKFSLRASPTGMILMDEVRVPEEQLLPNVAGFSGPFSCLNNARYGIAWGALGAAETCVEIARQYTLDRKQFGRPLAANQLIQKKLADAITEIALGLQACLHVGRLKDQKLHTPDMISLLKRNNTGKSLDIARQMRDMLGANGISDEYHVIRHVINLESVNTYEGTHDIHALILGRAITGLAAFAN

SEQ ID NO: 3499 - protein, 438 aa, Macaca mulatta
MALRGVSVQLLSRVPGLRVFRTWVSSAAQTEKGGRTQSQLAKSSRPEFDWRDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPRLAKGELLGCFGLTEPNSGSDPSSMETRARYNSSNKSYTLNGTKTWITNSPMADLFVVWARCEDGRIRGFLLEKGMRGLSAPRIQGKFSLRASATGMIIMDGVEVPEENMLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 3500 - protein, 507 aa, Mus musculus
MGFFLFSPTRYLDGISGFFQWAFLLSLFLVLFKAVQFYLRRQWLLKTLQHFPCMPSHWLWGHHLKDKELQQILIWVEKFPSACLQCLSGSNIRVLLYDPDYVKVVLGRSDPKASGIYQFFAPWIGYGLLLLNGKKWFQHRRMLTPAFHYDILKPYVKIMADSVNIMLDKWEKLDGQDHPLEIFHCVSLMTLDTVMKCAFSYQGSVQLDENSKLYTKAVEDLNNLTFFRLRNAFYKYNIIYNMSSDGRLSHHACQIAHEHTDGVIKMRKSQLQNEEELQKARKKRHLDFLDILLFARMEDRNSLSDEDLRAEVDTFMFEGHDTTASGISWIFYALATHPEHQQRCREEVQSILGDGTSVTWDHLGQMPYTTMCIKEALRLYPPVISVSRELSSPVTFPDGRSIPKGITATISIYGLHHNPRFWPNPKVFDPSRFAPDSSHHSHAYLPFSGGSRNCIGKQFAMNELKVAVALTLLRFELLPDPTRIPVPIARLVLKSKNGIHLCLKKLR

SEQ ID NO: 3501 - protein, 441 aa, Canis lupus
MEQPPGEAAEVREEEEKKEVAEAEGAPELNGGPERSLPSSSYTDLSRSSSPPSLLDQLQMGGDGASCGSLNMECRVCGDKASGFHYGVHACEGCKGFFRRTIRMKLEYEKCERICKIQKKNRNKCQYCRFQKCVALGMSHNAIRFGRMPEAEKRKLVAGLTANEGTQHNPQVADLKAFSKHIYNAYLKNFNMTKKKARGILTGKASHTAPFVIHDIETLWQAEKGLVWKQLVNGLPPYKEISVHVFYRCQCTTVETVRELTEFAKSIPSFSNLFLNDQVTLLKYGVHEAIFAMLASIVNKDGLLVANGTGFVTREFLRSLRKPFSDIIEPKFEFAVKFNALELDDSDLALFIAAIILCGDRPGLINVPQVEAIQDTILRALEFHLQANHPYAQYLFPKLLQKMADLRQLVTEHAQMMQRIKKTETETSLHPLLQEIYKDMY

SEQ ID NO: 3502 - protein, 505 aa, Canis lupus
MGETLGDSLIDPESDSFADTLSASTSQETTMVDTEMPFWPTNFGISSVDLSVMDDHSHSFDIKPFTTVDFSSISTPHYEDIPFSRADPMVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 3503 - protein, 505 aa, Mus musculus
MGETLGDSPVDPEHGAFADALPMSTSQEITMVDTEMPFWPTNFGISSVDLSVMEDHSHSFDIKPFTTVDFSSISAPHYEDIPFTRADPMVADYKYDLKLQEYQSAIKVEPASPPYYSEKTQLYNRPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKNIPGFINLDLNDQVTLLKYGVHEIIYTMLASLMNKDGVLISEGQGFMTREFLKNLRKPFGDFMEPKFEFAVKFNALELDDSDLAIFIAVIILSGDRPGLLNVKPIEDIQDNLLQALELQLKLNHPESSQLFAKVLQKMTDLRQIVTEHVQLLHVIKKTETDMSLHPLLQEIYKDLY

SEQ ID NO: 3504 - protein, 505 aa, Homo sapiens
MGETLGDSPIDPESDSFTDTLSANISQEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 3505 - protein, 475 aa, Cricetulus griseus
MVDTEMPFWPTNFGISSVDLSMMDDHSHSFDIKPFTTVDFSSISAPHYEDIPFTRADPMVADYKYDLKLQEYQSAIKVEPASPPYYSEKAQLYNRPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKNIPGFINLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKVLQKMTDLRQIVTEHVQLLHVIKKTETDMSLHPLLQEIYKDLY

SEQ ID NO: 3506 - protein, 505 aa, Bos taurus
MGETLGDALIDPESEPFAVTVSARTSQEITMVDTEMPFWPTNFGISSVDLSMMDDHSHAFDIKPFTTVDFSSISTPHYEDIPFPRADPMVADYKYDLKLQEYQSAIKVEPVSPPYYSEKTQLYSKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHISPLQEPSKEVAIRIFQGCQFRSVEAVQEITEYAKNIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 3507 - protein, 505 aa, Macaca mulatta
MGETLGDSPIDPESDSFTDTLSANISQEITMVDTEMPFWPTNFGISSVDLSVMDDHSHSFDIKPFTTVDFSSISAPHYEDIPFTRTDPMVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 3508 - protein, 505 aa, Rattus norvegicus [sequence omitted]

SEQ ID NO: 3509 - protein, 504 aa, Sus scrofa
MGETLGDSLIDPESDAFDTLSANISQEVTMVDTEMPFWPTNFGISSVDLSVMDDHSHSFDIKPFTTVDFSSISTPHYEDIPFPRADPMVADYKYDLKLQDYQSAIKVEPVSPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKNIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 3510 - protein, 475 aa, Oryctolagus cuniculus
MVDTEMPFWPTNFGIGSVDLSVMDDHSHSFDIKPFTTVDFSSISAPHYEDLPFARADPMVADYKYDLKLQEYQSAIKVEPASPPYYSEKTQLYNKTHEEPSNSLMAIECRVCSDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKNIPGFVSLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPEASQLFAKLLQKMTDLRQIVTEHVQLLQVIKKTETDMSLHPLLQEIYKDLY

SEQ ID NO: 3511 - protein, 477 aa, Xenopus laevis
MVDTEMPFWSNLNFGMNSMDMSALEDHCQPYDIKPFTTVDFSSINSHYDDILDEKTFLCRNDQSPIDYKYDLKLQECQSSIKLEPPSPPYFSDKPQCSKAFEDTPNSFIAIECRVCGDKASGFHYGVHACEGCKGFFRRTIRLKLIYERCDLNCRIHKKSRNKCQFCRFQKCLAVGMSHNAIRFGRMPQAEKEKLLAEISSDIDQLNPESADQRVLAKHLYDSYVKSFPLTKAKAPGHPDGQSHRQNSRGYTRHELADDGGGSDQGAVREPRAEQGGGDSNLPALSVALRGGVREITEFAKNIPGFVSLDLNDQVTLLKYGVHEIIFTMLASLMNKDGVLVAEGQGFMTREFLKSLRKPFSDFMEPKFEFAIRFNSLELDDSDLAIFVAVIILSGDRPGLLNVKPIEDIQDSLLQALELQLKLNHPDSAQLFAKLLQKMTDLRQVVTEHVQLLQLIKKTEADMCLHPLLQEIYKDLY

SEQ ID NO: 3512 - protein, 440 aa, Mus musculus
MEQPQEETPEAREEEKEEVAMGDGAPELNGGPEHTLPSSSCADLSQNSSPSSLLDQLQMGCDGASGGSLNMECRVCGDKASGFHYGVHACEGCKGFFRRTIRMKLEYEKCDRICKIQKKNRNKCQYCRFQKCLALGMSHNAIRFGRMPEAEKRKLVAGLTASEGCQHNPQLADLKAFSKHIYNAYLKNFNMTKKKARSILTGKSSHNAPFVIHDIETLWQAEKGLVWKQLVNGLPPYNEISVHVFYRCQSTTVETVRELTEFAKNIPNFSSLFLNDQVTLLKYGVHEAIFAMLASIVNKDGLLVANGSGFVTHEFLRSLRKPFSDIIEPKFEFAVKFNALELDDSDLALFIAAIILCGDRPGLMNVPQVEAIQDTILRALEFHLQVNHPDSQYLFPKLLQKMADLRQLVTEHAQMMQWLKKTESETLLHPLLQEIYKDMY

SEQ ID NO: 3513 - protein, 441 aa, Homo sapiens
MEQPQEEAPEVREEEEKEEVAEAEGAPELNGGPQHALPSSSYTDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 3514 - protein, 419 aa, Drosophila melanogaster; identical to SEQ ID NO: 3498

SEQ ID NO: 3515 - protein, 436 aa, Macaca mulatta
LRGVSVQLLSRVPGLRVFRTWVSSAAQTEKGGRTQSQLAKSSRPEFDWRDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPRLAKGELLGCFGLTEPNSGSDPSSMETRARYNSSNKSYTLNGTKTWITNSPMADLFVVWAWCEDGCIRGFLLEKGMRGLSAPRIQGKFSLRASATGMIIMDGVEVPEENMLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 3516 - protein, 409 aa, Cyanothece sp.
MELSTIWTIALPPITGAIIGYFTNDIAIKMLFRPYKPILIFKRRVPFTPGLIPRNQERLAQRVSDTIMGSLLTPDEIQNLARRLLKTERVQAAILWLLQLFLKQIRADKEQKTAKILADILRDLFGQSLPRLLKVLARREDFLEDQINHIFEQILLEFKLTDAQARQLADWLIDSVIPPDILRQALIDFLTDRNIQVIDEGFREKTSGTYWVVANIFGLRNTLTRLRTFCLDEKETANTRLKELLLSLEMRNRLRDWLKSLSLQNLPISTVRQLRKTTRDTVRLYIQESGSEFLQEFGQSIDWEKLSIVIVNRLQSSTTFTGSLDLISQELALILERYLEEDLEKIVSEAIPILSIDQIIVEKIVATSPEELETATEGIVKSELQAIVNLGGILGFLVGIIQTIILLVR

SEQ ID NO: 3517 - protein, 404 aa, Rhodospirillum centenum
MADVPETGLPQKTPKGSPFRWEDPLRLDDQLSEEERMVRDSARAYCQDRLMGRVLEAFRHEHFHREIMAEMGELGLLGVTIDGYGCAGLNHVCYGLVAREVERVDSGYRSAMSVQSSLVMHPIHAYGSEEQRQRWLPGLASGTLVGCFGLTEPDAGSDPGSMKTRARKVAGGWTLSGSKTWITNSPIADIFVVWAKDEAGDIRGWVLEKGMAGLSAPKIEGKFSLRASVTGMIMMDEVFVPEENLLPGAKGLSGPFGCLNKARYGIAWGAMGAAEFCWHAARQYTLDRQMFGRPLAATQLIQKKLADMQTEIALGLQGALALGRMLDAGTWAPEAISLMKRNNCGKALDIARVARDMHGGNGIADEYHVIRHVLNLEAVNTYEGTHDVHALILGRAQTGLQAFG

SEQ ID NO: 3518 - protein, 511 aa, Kluyveromyces lactis
MGHPTNTADVRKDRVVTNSQGAPINEPFATQRVGQHGPLLLQDFNLLDSLAHFNRERIPERNPHAHGSGAFGYLEITDDITDVCGSAMFDTVGKRTRCLVRFSTVGGEKGSADTARDPRGFAIKFYSEEGNVDWVNNNTPVFFIRDPSKFPHFIHTQKRNPETNMKDADMFWDFLTTEENQVAIHQVMILFSDRGTPASYRNMNSYSGHTYKWSNKQGEWRYVQVHLKTDQGIKNLNNEEATKLAGENPDYCQKDLFENIAKGNYPSWTLYIQTMTEEEAEKLPFSVFDLTKVWPHKQFPLRRVGKMVLNENPENYFAQVEQAAFSPSHTVPYQEASADPVLQARLFSYPDAHRYRLGPNYSQIPVNCPYASKVFNPAIRDGPMNVNGNLGKEPNYLSTSKKYQFIQQSKPIQQHQEVWSGPAMPVHWATSPGDIDFVQARDLYNKVLSKQPGQQKALAHNVAVHVASACPEIQDRVFAMFARVDRGLSENIKKEALSLSPRKAAALNAKL

SEQ ID NO: 3519 - protein, 408 aa, Acidiphilium multivorum; identical to SEQ ID NO: 2130

SEQ ID NO: 3520 - protein, 438 aa, Bos taurus; identical to SEQ ID NO: 1919

SEQ ID NO: 3521 - protein, 438 aa, Mus musculus; identical to SEQ ID NO: 1833

SEQ ID NO: 3522 - protein, 438 aa, Homo sapiens; identical to SEQ ID NO: 1362

SEQ ID NO: 3523 - protein, 511 aa, Lachancea thermotolerans
MGNDNPTNASNVRSDRVVTNSQGNPINEPFATQRVGQYGPLLLQDFTLLDSLAHFNRERIPERNPHAHGSGAFGYFEVTDDITDVCGSAMFNEIGKKTRCMVRFSTVGGEKGSADTARDPRGFATKFYTEEGNLDWVYNNTPVFFIRDPAKFPHFIHTQKRNPETNLKDANMFWDFLTTPENQVAIHQVMILFSDRGTPATYRNMNGYSGHTYKWSNKKGEWFYVQVHIKTDQGIKNLNNEEAVKIAGENPDYCGQDLFKNIKEGNFPTWTVYIQTMTEAEAQKLPFSVFDLTKVWSHKQFPLRRIGKMVLNENPKNYFAQVEQVAFSPSHTVPYQEASADPVLQSRLFAYPDAHRHRLGANYHQIPVNCPYASRVFNPSIRDGPMNVDGNLGSEPNYLSTAKSYNYTQASKPIQQHQEVWNGPALPFHWATSPGDADFVQARGLYNVLARTPGQQQALAHNVAVHVANACPEIQERVFAMFSRVDKTLGQSIKREALSISPRSSSQQAKL

SEQ ID NO: 3524 - protein, 485 aa, Debaryomyces hansenii
MAPVYTNSNGCPIPEPFATQRVGQHGPLLLQDFNLIDSLAHFDRERIPERVVHAKGSGAYGYFEVTDDISDVCSAAFLDTIGKKTKVLTRFSTVGGESGSADSARDPRGFSTKLYTEEGNLDLVYNNTPVFFIRDPSKFPHFIHTQKRNPETHLKDPTMFWDYLTSNQESIHQVMTLFSDRGTPASYREMNGYSGHTYKWSNKKGEWYYVQVHFISDQGVKTLTNEEAGELAGSNPDFAQEDLFKEIAKGNAPSWTCYIQTMTQEQAKKAPFSVFDLTKVWPHKDYPMRRFGKLVLNENPKNYFAEIEQAAFAPAHTVPYMEASADPVLQSRLFSYADTHRHRLGTNYTQIPVNCPITGRVFNPHMRDGGMNVNGNLGSHPNYLATSKPVEFKNFSIQEEQEVWEGAACPFHWKCTDKDYSQATALYNVLAKYPNQQKNLAHNVAVHVSGAETHIQDKVFDMFAKVHPELSANIKKEALQLSPRK

SEQ ID NO: 3525 - protein, 485 aa, Millerozyma farinosa
MAPVYTNSNGCPIPEPFATQRIGKHGPLLLQDFNLIDSLAHFDRERIPERVVHAKGSGAYGYFEVTDDITDVCGAAFLDTIGKRTKVFTRFSTVGGESGSPDAARDPRGFATKFYTEEGNLDLVYNNTPVFFIRDPSKFPHFIHTQKRNPETHLKDANMFWDYLTSNPESAHQVTILFSDRGTPASYREMNGYSGHTYKWSNKKGEWFYVQVHFISDQGIKTLNNEEAGAMSGANPDHAQEDLFKEIAKGNAPSWTCYVQTMTAEQAKKAPFSVFDLTKVWPHADYPMRRFGKLVLNENPKNYFAEVEQAAFSPAHTVPHMEPSADPVLQSRLFSYADTHRHRLGTNYTQIPVNCPVTGRVFNPHMRDGGMNVNGNLGAHPNYLATSHPLEFKQFSLQEDQEVWEGSACPFHWKATDDEFKQPGALYKVLAKYPNQQKNLAHNVAVHVSAADPHIQDRVFEYFSKVDPELGSNIKKETLQLSPRN

SEQ ID NO: 3526 - protein, 485 aa, Millerozyma farinosa; identical to SEQ ID NO: 3525

SEQ ID NO: 3527 - protein, 404 aa, Rhodospirillum centenum; identical to SEQ ID NO: 3517

SEQ ID NO: 3528 - protein, 871 aa, Pelotomaculum thermopropionicum
MKNKIYHRVFFLLVLTLSLLAAVGGRAMAQEGEAGALPRQDSVQVAASAAPSGPAAGTGFSVKLNGRPVVFDVSPRLEEGRFLLPMRPVLEAMRAKVSWSGETGTAVACLPGTTLAVTAGTQYARINGREYPMPVAAEIDRGRLVVPAEIILQATGAQEQWDGAARVLSLFLKDPGAGFPAPVLELQRDVQNELDRMDRDLAAAAGELARTGLDGEEARRILSGLAARYPYVADASTVDKNGKIAAVEPAAYHEFAGSDISGQEQVERLRETGRPVISSVFTAVEGFPALDLERPVFNRQNELTGSVSLLIRPELLFASFAVPELQGQRPEMMAVQKDGYIVYDSDSSQIGRNVFTDPFYQDYTGLPALTRRTVADRAGVGTYAPPDQPSQKQVVKRSVWTTLGLHGTEWRLVVNYAADGDSRAAGNKEEGKMEKKSDSNKTAPALEISPLQALAGEPWKIRVSGLTPGAPVTLVAEQQDNKGIKWESHAVFHADQSGVVDPAVQAPVSGSYEGADPAGLFWSLRPVAGVKPAGTFAKSLEPQMITVSVEVEGERILAQEVERLYLLPGVKRVEVRESGVVGTLFLPAGEGRRPAIIVLGGSDGGTYEPAAAIYASHGYVTLALAYFGMEGLPDSLVNIPLETVGKAIEWLESRPEVDKDAIGVWGASKGAELALLAASHYPQIKAVVAKSPSAVVFEGISKDSGKNHQSSWTYKGEPLSFVPTIFTEELAGSYFAAVAKKEPWSTAPLYEYALQNQEAVEKATIKVENINGPVLLVSGGRDGAWPSGKMAEMIMQRLREKGHPFPDMHLHYRDAGHQISTPYSPTTVYWLTLPGGFIEDLGGTPEGNAAASMDSWPKIIDFFARHLGGKQ

SEQ ID NO: 3529 - protein, 409 aa, Cyanothece sp.; identical to SEQ ID NO: 3516

SEQ ID NO: 3530 - protein, 418 aa, Drosophila pseudoobscura
MIAQSVIGKLINPCARRLASSKAAAPKFNWQDPLNLESQLTEEEVAIRDAFRGYCQAELLPRVKMANRLEQFDKKIMEEIGSLGVLGCTLKGYGCAGVSSVAYGLLTREVERVDSAYRSAVSVQSSLAMGAIYDYGSEEQKERYLPSMAQGKLIGGFGLTEPNHGSDPAGMETNAKYDSKTKTYILNGSKTWITSAPIADVLVVWAKCEDGKLRGFLVDRKISGKGLDTPKIEGKFSLRASPTGMILMDDVRVPEEQLLPKASGFSGPFNCLNNARYGIAWGALGAAEACVDIARQYTLDRKQFGRPLAANQLIQKKLADATTEIALGLQGCLQVGRLKDQKLHTPEMISLLKRNNTGKSLDIARQMRDMLGGNGISDEYHVIRHVMNLESVNTYEGTHDIHALILGRAITGLAAFAN

SEQ ID NO: 3531 - protein, 434 aa, Mustela putorius
EKVLRAAGERGPGLSFLRGWGSAAAQTEKGGKTQNRATKASRPLFDWRDPLVLEEQLTADEILIRDTFRTYCQERLMPRILLANRNEVFHREIISEMGELGVLGPTIKGYGCAGVSSVAYGLLARELERVDSGYRSAMSVQSSLVMHPIYAYGSKEQQEKYLPRLAKGELLGCFGLTEPNHGSDPGSMETRARHNPSNRSYTLTGTKTWITNSPVADLFVVWARCEDSCIRGFLLEKGMRGLSAPKIEGKFSLRASSTGMIVMDSVEVPEENVLPDVSGLAGPFGCLNNARFGIAWGVLGAAEFCLHTARQYSLDRIQFGVPLARNQLIQKKLADMLTEITLGLHACLQLGRLKDQDKATPEMVSLLKRNNCGKALDIARQARDILGGNGISDEYHVIRHAMNLEAVNTYEGTHDIHALILGRAITGIQAFTAS

SEQ ID NO: 3532 - protein, 418 aa, Drosophila persimilis; identical to SEQ ID NO: 3530

SEQ ID NO: 3533 - protein, 438 aa, Canis lupus
MALRRVPERLLSRGPGLSFLRGWGSAAAQTEKGGKTLNRATKASRPEFDWRDPLVLEEQLTADEILIRDTFRTYCQERLMPRILLANRNEVFHREIISEMGELGVLGPTIKGYGCAGVSSVAYGLLARELERVDSGYRSAMSVQSSLVMHPIYAYGSKEQQQKYLPRLAKGELLGCFGLTEPNHGSDPGSMETRARHNPSNRSYTLNGTKTWITNAPVADLFVVWARCEDRSIRGFLLEKGMRGLSAPKIEGKFSLRASSTGMIVMDGVEVPEENVLPDVSGLAGPFGCLNNARFGIAWGVLGAAEFCLHTARQYSLDRIQFGAPLARNQLIQKKLADMLTEITLGLHACLQLGRLKDQDKATPEMVSLLKRNNCGKALDIARQARDILGGNGISDEYHVIRHAMNLEAVNTYEGTHDIHALILGRAITGIQAFTASK

SEQ ID NO: 3534 - protein, 520 aa, Aspergillus fumigatus
MLIERGLLSIMASKCSGTWSTYKTYTTANGCPFMKPEGPPADGRTLALNDHHLVESLAHFNREKIPERAVHAKGAAAYGEFEVTADISDICNIDMLLGVGKKTPCVTRFSTTGLERGSAEGMRDLKGMATKFYTKEGNWDWVCLNFPFFFIRDPLKFPSLMHAQRRDPRTNLLNPNMYWDWVTSNHESLHMVLLQFSDFGTMFNWRSLSGYMGHAYKWVMPNGSFKYVHIFLSSDRGPNFSQGEQAKDNSDLDPDHATRDLYEAIERGDYPTWTANVQVVDPAEAPDLGFNILDVTKHWNLGTYPKDLPKIPSRPFGKLTLNRIPDNFFAEVEQLAFSPSNMVPGVLPSEDPILQARMFAYPDAQRYRLGPNHHKIPVNQCPMTFNPTLRDGTGTFDANYGSLPGYVSESQGVNFARPQEHDPKFNAWLSQLSSRPWMQTNENDYKFPRDFYNALPEFRSQEFQDKMVENIIASVAQTRREIREKVYHTFHLVDPELSARVKRGVEKMDASFKQVSLSRL

SEQ ID NO: 3535 - protein, 438 aa, Macaca fascicularis
MALRGVSVQLLSRVPGLRVFRTWVSSAAQTEKGGRTQSQLAKSSRPEFDWRDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPRLAKGELLGCFGLTEPNSGSDPSSMETRARYNSSNKSYTLNGTKTWITNSPMADLFVVWARCEDGCIRGFLLEKGMRGLSAPRIQGKFSLRASATGMIIMDGVEVPEENMLPGASSLGGPFGCLNNARYGIAWGVLGASEFCLHTARQYTLDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 3536 - protein, 438 aa, Macaca mulatta; identical to SEQ ID NO: 3499

SEQ ID NO: 3537 - protein, 624 aa, Homo sapiens; identical to SEQ ID NO: 434

SEQ ID NO: 3538 - protein, 624 aa, Homo sapiens; identical to SEQ ID NO: 434

SEQ ID NO: 3539 - protein, 624 aa, Homo sapiens; identical to SEQ ID NO: 434

SEQ ID NO: 3540 - protein, 551 aa, Cricetulus griseus
  MOD_RES (139)..(139): Any amino acid
MGYFTSSWTATGLNPPRVQRLLQDLLLTKEPQFQEFVSKESLKAMELVPRERLFCHLFFSGSHALAGSLKFWDVILLSRRNNVDTVQPVGIAQYGFLELAWKSLPSVAVAAMLAGYMALRGVSARILSRRPGLHFPRTXSSAAAHTKKTQSRPAQTSRPGFDWRDPLVLEEQLTADEKLIRDTFRNYCQEQLMPRIVLANRNEVFHRDIVYEMGELGMLGPTIKGYGCAGVSSVAYGLLTRELERVDSGYRSMMSVQSSLVMHPIYTYGSEEQRQKYLPRLAKGELLGCFGLTEPNHGSDPGGMETRARHNPSNQSYILNGTKTWITNSPVADLFVVWARCEDNCIRGFLLEKGMRGLSAPRIEGKFSLRASSTGMIIMDNVEVPEENVLPNASSLAGPFGCLNAARYGITWGVLGAAEFCLHTARQYALDRIQFGVPLARNQLIQKKLADMLTEITLGLHACLQLGRLKDQDKATPEMVSLLKRNNCGKALDIARQARDILGGNGISDEYHVIRHAMNLEAVNTYEGTHDIHALILGKAITGIQAFTVGK

SEQ ID NO: 3541 - protein, 438 aa, Unknown; identical to SEQ ID NO: 3197
  Description of Unknown: Coenzyme A polypeptide

SEQ ID NO: 3542 - protein, 438 aa, Unknown; identical to SEQ ID NO: 1362
  Description of Unknown: Coenzyme A polypeptide

SEQ ID NO: 3543 - protein, 439 aa, Heterocephalus glaber
MALRGVAARLLSRGAHLRVQHAWGSAAMHTGLVVGVVKPRAPLASRPKFDWWDPLVLEEQLKADEILIRDTFRNYCHERLMPRILMAYRNGVFNREIVTEMGELGVLGPTIKGYGCAGVSSVAYGLLARELERVDSGYRSMMSVQSSLVMHPIYAYGSEEQRQKYLPQLAKGELLGCFGLTEPNHGSDPSRMETRARHNPASKSYTLSGTKTWITNSPVADLFVVWARCEDARIRGFLLEKGMRGLSAPKIEGKFSLRASTTGMIIMDSVEVPEDNVLPNVAGLAGVFNCLNNARYGITWGVLGAAEFCLHTARQYTLDRIQFGAPLAKNQLIQKKLADMLTEITLGLQACLRLGRLKDQDRATPEMVSLLKRNNCGKALDIARQARDMLGGNGILDEYHVIRHAMNLEGVNTYEGTHDIHALILGRAITGIQAFSEGK

SEQ ID NO: 3544 - protein, 515 aa, Saccharomyces cerevisiae
MSKLGQEKNEVNSSDVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKFYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAEAKHASELSSNSKF

SEQ ID NO: 3545 - protein, 438 aa, Cavia porcellus
MALRNVAARLLSRGPHLRVRRAWGSAAAPTGQREVTSSRSRPAPRPEFDWRDPLGLEEQLTADEVLIRDTFRGYCQERLMLRVLNANRTPVFHREMVAEIGWLPPVPSGPAGYGCAGVSSVAYGLLARELERVDSGYRSLMSVQSSLVMYPIYAYGSEEQRQKYLPRLAKGELLGCFGLTEPNHGSDPSGMETRACHNPAGKSYTLNGTKSWISNSPVADLFLVWARCEDARVRGFLLEKGMPGLSAPKIEGKFSLRTSATGMIVMDSVEVPEENVLPNAVGLSSAFGCLNNARYGITWGVLGAAEFCLHTARQYTLDRVQFGAPLARNQLIQKKLADMLTEITLGLQACLRLGRLKDQDRATPEMISLLKRNNCGKALDIARQARDMLGGNGILDEYHVIRHVMNLETVNTYEGTADIHALILGRAITGIQAFASGK

SEQ ID NO: 3546 - protein, 418 aa, Ascaris suum
MLLRIFARSGLVSKASTIATFLTRAGSTFNYRDALDFNGLLSVEERSLMEQTQEYCRKSLMPRVIEAYRSERFDPTLLPELGKMGLLGAPYEGYGCAGTTFVGYGLLAREVEAIDSGYRSTVSVQTSLVIGPIYNYGSEAQKKKYIPGLAAGELIGCFGLTEPNHGSNPAGMETKARWDGNAKVYKLSGTKSWISNSPVADVMIVWARSDRHDNEIMGFILERGMSGLTTPKIEGKLSLRTSVTGQIAMDEVPVPEENLLPNVKGIVGPFGCLNNARLSIAWGALGAARTCFEIARDYALERPQFGRPLAKNQLIQVKLADMLTEISIGLHACLRVTRLKDEKSCSPQQISLIKRNSCGKALEIARKARDILGGNGIVDEYHVMRHMCNLESVNTYEGTHDIHALILGQQITGLQAFK

SEQ ID NO: 3547 - protein, 430 aa, Cricetulus griseus
MLAGYMALRGVSARILSRRPGLHFPQKTQSRPAQTSRPGFDWRDPLVLEEQLTADEKLIRDTFRNYCQEQLMPRIVLANRNEVFHRDIVYEMGELGMLGPTIKGYGCAGVSSVAYGLLTRELERVDSGYRSMMSVQSSLVMHPIYTYGSEEQRQKYLPRLAKGELLGCFGLTEPNHGSDPGGMETRARHNPSNQSYILNGTKTWITNSPVADLFVVWARCEDNCIRGFLLEKGMRGLSAPRIEGKFSLRASSTGMIIMDNVEVPEENVLPNASSLAGPFGCLNAARYGITWGVLGAAEFCLHTARQYALDRIQFGVPLARNQLIQKKLADMLTEITLGLHACLQLGRLKDQDKATPEMVSLLKRNNCGKALDIARQARDILGGNGISDEYHVIRHAMNLEAVNTYEGTHDIHALILGKAITGIQAFTVGK

SEQ ID NO: 3548 - protein, 438 aa, Loxodonta africana
MALRGASARLLSRRPGLRVLRLWGSAAAPTEKNGKTQNRPAKSSRPEFDWRDPLVLEEQLTADEILIRDTFRTYCQERLMPLILLANRKEVFHREIISEMGELGVLGPTIKGYGCAGVSSVAYGLLARELERVDSGYRSAVSVQSSLVMHPIYTYGSEEQRQKYLPRLAKGELLGCFGLTEPNHGSDPGSMEARARHNPSSKSYTLNGAKTWITNSPVADLFVVWARCEDSRIRGFLLEKGMQGLSAPKIEGKFSLRASATGMIIMDGVEVPEENVLPNASGLGSAFGCLNNARYGITWGVLGAAEFCLHTARQYTMDRIQFGVPLARNQLIQKKLADMLTEITLGLHACLQLGRLKDQDKDTPEMVSLLKRNNCGKALDIARQARDMLGGNGISDEYHVIRHTMNLEAVNTYEGTHDIHALILGRAITGIQAFTAGK

SEQ ID NO: 3549 - protein, 432 aa, Rhodotorula glutinis
MSLRLPLRQLAAKRVPPQALAARFASSEATAPAELAKTSSFAPYQWEDPLKVESTMLSEEEVSIMEMARSYCQEKLAPRVTEAYRTENFDRSILSEMGELGLLGPTIDGYGCAGVSSVAYGLVAREVERIDSGYRSAMSVQSSLVMHPINAFGSKQLKEKYLPRLAKGELVGCFGLTEPDHGSDPAGMTTEAREAPGGGGFLISGAKTWISNAPIADVFVVWAKCQWDGKIRGFVLDKGMKGLSAPAIKNKTALRASITGSIFMDEVSVPAEQMLDVQGLKGPFSCLNNARFGISFGAVGALEEAIRITREYALERKQFKKPLAGFQLVQQKLANAHMEAAIGLVSCVQLGRLKDSGNWSPEMVSIMKRNNCQKALDHSRILMEVFGGNAASDEYPIARIAYNLHTVSTYEGTRDIHGLILGKAITGIAAFE

SEQ ID NO: 3550 - protein, 415 aa, Amphimedon queenslandica
MESDGMTSSFSQAVSSKGASEPRSSKPKTGFDWPDPLQLAGALSDEERMVQQSAHEYAQRALAPRILEAHRKEYFDPAILREMGEIGLLGSTIDGYGCAGIGYVGYGLVAREIERVDSGYRSAMSVQSSLVMHPIHAFGSEEQREKYLPRLAKGELVGCFGLTEPDAGSDPGSMRTRARRVDGGFRLSGGKTWISLAPIADIMVVWAKNDEDEIRGFVLERGMKGLETPTIEGKFSLRSSITGQILLDDVFVPAAAELQGVRGLKGPFSCLTRARYGIAWGALGAAEFCWHAARGYTLERRQFGRPLAANQLIQKKLADMQTEIAIGLAACLRLGRLFDEGRAAHEAVSMLKRNSAGKALEIARLARDMHGGNGIADEYHVIRHLMNLETVNTYEGTHDIHALVLGRAQTGIAAF

SEQ ID NO: 3551 - protein, 408 aa, Acidiphilium sp.; identical to SEQ ID NO: 2130

SEQ ID NO: 3552 - protein, 408 aa, Acidiphilium sp.; identical to SEQ ID NO: 2130

SEQ ID NO: 3553 - protein, 438 aa, Equus caballus
MALRGVSVRLLSRRPGLRALRAWGSAAAQTEKGGKTQSRPAKSSRPEFDWRDPLVLEEQLTADEIAIRDTFRTYCQERLMPRILLANRNEVFHREIILEMGELGVLGPTIKGHGCAGVSSVAYGLLARELERVDSGYRSAMSVQSSLVMYPIYAYGSEEQQQKYLPRLAKGELLGCFGLTEPNHGSDPGSLETRARHNPSGRSYTLNGTKTWITNSPVADLFVVWARCEDGRIRGFLLEKGMRGLSAPKIEGKFSLRASATGLIVMDDVEVPEENVLPNASGLAGPFGCLNNARYGITWGVLGAAEFCLHTARQYTLDRIQFGVPLARNQLIQKKLADMLTEITLGLHACLQLGRLKDQDKATPEMISLLKRNNCGKALDIARQARDMLGGNGISDEYHVIRHAMNLEAVNTYEGTHDIHALILGRAITGIQAFTASK

SEQ ID NO: 3554 - protein, 408 aa, Acidiphilium multivorum; identical to SEQ ID NO: 2130

SEQ ID NO: 3555 - protein, 429 aa, Monodelphis domestica
MALKGVSTWRLLSQVHSPILALVRGRTAQAATRASRPTFNWQDPLLLEAQLTPDEILTRDTFRTYCQEKLMPRILLANRNEVFHREIVSEMGELGVLGPTIQGYGCAGTSNVAYGLLTRELERVDSGFRSTMSVQSSLVMFPIYAYGSEEQRQRFLPRLAKGEILGCFGLTEPNHGSDPGSMETKARYNAASKTYTLNGSKTWITNSPVADLFVVWAVCEDGKVRGFLLEKGMRGLSAPKIEGKFALRSSITGMILMDDVEVPEQNLLPHASGLSGPFGCLTTARFGIAWGALGAAEFCMHTARQYTLDRKQFGVPLAKNQLIQKKLADMLTEITLGLHACLQLGRLKDQDKATPEMVSLLKRNNCGKALDIARQARDMLGGNGISDEYHVIRHVMNLEAVNTYEGTHDIHALILGRAITGIQSFTSGK

SEQ ID NO: 3556 - protein, 530 aa, Hordeum vulgare
AVLSSVSTPEVPCGNCFKVEILYCIIPGTPLPSEEQTSQLTISWRLNFVQSTMLKGMIENGTRQGLREGYAQFTEVLSKKIKVSELDGANSSKDKILASLQTHEQSNWSLVARFLGSFAFIFSFTIAVYGIAHLRLAKPSKMVHGGLEYFGIDLPDSVGEVIFCAILILQGRNIFKVGQRFLHAWKKRGSDHGVKAHGDGWLLTVALIEGSGIVGAGTPGLADPYVVFMCNGKRKTSSVKFQTSEPKWNEIFEFDAMDDPPSRLDVVVHDSDGPVDDNTICRTEINFVKNNLSDLDDMWLPLDGRFAQGSEPKLHLRIFLNNSRGTEVVMNYLEKMGKEVGKKMHLRSAQTNSSFRKLFSLPPEEFLIDDFTCHLKRKMPLQGRLFLSPRITGFYSNIFGRKTKFFFLWEDIDDIQVVPPSLSTVGSPSLMIILQKDRGLEARHGAKTQDPQGRLKFHFQTFVSFNDAHRVIMALWKMRSSGLEQKGEMIEPEPKQLPCEEVPLLGNEDVKMIEVYSAVLSVDVGLALCQ

SEQ ID NO: 3557 - protein, 2385 aa, Selaginella moellendorffii
MEASAVHELLEELHPSLSRSSRICVVGGGPSGVSAAYALWKLGYEQVTLIEKHHTVGGMCESVDIQGRPYDLGGQVIARESAPNIKHLAQVARVGMEDMAAHKLSLVDSKTGTYQDLGIARDYISMIQITLDLQAQAASTGKTGVHALSSLAPETAAEFAAKHGMGRIPEAVATGYTASGYGFPHEQDIPYAYLHEFVRTSMFGKVCRIKGGYTGLWQGVARLLPRVRLNTRVTEIRRRGSGRGVTVCTSSSDGGEESEELEFDKIVISGAIPFAPPGAELMTLGDEEASLFSRVRTMDYYTTVLEISGFENKFPAGFYYFKDNVEDAKEIGHPVAMQKFYADTNIYLFWSYGTAQVSQEMMTALLLQDVARIGGTVERIVLQRKWNYFPHIGSQDMRSGLYDRLESLQGCNDTYYVGGLFAFELTERNAAYAMNLIAKNFGTPAKVKNLITGAAIKLDEAEGGDLEVTSEATGGEFPDLPCLDSYLHFYAKHSVARDKVLYTWLDDKGDESGSRTYAQLHNNANTIAHNLVTHKVTLHDGDRVLLLYNPGLEFIEAFFGCLRANVLPVPLIPPDVASRGSSSSSSHALAKVENVAAACGAKAILSTVAYHTAVRASAIRDTLLSRSGGRPSWPKLPWMHTDLWVSKQNKEAEDYFRGRGEAEESERCCFLQFTSGSTGDPKGVIITHAALIHNVKLMRRRYKSTSRTVLVSWLPQYHDMGLIGGLFTALVSGGTAILLSPTNFIRRPLLWLEAMSKYEATHSAAPNFAFDLVVNKMNQQPGITYQLSCLKFLMVSAEPVRSSTLKRFLKTMESSGLKEEVVAPGYGLAENCVFVSVAWGRGRPLVVDWQGKVCCGYVDRGNPDVDVRIVDPETGVEVGDGVEGEIWVGSPSNGAGYWGNERLSQDTFHARLEGGEEANRFLRTGDLGRVVKGMLFVTGRIKDLIIIRGRNVYPSDIEKTVEACSGSLRPGCCAAFGAPGRALHSKGIKVCDEDEVGVVVVAEVRDESKVDPEQLTAHISSMVASEHGLSVASVRLVKPRTISKTSSGKIRRLDCLKQFTEDRLDSISPTIEKTKKILRLRRSRTFSGTPGVIPPTPPPSAASVARSKAEVTSFLTEILAEKLGLSQAQVLSTKSFADYGLDSSSVVWAAHKLSSFLGVHVAAIDIYTAGCISELADSVESLVLTTKSSTSSQPVVPPAIPETDVSAKGPSKTEISNFICQIISERTGIDMSKLSPSQSFANYGLDSVAVVWASQKLSNFLGVHVAAIDIYTAGCISELCDVVDGLVGKTVVTQQQQGTEIDDKASLSSCRGGPYTDDDFEGEIVTDSQLESGILPSLQRQVCITFLQLLGIIYVAWTLLVPAAFILRQFTSLVADRPVVATVLCAPLCWLLYMAATALAASLGTSFLLPVLHLRTTVPLWSLNFVRWWTCYRLQDFASARIVANQLRGTVFVNWWYRLLGAQIGSGVELETTDITDPWLVVLGDGAAIGEGATLQCHEVKAGAVQFKPIRIGRRCSIGPYSFIGLGASLRATSVSPLGKVDGTSQLGVRHLEDDSSKVHPSRRQDKNSTMLYTLCQAAGLYVVSLVSAISGVVGYVVFVWLVDKLGILPAGARESQTGYIVSSLLSTFPWAVTAAIPLSVFQDPSSIVDYLIYVALQGKLLALVLCMGCAYIGYDLLDLGSGSHLGDFAKVITSDNGCYAKLDVGTGCVVGAQSVLMPGSCMEESSWLGALSVATSGFTLKQGGVYLGVENPTMVYNHASVAHEQDSRIVAMDAEYRKTVANLSAHIGKTSHSVKSRYFHRAGICGKGRLTVLEDLDSSFPRHDVFSKGKSYSVVVRHSNSLSSDDDARPDARGASLRILRHDHSSVHESLVDLTLKTGQAFYARNIADFVTWLTTSSKRREEIVKDSPHRGDAVWDSLRLGNSYAELHYYSNVSRLFKSASSPKREWYVRFRMRPLDPQYGVDEGRIAREGVLPPDTGALPRRDKDERSPSYLRDDFARRLASPQGVDYVLQLQLRPVPDSLAERDLAIDCTRAWDEQAFPYVDVAAIHLDELVDPALTEAMRFNPRNGVPSLDMIPATSLRESASIDHGRSVAYDIAQYVRNGAELPGAWKALLRDSDVPLANDISNDGNIGCPALSGCLPPNLAVLPETNCKTATATAKTRLKFGLIRSMQPLLQLLAPATLLGLSQLAALLPAALIASRAPRSDWLFLALVLLSYMVSALVLSLGSISARRILVGGRKGVQEKSRSELWGLRSLQDTVWQCVNSVACGYFLDLTKGSALSTGYLRQLGASIDTVGVYMDTLYALNPDRLSVKTGSSIGRDALLFGHVYEGGGDVHFGSNSVGEYAFVGARSLLLPGSSLEDGAELRPLGLAMKNELVKAF

SEQ ID NO: 3558 - protein, 2439 aa, Selaginella moellendorffii
MEASAVHELLEELHPSLPRSSRICVVGGGPSGVSAAYALWKLGYEQVTLIEKHHTVGGMCESVDIQVARVGMEDMAAHKLSLVDSKTGTYQDLGIARDYISMIQITLDLQAQAASTGKTGVHALSSLAPETAAEFAAKHGMGRIPEAVATGYTASGYGFPHEQDIPYAYLHEFVRTSMFGKVCRIKGGYTGLWQGVARLLPRVRLNTRVTEIRRRGSGRGVTVCTSSSDGGEESEELEFDKIVISGAIPFAPPGAELMTLGDEEASLFSRVRTMDYYTTVLEISRFENKFPAGFYYFKDNVEDAKEIGHPVAMQKFYADTNIYLFWSYGNAQVSQEMMTALLLQDVARIGGTVERIVLQRKWNYFPHIGSQDMRSGLYDRLESLQGCNDTYYVGGLFAFELTERNAAYAMNLIAKNFGTPAKVKVELFLLPIKLDEAEGGDLEVTSEATGGEFPDLPCLDSYLHFYAKHSVARDKVLYTWLDDKGDESGSRTYAQLHNNANTIAHNLVTHKVTLHDGDRVLLLYNPGLEFIEAFFGCLRANVLPVPLIPPDVASRGSSSSSSHALAKVENVAAACGAKAILSTVAYHTAVRASAIRDTLLSRSGGRPSWPKLPWMHTDLWVSKQNKEAEDYFRGRGEAEESERCCFLQFTSGSTGDPKGVIITHSALIHNVKLMRRRYKSTSRTVLVSWLPQYHDMGLIGGLFTALVSGGTAILLSPTNFIRRPLLWLEAMSKYGATHSAAPNFAFDLVVNKMNQQPGITYQLSCLKFLMVSAEPVRSSTLKRFLKTMESSGLKEEVVAPGYGLAENCVFVSVAWGRGRPLVVDWQGKVCCGYVDRGNPDVDVRIVDPETGVEVGDGVEGEIWVRSPSNGAGYWGNERLSQDTFHARLEGGEEANRFLRTGDLGRVVKGMLFVTGRIKDLIIIRGRNVYPSDIEKTVEACSGSLRPGCCAAFGAPGRALHSKGIKVCDEDEVGVVVVAEVRDESKVDPEQLTAHISSMVASEHGLSVASVRLVKPRTISKTSSGKIRRLDCLKQFTEDRLDSISPTIEKTKKILRLRRSRTFSGTPSVIPPTPPPSAASVARSKAGVTSFLTEILAEKLGLSQAQVLSTKSFADYGLDSSSVVWAAHKLSSFLGVHVAAIDIYTAGCISELADSVESLVLTTKSSTSSQPVVPPAIPETDVSAKGPSKTEISNFICQIISERTGIDLSKLSPSQSFANYGLDSVAVVWASQKLSNFLGVHVAAIDIYTAGCISELCDVVDGLVGKTVVTQQQQGTEIDDKASLSSCRGGPYTDDDFEGEIVTDSQLESGILPSLQRQVCITLLQLLGIIYVAWTLLVPAAFILRQFTSLVADRPVVAAVLCAPLCWLLYMAATALAASLGTSFLLPVLHLRTTVPLWSLNFVRWWTCYRLQDFASARIVATQLRGTVFVNWWYRLLGAQIGSGVELETTDITDPWLVVLGDGAAIGEGATLQCHEVKAGAVQFKPIRIGRRCSIGPYSFIGLGASLRATSVSPLTSTGDCFFSFLLASYHLSLQDKNSTMLYTLCQAAGLYVVSLVSAISGVVGYVVFVWLVDKLGILPAGARESQTGYIVSSLLSTFPWAVTAAIPLSVFQDPSSIVDYLIYVALQGKLLALVLCMGCAYIGYGASLCWMTWLLKWILVGKLERKGEVRKNSSFGYRLWLVRRLLATTHARFTFLLTGTEALCFYLRVLGAKVGDRASVRAINAILDPDLLDLGSGSHLGDFAKVITSDNGCYARLDVGTGCVVGAQSVLMPGSCMEESSWLGALSVATSGFTLKQGGVYLGVENPTMVYNHASVAHEQDSRIVAMDAEYRKTVANLSAHIGKTSHSVKSRYFHRAGICGKGRLTVLEDLDSSFPRHDVFSKGKSYSVVVRHSNSLSSDDDARPDARGASLRILRHDHSSLHESLVDLTLKTGQAFYARNIADFVTWLTTSSKRREEIVKDSPHRGDAVWDSLRLGNSYAELHYYSNVSRLFKSASSPKREWYVRFRMRPLDPQYGVDEGRIAREGVLPPDTGALPRRDKDERSPSYLRDDFARRLASPQGVDYVLQLQLRPVPDSLAERDLAIDCTRAWDEQAFPYVDVAAIHLDELVDPALTEAMRFNPRNGVPSLDMIPATSLRESASIDHGRSVAYDIAQYVRNGAELPGAWKALLRDSDVPLANDISNDGNIGCPALSGCLPPNVAVLPETNCKTATATAKTRLKFGLIRSMQPLLQLLAPATLLGLSQLAALLPAALIASRAPRSDWLFLALVLLSYMVSALVLSLGSISARRILVGGRKGVQEKSRSELWGLRSLQDTVWQCVNSVACGYFLDLTRGSALSTGYLRQLGASIDTAGVYMDTLYALNPDRLSVKTGSSIGRDALLFGHVYEGGGDVHFGSNGVGEYAFVGARSLLLPGSSLEDGAELRPLGLAMKNELVKAF

SEQ ID NO: 3559 - protein, 438 aa, Pan troglodytes
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPRLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVSQALNQMIQKKLENMLIEITLSLHACLQFGRLKDQDKAAPEMVSLLKRNNCGKALDIARQARDMLGGNGISDEYHVIRHAMNLEAVNTYEGTHDIHALILGRAITGIQAFTASK

SEQ ID NO: 3560 - protein, 438 aa, Nomascus leucogenys
MALRGVSVRLLSRGPGLRVLRMWVSSAAQTEKGGRTQSQLAKSSRPKFDWQDPLVLEEQLTTDEILIRDTFRTYCQERLMPRILLANRNEVFHREIISEMGELGVLGPTIKGYGCAGVSSVAYGLLARELERVDSGYRSVMSVQSSLVMHPIYAYGSEEQRQKYLPRLAKGELLGCFGLTEPNSGSDPSSMETRARYNSSNKSYTLNGTKTWITNSPMADLFVVWARCEDGCIRGFLLEKGMQGLSAPRIQGKFSLRASATGMIIMDGVEAPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 3561 - protein, 515 aa, Saccharomyces cerevisiae; identical to SEQ ID NO: 3497

SEQ ID NO: 3562 - protein, 420 aa, Salpingoeca sp.
MMMFAVRAVARGTGAPVRRMLSSTASAKSVLPMDWQDALNLDDQLTSDEKMARDMARSYCKEKLLPRVVSAYQEERFDREIMNEMGELGMLGSTIDGYGCAAMSYVAYGLLAREVERIDSAYRSAMSVQSSLVMFPINEFGTEAHKEKYLPRLATGEIVGAFGLTEPNHGSDPAGMETKLTKVDGGFLLNGTKTWITNSPVADVFVVWAKLDGKIRGVILERGMAGLETPKIEGKLSLRASVTGQIVMEDVFVPEENMFPEVTGLKGPFSCLNNARYGIAWGALGAAESCLEMAREYTLDRKQFGRPLAANQLMQLKMANMLTEISIGLQACLRVGRLKQERGVFAPDQVSLIKRNSCGKALDIARVARDMLGGNGISGDYHIIRHMINLETVNTYEGTHDIHALILGRAITGLQAFKPE

SEQ ID NO: 3563 - protein, 2414 aa, Oryza sativa
MDPKRSIDDQFSKLHPSLPVDTRIGIVGAGPSGLSAAYALAKLGYRNVTLFEKCHTVSGMCESIDIEGRIYDLGGQVIAANSAPVITHLAEELGSDFEEMDTHKLSLIDSQTGNIRDLEVAEDYVSMVSLTLKLQDEANKSGRAGLHALSGLASDPTHEFLKQNGINSMPKSVAYGYTASGYGFVQDMPYAFIQEFTRTSMAGKIRRFKHGYMSMWERLSKSLPFEVFCDTQVLNVKRNSCGANVTIKNNNGEKQVLEFDKIILSGAVAFKNSKTYRSSSLTDGESEVVELNNLERELFSKVQTIDYYTTVVKINGFEHIPKGFYYFEEFMEDPTTIGHPVAMQRFFADTNIFLFWSYGNSADIKGSFVAKCVTDVVSSMGGNVQKVILQRRFKYFPHVSSKDMKDGFYERLESQLQGFQNTYYVGGLLAFELTERNASYSIMAVCKHFAIDGEGELTPYVKRLFPLSHNRNPSPPRDLGELEGVEFPDLPSLDGYLQYWGTHKVTEKNVIYTWINEEGKLMNRRTYQELHGNASYIAQKLLTSTKPVIKPGDRVLLIHLPGLEFIDAFFGCIRAGVIPVPVLPPDPMQSGGQALLKVENISKMCNAVAILSTSSYHAAVRAGYIKNIVTLAKRVQKCSAQWPDIPWIHTDSWIKNYRRSSDSFNSDTVLFTKPQPSDLCFLQFTSGSTGDAKGVMITHEGLIHNVKTMKKRYRSTSKTVLVSWLPQYHDMGLIGGLFTALVSGGTSVLFSPMTFIRNPLLWLQTINDYHGTHSAGPNFAFELVIRRLEAEKNKVYDLSSMVFLMIAAEPVRQKTVRRFIELTQPFGLSEGVLAPGYGLAENCVYVTCAFGECKPVFIDWQGRVCCGYVEQDDTDTLIRIVDPDSLTEHQEDGVEGEIWISSPSSGVGYWGNSEMSQRTFFNQLKNHPNKKFTRTGDLGRTIDGNLFITGRIKDLIIVAGRNIYSADVEKTVESSSEVLRPGCCAVVGIPEEVLAQKGISIPDSSDQVGLVVIAEVREGKAVSEEVVNNIKARVVEEHGVAVASVKLIKPRTICKTTSGKIRRFECMRQFVDNTLSLAKGNHVSKKKGLFRSLTTGTGMESKRSLLRQTVDLTISHWPKSQVKNSNEITEFLTQIVSEHTGISKDKISLTDSLPSYGFDSIAVVRAAQKLSDFLGVPVGAIDIFTASCISELASFLENLVHKSQPQLAPWPKSKVKNSKEIIEFLTKIVSDQTGIPKDKISPTNSLPSYGFDSIAVVQAAQKLSDFLGVPVGAIDIFTAGCISELATFLENLAHKSQSQLAPGASCYIEDETQVDPMDAISPEFSVLGTGILQLLALTYVCFVLLLPAYLASSTYMSIFSTVSLVRSPLLSYLSSLVMAPIVWIFYISLTSLSLSILGKSFLQPNYVLIPDVSIWSVDFVKWWALNKAQALAAKMLAVHLKGTIFLNYWFKMQGARIGSSVVIDTVDITDPSLLTVADGAVLAEGALVQGHEVCNEVLSFRPIWIGCEASIGPYAVLQKGTVVEDGAVVPPLQKTGAGKSTRRTSRTSVSIKKEAAKANMILEHLVSIYAVGILGALSGAIVYTLYTHLSGKAASPLHFSFACIAGAFHWLPAAITAYAVIVQETPTSALSFALFTAFADLSYGVILSILTSITSRALAAKPGTKQNGIASLIHRRITISAHVRFAKMLSGTEAFCVYLRLLGAKIGRHCSIRAINPVANPELISVGDGVHLGDFCNIVPGFYSKGGFTSAEIKVQENTVVGSGSLLLPGCVLQENVILGALSVAPENAVLRRGGVYVGSQSPAMVKNTLLDEDERIEEMDQAYKKIVGNLAANLAITTMNVKSRYFHRIGVSGRGVLRMYEEIPSFPRHKIFASGKSFPVIVRHSNSLSADDDARLDARGAAVRILSDNDGEAPLLDLTLKSGKAFYARTIADFATWLVCGLPAREEQVKRSPHIRDAVWGSLRSTDSYTVLHYYSNICRLLRFDDGREMYAKFKLRPADPDVPEDSGKVVPRGILPPETGAIPRDEDDTRPLLFLADDFRRRVGSPDGVRYVFQLQLREVPTDAAARDVALDCTRPWDEAEFPYIDVGEVSIGCNLPTEETEKLEFNPFLRCPEVDVIPATSCAQSASIDHGRSLVYEICQRLRNGEPLPASWRAFLEQSDTKIDLSGCPVAAAATPTRSNAGDATKVTLARTWYQALWATLCQPLLQTLVPYSVLGLVIFLPLRGLLAVAAATRFPLYWLLPAFWAASGVAAMATCAAAKWALVGSRVDGDTVHIWSPAVFLDTVWQAVRAATAEYFAELTPGSAPFAAWMRVMGASVSPGDGVYVDSMGALLNPEMVRLERGAAVGRDALLFGHVYEGEAGKVKFGAVSVGEDGFVGSRAVAMPSVTVDDGGCLAALGLAMKGETVKHSM

SEQ ID NO: 3564 - protein, 419 aa, Drosophila sechellia
MIAQSVISKLRPCARRLASTSSKAAAPKFNWQDPLNLESQLTEEEVAIRDAFRGYCQAELQPRVKMANRLETFDKKIMEEIGSLGVLGCTIKGYGCAGVSSVAYGLLTREVERVDSAYRSAVSVQSSLAMGAIYDFGSEEQKQRYLPSMAEGKLIGAFGLTEPNHGSDPAGMETRAKYDSKSKTYILNGSKTWITSAPIADVIVVWAKCENGKVRGFLVDRKISGKGLETPKIEGKFSLRASPTGMILMDEVRVPEEQLLPNVAGFSGPFSCLNNARYGIAWGALGAAETCVEIARQYTLDRKQFGRPLAANQLIQKKLADAITEIALGLQACLHVGRLKDQKLHTPDMISLLKRNNTGKSLDIARQMRDMLGANGISDEYHVIRHVINLESVNTYEGTHDIHALILGRAITGLAAFAN

SEQ ID NO: 3565 - protein, 418 aa, Drosophila persimilis; identical to SEQ ID NO: 3530

SEQ ID NO: 3566 - protein, 432 aa, Trypanosoma cruzi
MFLFFFFSFRFMLCRFFCARRTAIAARCHGAVLDFARRCGSFNYAEYNDGDPLLLQEQLTDSEVEIRRVVREFCKKTLLPRVTDAYRNEREDRKIFRELGALGVLGPTIEGYGCAGISSVAAGLISREIEAIDSGYRSAWSVQSSLVMHPIYAFGSDAQKQRFLPKLATGELIGCFGLTEPNAGSDPMSMTTRARKVAGGYSLSGCKTWITSAPLADIAVVWAKLHDTNKIAGFIVERDFKGFATERIEGKLSLRTSCTGMIVLDNCIVPEENVLPHAIGLKAPFNCLSSARYGIAWGVVGAAETCFNIARDYSLERKQFGKSIASMQLVQAKLADAVTEITLAMQSCLRAGRLKEEGKLSHQVISMLKRNNTRKAIEIARAMRDILGGNGISDEYHVMRHVCNLETVLTYEGTYDIHGLILGRSITGMSAF

SEQ ID NO: 3567 - protein, 431 aa, Capsaspora owczarzaki
MASLTIARRIASASLGASSARTFASAATTASLAGGPGPAKFVKFNHTDPLNMDGLLTEEERMVRDMANEYCQSKLLPRVKLAYRHETFDRAIFTEMGKLGMLGATIQGYECPGVSSVAYGLIAREVERVDSSYRSAMSVQSSLVMYPIYAYGTEAQRKKYLPGLARGELVGCFGLTEPNHGSDPGSMETRARKTPQGNYILNGAKMWITNSPIADVFVVWAKTVEDGIIRGFVLEKGMKGLSAPKIEGKFSLRASPTGEIVMQDVEVPAENLLPNVEGLKGPFGCLTNARYGISFGAMGAAEFCMEAARTYTVDRKQFGRPLASNQLIQKKLADMLTEINLGLLASLQVGRLKDAGKLAPEMVSLVKRNNCGKALDIARVARDMLGGNGISDEYGVIRHVLNLEAVNTYEGTHDIHALILGRAMTGLQAFQ

SEQ ID NO: 3568 - protein, 1078 aa, Populus trichocarpa
MDPLVSIEDQFVKLHPCLPVNTRIGIVGGGPSGISAAYALAKLGYQNVTVLEKHHTVGGMCESVDIEGRIYDLGGQVLAKNSAPVIFHLAKEVGSELEEMDSHKLAHIDSSTGKYQDIKVADDYVAVMSLTLELQDKAKDSGRIGVHAVSELAADLTPTYLESRGFKSVPKSVAYGYTASGYGFVQDMPYAYIHEFTRTSMAGKIRRFKGGYTSLWQKISESLPIEVNCKTDVLAIRRNSDSVRVDVKRNNGEIQEMEFDKIIISGSFPFTNGNTYRFPAEKSTESETKVTDLSEVERYFFRKVQTIDYYTTVLKIKGLEDMPVGFYYFGEYMEDPATIGHPVAMQKFYADTDIFLFWSYGNSFDIKRPTVAELAKKVVMSMGAKVEEEVLQRRFKYFPHVGSQEMKDGFYEKLESELQGQRNTYYVGGLMAFELTERNSSYAMDLICKHFANNNSVPMFPYVKSLFSLKSDCWDRNPKELGEGVEFPDLSTLDGYLKHWGTESMTKDKTLYTWIGEDGAVVCQRTYAELHAKASCIARKLLTSRKPVIKPGDRVLLVYVPGLDFIDAFFGCLRAKVLPVPVLPPDPLQRGGQALLKIESIAKSCNAVAILSTLLYHSAVRAGSVKNLISLAGKNGKWPNLPWMHTDSWLKDSKVLAPGNIAYESECQPDDLCFLQFTSGSTGDAKGVMITHGGLIHNVKLMKRIYKSTSKTVLVSWLPQYHDMGLIGGLFTALVSGGSAILFSPMTFIKNPLLWLQIMSKYNATHSAGPNFAFELLIRRLEYADKDKVRNFDLSSLIFLMVAAEPVRQRTLKRFVELTRPFGLSQEVMAPGYGLAENCVFVSCAYGEGKPILVDWQGRVCCGYVEPNGEDIDIRIVDPESNEELKESGKEGEIWISSPSAGIGYWGREELSQSTFRNVLQNHPGRKYTRTGDLGRIIDGKVFITGRIKDLIIVAGRNIYSTDVEKTVESASELLRPGCCAVIGVPEEVLSSKGISLPDCSDQVGLVVIAEVRDAKPVDKDVVENIRSRVAEEHGVTVASIKLIKPRTISKTTSGKIKSARPNFCKTKIASLIHHRDM

SEQ ID NO: 3569 - protein, 419 aa, Drosophila simulans
MIAQSVISKLRPCARRLASTSSKAAAPKFNWQDPLNLESQLTEEEVAIRDAFRGYCQAELHPRVKMANRLETFDKKIMEEIGSLGVLGCTIKGYGCAGVSSVAYGLLTREVERVDSAYRSAVSVQSSLAMGAIYDFGSEEQKQRYLPSMAEGKLIGAFGLTEPNHGSDPAGMETRAKYDSKSKTYILNGSKTWITSAPIADVIVVWAKCEDGKVRGFLVDRKISGKGLETPKIEGKFSLRASPTGMILMDEVRVPEEQLLPNVAGFSGPFSCLNNARYGIAWGALGAAETCVEIARQYTLDRKQFGRPLAANQLIQKKLADAITEIALGLQACLHVGRLKDQKLHTPDMISLLKRNNTGKSLDIARQMRDMLGANGISDEYHVIRHVINLESVNTYEGTHDIHALILGRAITGLAAFAN

SEQ ID NO: 3570 - protein, 420 aa, Drosophila willistoni
MIAQMSKLWRPASTIGRLASNSTKASAPKFNWQDPLNLESQLTEEEVAIRDAFRGYCQSELLPRVKIANRLEQFDTKIMEEIGSLGVLGCTLKGYGCAGVSSVAYGLLTREVERVDSAYRSAVSVQSSLAMGAIYDFGSEEHKERYLPLMAQGKLIGAFGLTEPNHGSDPAGMETRAKYDSKSKAYILNGSKTWITSAPIADVLIVWAKCEDGKLRGFIVDRKISDKGLDTPKIEGKFSLRASPTGMILMDDVHVPEENLLPNALGFTGPFTCLNNARYGIAWGALGAAEACVETARQYTLDRKQFGRPLAANQLIQKKLADATTEIALGLQACLHVGHLKDQKLHTPEMISLLKRNNAGKALDIARQMRDMLGGNGISDEYHIIRHVMNLESVNTYEGTHDIHALILGRAITGLAAFAN

SEQ ID NO: 3571 - protein, 419 aa, Drosophila virilis
MIAQSIISKLGACGIRRLASTKASSAPKFNWQDPLNLESQLTEEEMAVRDAFRGYCQSQLLPRVILANRLEQFDKKIMEEIGSLGVLGCTLQGYGCAGVSNVAYGLLTREVERIDSAYRSAVSVQSSLAMGAIYDYGSDEQKQKYLPSMAQGKLIGAFGLTEPNHGSDPAGMETRAKYDSKTKTYILNGSKTWITSAPIADVIIVWAKGEDGKVRGFIVDRKLSGKGLDTPKIEGKFSLRASPTGMIMMDDVHVPEELLLPKALGFSAPFNCLNNARYGIAWGALGAAEACVETARQYTLDRKQFGRPLAANQLIQKKLADATTEIALGLQACLHVGRLKDRKLHTPEMISLLKRNNAGKALDIARQMRDMLGGNGISDEYHVIRHVMNLESVNTYEGTHDIHALILGRAITGLAAFAN

SEQ ID NO: 3572 - protein, 419 aa, Drosophila mojavensis
MIAQSIITKLRPCLVTRRLSSSKASAAKFNWQDPLNLESQLTEEEVSIRDAFRSYCQAELLPRVKMANRLEQFDKKIMEEIGSLGVLGCTLQGYGCAGVSSVAYGLLTREVERIDSAYRSAVSVQSSLAMGAIYDYGSDEQKQKYLPGLAQGKLIGAFGLTEPNHGSDPAGMETNAKYDSKTKTYILNGSKTWITSAPIADVIIVWAKCEDSKLRGFIIDRQLTSKGLDTPKIEGKFSLRASPTGMILMDDVRVPEELLLPNALGFSGPFNCLNNARYGIAWGALGAAETCVEIARQYTLDRKQFGRPLAANQLIQKKLADATTEIALGLQACLHVGRLKDKKLHTPEMISLLKRNNAGKALEIARQMRDMLGGNGISDEYHVIRHVMNLESVNTYEGTHDIHALILGRAITGLAAFAN

SEQ ID NO: 3573 - protein, 420 aa, Drosophila grimshawi
MIAQSVIAKLRPCARRLATGTKAISTAPKFNWQDPLNLESQLTEEEVSIRDAFRGYCQSQLMPRVIAANRLEQFDKKIMEEIGSLGVLGCTLQGYGCAGVSNVAYGLLTREVERIDSAYRSAVSVQSSLAMGAIYDYGTDQQKQKYLPSMAQGKLIGAFGLTEPNHGSDPAGMETRAKYDSKTKTYILNGSKTWITSAPIADVIVVWAKGEDGKVRGFIVDRQMSSKGLATPKIEGKFSLRASPTGMIHMDDVHVPEENLLPNALGFSGPFNCLNNARYGIAWGALGAAEACVETARQYTLDRKQFGRPLAANQLIQKKLADAITEIALGMQACLHVGRLKDQKLHTPEMISLLKRNNAGKALDIARQMRDMLGGNGISDEYHVIRHVMNLESVNTYEGTHDIHALILGRAITGLAAFAN

SEQ ID NO: 3574 - protein, 419 aa, Drosophila erecta; identical to SEQ ID NO: 3498

SEQ ID NO: 3575 - protein, 419 aa, Drosophila yakuba
MIAQSVISKLRPCARRLASTSSKAAAPKFNWQDPLNLESQLTEEEVAIRDAFRGYCQAELQPRVKMANRLETFDKKIMEEIGSLGVLGCTIKGYGCAGVSSVAYGLLTREVERVDSAYRSAVSVQSSLAMGAIYDFGSEEQKQRYLPSMAEGKLIGAFGLTEPNHGSDPAGMETRAKYDSKTKTYILNGSKTWITSAPIADVIVVWAKCEDGKVRGFLVDRKISGKGLETPKIEGKFSLRASPTGMILMDEVRVPEEQLLPNVAGFSGPFTCLNNARYGIAWGALGAAETCVEIARQYTLDRKQFGRPLAANQLIQKKLADAITEIALGLQACLHVGRLKDQKLHTPDMISLLKRNNTGKSLDIARQMRDMLGANGISDEYHVIRHVINLESVNTYEGTHDIHALILGRAITGLAAFAN

SEQ ID NO: 3576 - protein, 419 aa, Drosophila ananassae
MIAQSVISKLRPCARRLASTSSKAAAAKFNWQDPLNLESQLTEEEVAIRDAFRGYCQSELLPRVKLANRLEQFDKKIMEEIGSLGVLGCTLQGYGCAGVSSVAYGLLTREVEKVDSAYRSAVSVQSSLAMGAIYDYGSEEQKQRYLPSMAQGKLIGAFGLTEPNHGSDPAGMETRAKYDSKSKTYILNGSKTWITSAPIADVIVVWAKCEDGKVRGFLVDRKISGKGLDTPKIEGKFSLRASPTGMILMDDVRVPEEQLLPNALGFSGPFNCLNNARYGIAWGALGAAESCVEIARQYTLDRKQFGRPLAANQLIQKKLADATTEIALGLQACLQVGRLKDQKLHTPEMISMLKRNNTGKSLDIARQMRDMLGGNGISDEYHVIRHVMNLESVITYEGTHDIHALILGRAITGLAAFAN

SEQ ID NO: 3577 - protein, 438 aa, Mus musculus; identical to SEQ ID NO: 1833

SEQ ID NO: 3578 - protein, 2439 aa, Selaginella moellendorffii; identical to SEQ ID NO: 3558

SEQ ID NO: 3579 - protein, 2385 aa, Selaginella moellendorffii; identical to SEQ ID NO: 3557

SEQ ID NO: 3580 - protein, 511 aa, Kluyveromyces lactis; identical to SEQ ID NO: 3518

SEQ ID NO: 3581 - protein, 438 aa, Ailuropoda melanoleuca
MALRRVSERLLSRGPGLNFLRGWGSAAAQTEKGGKTQNRATKSSRPEFDWRDPLVLEEQLTADEILIRDTFRTYCQERLMPRILLANRNEVFHREIISEMGELGVLGPTIKGYGCAGVSSVAYGLLARELERVDSGYRSAMSVQSSLVMHPIYTYGSKEQQQKYLPRLAKGELLGCFGLTEPNHGSDPGSMETRARHNPSNRSYTLNGTKTWITNSPVADLFVVWARCEDSCIRGFLLEKGMRGLSAPKIEGKFSLRASSTGMIVMDSVEVPEENVLPDVSGLAGPFGCLNNARFGIAWGVLGAAEFCLHTARQYTLDRIQFGAPLARNQLIQKKLADMLTEITLGLHTCLQLGRLKDQDKATPEMVSLLKRNNCGKALDIARQARDILGGNGISDEYHVIRHAMNLEAVNTYEGTHDIHALILGRAITGIQAFTASK

SEQ ID NO: 3582 - protein, 425 aa, Coprinopsis cinerea
MLSSLRCQRANLLRAQERRLTQLTRGQGSRKASTLAKYNWEDPLSLESQLTEEEIAIRDMAREYCQENLMPRVLKGWRTEEFDRDILPEMGKLGLLGPTITGYGCAGASNVAYGLVAREIERVDSGYRSTASVQSSLVMHPINEFGTEAQKEKYLPRLAKGELVGAFGLTEPNHGSDPGGMETTAQEVDGGFVLNGSKTWITNAPVADVFIVWARCKWDGRVRGFILEKGMKGLTAPAIKNKVALRASATGSIFMDNVSVPHDALLPKSRGLSSAFSCLNSARYGISWGVMGALEDCLARTREYALERYQFKRPLASFQLVQKKLVDAHTEIALGLQSSLQVGRLKDQGKVAPEMISLVKRNNCGKALQHARILIDILGGNASADEYHVGRHVANLQVTNTYEGTHDIHALILGKAITDIPAFAN

SEQ ID NO: 3583 - protein, 660 aa, Pongo abelii; identical to SEQ ID NO: 372

SEQ ID NO: 3584 - protein, 425 aa, Coprinopsis cinerea; identical to SEQ ID NO: 3582

SEQ ID NO: 3585 - protein, 438 aa, Macaca mulatta
MALRGVSVQLLSRVPGLRVFRTWVSSAAQTEKGGRTQSQLAKSSRPEFDWRDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPRLAKGELLGCFGLTEPNSGSDPSSMETRARYNSSNKSYTLNGTKTWITNSPMADLFVVWARCEDGCIRGFLLEKGMRGLSAPRIQGKFSLRASATGMIIMDGVEVPEENMLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 3586 - protein, 438 aa, Bos taurus; identical to SEQ ID NO: 1919

SEQ ID NO: 3587 - protein, 438 aa, Callithrix jacchus
MALRGVSARLLSRGPGLRVLRTWVSTAAQTEKGGRTQSRPTKSLRPQFDWQDPLVLEEQLTTDEILIRDTFRTYCQERLMPRILLANRNEVFHREIISEMGELGVLGPTIKGYGCAGVSSVAYGLLARELERIDSGYRSAMSVQSSLVMYPIYAYGSEEQRQKYLPQLAKGELLGCFGLTEPNCGSDPSSMETRARYNSSNKSYTLNGTKTWITNSPMADLFVVWARCEDGCIRGFLLEKGMRGLSAPKIQGKFSLRASATGMIIMDSVEVPEENMLPGASSLGGPFGCLNNARYGITWGVLGASEFCFHTARQYALDRIQFGVPLAKNQLIQKKLADMLTEITLGLHACLQLGRLKDQDKATPEMVSLLKRNNCGKALDIARQARDMLGGNGISDEYHVIRHAMNLEAVNTYEGTHDIHALILGRAITGIQAFTASK

SEQ ID NO: 3588 - protein, 424 aa, Perkinsus marinus
MLTHVVSQGRALSRGFCTAAAAAKVKQGGDPFKWDHDTHWRDMFMLEDMLTEEERLIRDSARAFADAVLMPTVLDGFRNETFNKEVFLEFGKNGLLGPFIEGYGCAGASSVAYGLIAREVERVDSAFRSAFSVQSSLVMHPINIFGSEEQKSRWLPELAKGTKIGCFGLTEPNHGSDPSGMETTAKKVDGGWKLHGSKNWITNSPIADVCVVWAKCDTDGQVRGFLVETEWKGVSCPKILGKFSLRASPTGMILMDDVFVPEESLLPGVVGMKGPFACLNSARLGIAWGVIGAAEYCMETARGYTMDRKQFGRPLAANQLIQKKLADQLTEIHSMTLMAHRATQLKDEYKLHSNVISMCKRNNCGKALAIAREARDMLGGNGIVDEYGIIRHVMNLEAVNTYEGTHDIHALILGRAVTGLSAFK

SEQ ID NO: 3589 - protein, 424 aa, Perkinsus marinus
MLTHVVSRGRALSRGFCTAAAAAKVKQGGDPFKWDHDTHWRDMFMLEDMLTEEERLIRDSARAFADAVLMPTVLDGFRNETFNKEVFLEFGKNGLLGPFIEGYGCAGASSVAYGLIAREVERVDSAFRSAFSVQSSLVMHPINIFGSEEQKSRWLPELAKGTKIGCFGLTEPNHGSDPSGMETTAKKVDGGWKLHGSKNWITNSPIADVCVVWAKCDTDGQVRGFLVETEWKGVSCPKILGKFSLRASPTGMILMDDVFVPEESLLPGVVGMKGPFACLNSARLGIAWGVIGAAEYCMETARGYTMDRKQFGRPLAANQLIQKKLADQLTEIHSMTLMAHRATQLKDEYKLHSNVISMCKRNNCGKALAIAREARDMLGGNGIVDEYGIIRHVMNLEAVNTYEGTHDIHALILGRAVTGLSAFK

SEQ ID NO: 3590 - protein, 420 aa, Glossina morsitans
MIGRNVVAKVQSMVAKVGFATKASKQAPKFNWQDPLNLESQLTEDEIAIRNSFRSFCQDSLLPRITKANREESFDKDIMKDIGALGALGCTLNGYGCPGVSNVAYGLLAREIERVDSAYRSALSVQSSLAMGAIYDFGSDKLKEKYLPQLAQGKLIGAFGLTEPNHGSDPGGMETRAKYDNESKCFILNGSKSWITSSPIADVLIIWAKGEDGKVRGFLVDREQSKKGLSTPKIEGKFSLRASITGMILMDDLHVPEENLLPNVVGFVGPFTCLNNARYGIAWGALGAAEACVEIARQYVLDRKQFGRPLAANQLIQKKLADASTDIALGLQACLQVGRLKEKKLHTPEMISMIKRNNAGKALEIARVMRDVLGGNGISDEYHIIRHVMNLEAVNTYEGTHDIHALILGRAITGIPAFAN

SEQ ID NO: 3591 - protein, 419 aa, Drosophila melanogaster; identical to SEQ ID NO: 3498

SEQ ID NO: 3592 - protein, 485 aa, Debaryomyces hansenii; identical to SEQ ID NO: 3524

SEQ ID NO: 3593 - protein, 431 aa, Naegleria gruberi
MLSSARKVITKNSNKSGLASLISNNSRCFSTNATQHKEVMVSFNWKDPLNVESLLTEEEKEIRDQVHGYCQAKLMPRVLEANRKEHFDPEIMREMGEMGMLGINIHGHGCAGASNVAYGLVAREVERVDSGYRSAMSVQSSLVMHPINQWGNEAQKQKYLPKLATGELIGCFGLTEPNHGSDPSSMETKAKLSQCGKYYILNGSKMWITNSPIADIFVVWARSEAHEGKIKGFILEKGMKGLTAPKIEGKMSLRASITGSIGMDDVHVPVENLLPHASGLGGPFSCLNSARYGIAWGALGAAEYCFHTARQYQIDRKQFGRPLAQNQLPQKKMADMLTEISLGLVSCVQLGRLKDKGEWAPEMISMLKRNNAGKALEIARVCRDMLGGNGIADEYHIIRHSANLESVNTYEGTHDIHALILGRSITGLAAF

SEQ ID NO: 3594 - protein, 442 aa, Oryctolagus cuniculus
MALRGVSARLLSRGPGLRVLGALRPWASATARSAESGKTQSRPAKPSSRPAFEWRDPLLLEEELTADEILIRDTFRTYCQERLMPRILLANRNEVFHREMVSELGELGVLGPTIKGYGCAGVSSVAYGLLARELERVDSSYRSVMSVQSSLVMHPIHAYGSEEQRQKYLPRLASGELLGCFGLTEPNHGSDPGGMETRARYNPSSKSYTLNGTKSWITNSPVADLFVVWAPCDDGLIRGFLIERGTRGLSAPRIQGKFSLRASATGMIVMEGVEVPEENVLPGATGLSAPFGCLNNARYGITWGVLGAAEFCLHTARQYTLDRLQFGAPLARNQLIQKKLADMLTEITLGLHSCLRLGRLKDQDKATPEMVSLLKRNNCGKALDIARQARDMLGGNGVCDEYHVIRHAMNLEAVNTYEGTHDIHALILGRAITGIQAFKADK

SEQ ID NO: 3595 - protein, 431 aa, Naegleria gruberi; identical to SEQ ID NO: 3593

SEQ ID NO: 3596 - protein, 515 aa, Saccharomyces cerevisiae
MSKLGQEKNEVNYSDVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKFYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQEQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAEAKHASELSSNSKF

SEQ ID NO: 3597 - protein, 419 aa, Artificial Sequence; identical to SEQ ID NO: 3498
  Description of Artificial Sequence: Synthetic construct

SEQ ID NO: 3598 - protein, 419 aa, Artificial Sequence; identical to SEQ ID NO: 3498
  Description of Artificial Sequence: Synthetic construct

SEQ ID NO: 3599 - protein, 428 aa, Myxococcus xanthus
MYDATPTTADTSPHAKLHAQRFEGIKRNYTPKDVEKLRGSITVSHTLAELGAKKLWELLHTEDYINALGSLTGNQAVQMVRAGLKAIYLSGWQVAADANSAGQMYPDQSLYPVDSVPTVVRKINNALRRADQIDHAEGRKDRYWFAPIIADAEAGFGGPLNAFELMKGMIEAGAAGVHFEDQLASEKKCGHMGGKVLVPTSHFIRTLNAARLAADVMGVPTLLVARTDADSAKLLMSDADEYDHAFIDKKSGRTPEGFYRLNGGLDCAIARGLAYAPYADLVWCETITPDLAQAKKFAESIRAKYPNKLLAYNCSPSFNWKKNLDDATIAKFQRELGAMGYKFQFVTLAGFHALNFGMYELARKYKDRGMAAYSELQQAEFAAEKDGYTATRHQREVGTGYFDQVAEAICGGNASTLALTESTEAHQF

SEQ ID NO: 3600 - protein, 478 aa, Myxococcus xanthus
MTSRLRLLPLLALLSLTTCVRNPATGKRMLSLVSQQSEIALGKQSAEEVRGSIGLIQEPKVQEYVARVGLPMAKASERPELPWTIQAVDDPVVNAFALPGGPVFVTRGLLTAMNSEAELASVLGHEIAHITARHSVEQMSQAQLAQAGLLLGSVLSEDVARFGGLAAAGLQLLFLKYGRDDERQADELGFKYMLKGGYDVRQAANVFATLDRVGKAAGGQSLPTWLSTHPDPGDRVKTAKERAAKANVDFNQLKDGREEYLAMLQGMAYGDDPRQGFFRGNVFMHPGLRFQLTFPQGWKTANQPQQVAGISPQEDAIVGLVPIGNIAPQEAMRRFLAQEGIQPVSAAPTGFPQGTAFFQAQTEQGVIAGVTAFVSQGGTTLQLLGYTGAQQLPAYEDAFRATFSSFGELTDASALAVQPARIELAKVTSPMTLQQFNEQHPSTIPVEELSIINGVQPGDTLPAGRTVKRVTGGVRSTH

SEQ ID NO: 3601 - protein, 466 aa, Myxococcus xanthus
MSTKNVRTEKDTFGPIDVPADRLWGAQTQRSLQNFAISTERMPLALIRALVLVKKAAARVNVENGSLAKEKGEAIIRAADEVLAGQHDAEFPLSVWQTGSGTQTNMNTNEVLANRASELLGGERGERRKVHPNDDVNKGQSSNDVFPTAMSVAAVAAITEHVLPELKALRDVLAQKARAFHDVVKVGRTHLQDATPLTLGQEVGGFVAQLDHAKGHLERTLPHLLELALGGTAVGTGLNAPKGYAERVAQELAQLTGHPFVTAPNKFEALAANDALVQAHGALKGLAAVLFKVANDVRWLSSGPRSGLAEITIPENEPGSSIMPGKVNPTQSEALTMLCAQVMGNDVAVTVGGASGNFQLNVFKPLIAHNLLQSCRLLADGMRSFRLHCAVGIEPNRPRIQENLERSLMLVTALNPHIGYDNAAKIAKTAHRDGTTLKETAVALGLVTPEQFDQWVRPEDMTGHKG

SEQ ID NO: 3602 - protein, 935 aa, Streptomyces verticillus
MTSARPTPTLLPADQRELLRMMNDRTAPVPAHTLTAQLADAARTHDRALALVAPGLTLSHAELDARAAAVAARLTAAGVIPGDRVALAVEYGWEQVVGALAALRAGAVCLPVAPGLPRPARWQHATRAGATAVLTQSWLTQRIDWPQELPVLSVDEPGPPVPPTTAPADGRSATDAAYRLDAPVSHRAITTAALEIDRAFRVGPGDRLLALAPADSPLALYELFGPLLAGAALVLTRDIDLRDPGALHEALRTHGVTLWHSPPALLGLLLDHLADRGGKLPESLRLVLLGGERLDPALVRRVRESAPHQPAVAHLSSATPSGPWTTCLETGDLAPEWRSVPVGAPLPNQRAHILSETLRPCPVWVTGRLHYGGVAAEPPTGEEHAPATVPHPETGEPLLRTGLFARLLPEGLIDVVGDETARISVRDRPLNLQDTETALAAHEDVHSAVVVPVGRGDESLARVRLHPGATAGPDELLAHLRRKVSPYLLPGHIEVGGPLPLTRDGRVDRARVTAEAPAPAAVPAAAPAASAPARDEAELLAQVARVTCRVLGIGAVEPDMNLLDAGATSVELVRLATALEEELGLDTDIEELLAFPSVAVIVGRHLGRRTAPPARDPLPPASVAFAPGSVLPAPPAPGPVPPASVPPAPASVPPASESSPLAPPAPGPVPPTPVPPASVPPASGAAPHVPPAPPAPIPAPSVPPAPRPQPPLLTGIGARQAFKDAHHGIRHEFDATDGVALSGPDDHHLTARRSHHRFDPGPVTLPDLAALLGALRRVRGPGGEPKYAYPSAGSSYPVQTYLLVHPGKVTGLPGGSHYVHPARNRLVSIDPTATLPADAHAEINRAAYGEAAFSLYLIAAIDAITPLYGDLSWDFTVFEAGAMTQLLMRTAVGTGIGLCPVGTMDPAPLRRAFALTDRHRFVHALLGGRPRTEAP

SEQ ID NO: 3603 - protein, 416 aa, Lepeophtheirus salmonis
MAFSLRGGLIGRILKRSPSGFRGLSSSWWEDALNLEVSLTEEEIGIRDSVRSYCQEQLLPRVLMANRNEVFHREIMSEMGEMGILGPTIQGYGCAGTSTVAYGLIAREVERVDSSYRSAMSVQSSLVMYPISDFGTEEQKNKYIPRLATGEIVGCFGLTEPNHGSDPSSMETKAVKNPDGSWTINGSKNWITNSPIADVFMIWAATEDGIQGFLLEKGMEGLTAPKIEGKFSLRASTTGMIFMEDVVVGDEQRLPGVKGLRGPFSCLNSARFGIAWGVLGAAEFCLGAARQYTLDRYQFKKPLAQNQLIQKKLADALTEITLGLHACLHLGRLKDSGKLVPEMISILKRNNCGKSLDIARNCRDMLGGNGISDEYHIIRHVMNLEAVNTYEGTHDIHALIIGRGITGLEAFTGKSA

SEQ ID NO: 3604 - protein, 416 aa, Lepeophtheirus salmonis; identical to SEQ ID NO: 3603

SEQ ID NO: 3605 - protein, 430 aa, Dictyostelium discoideum
MERIQIISNHLVAGEIKQQKKAQPSATDFFDFDGLLTEKELAIRKKAEKFAKEEINSLNINEYYERAEFPLPIIERLKGLNWVGANIKGYGSPELTSMELGLIAMEISKSSADIATFYTILLNITMLAIYYSGSEQQKQYYLPKMTSLEKIGAFALTEPEAGSDAAGLKCTAKQLPNGAGWILNGEKRWIGNAPMADIIVIWARNIDTNKIHGFILEPSKVASGGDQLRIETLQKKFAFRSVQNGHIFMKDCFIAEDQRLTNALDFNSGPGKCLFLTRIVVGWIALGVASNAYEKCLQYVKQRNQFGQPLAQFQLVQERLVKMCSNIQAISLMCHRVSQLFDQGKLSSGQVGLLKAFSTSKAREVVSMARELFGGNGILLDDIGRNFLDMEGIYTFEGTYDVNTLIAAREITGLSAISSINHSKSQQQQK

SEQ ID NO: 3606 - protein, 519 aa, Zygosaccharomyces rouxii
MRSRTSYITDCLGIAPSSSSFSIRKSITTMSPANYSVPLYTTSNGCPVRDPNAMLKMGKFGPTLLQDHHLIDLIAHFDRERIPERVAHAKGSGAHGYLEVTDDVSDIVSADFLNGIGKKTPLFLRFSTVGGEKGTADSARDPRGFAIKFYTQEGVIDWVNINSPIFFIRNGVQFPYLVHTQKARDPKTNLKDPNMFWDFLLNNPESVHNTMFVFSDRGTPFSYRHMHGYSAHTYKWVNKEGKFHYVQVHLLTDQGIKNLNNEEAHALEADDPDHAGRDLYESIEGGEYPSWTIYIQTMTAEQAEQADFSVFDLTKTWPQKEYPLRRVAKLVLDRNPENYFAEVEQSAFSPANTVPGIEPSADPVLQARLFSYADTQRYRLGPNFNQLPVNRPLQAYCPFQRDGPGRTDGNYGAVPNYPSSFEPLNYRADASNNEAHEKWVGEATSFHWGATEKDYEQPRIFWELFKNTGQQDAFIHNVTENVKATRPDVQKRVLELFSKINPEISELMSHSLETKAKRT

SEQ ID NO: 3607 - protein, 508 aa, Zygosaccharomyces rouxii
MSGKDNTNSSDVRGDRVVTTVEGAPINEPFATQRVGNHGPLLLQDAGLIESLAHFNRERIPERNPHAHGSGAFGYFEVTDDITDICGSAMFSEIGKKTRCLTRFSTVGGEKGSADTARDPRGFATKFYTEEGNLDWVYNNTPIFFIRDPSKFPHFIHTQKRNPQTNMKDANMFWDFLTTPENQVCVHQMCILFSDRGTPASYRNMNGYSGHTYKWSNKKGEWHYVQVHIKTDQGIKNLTNEEAVKLSGENPDCCQQDLFENIEKGNPPSWTIYIQTMTEDQASKQPFSVFDLTKVWPQNEFPLRRVGKLVLNENPQNFFAQVEQAAFAPSNTVPYQEASADPVLQSRLFAYSDAHRYRLGANFNQIPVNCPYASRFFNPAIRDGPMNVNGNFGSEPNYLAQSKKYTYVQQDRPIQQHQEVWHGPAVPYHWATSPGDVDYYQPRILYQKVLAKQPGQQKNLAHNIGVHVAGACPEIQKRVINMFTRVDKKLAADIKKELQLASAPQAKL

SEQ ID NO: 3608 - protein, 491 aa, Zygosaccharomyces rouxii
MSPVTSNYSVPLYTTSNGCPVRDPNAMIKMGTFGPTLLQDHHLIDLIAHFDRERIPERVAHAKGSGAHGYLEVTDDVSDIVSADFLNGIGKKTPLFLRFSTVGGERGTADSARDPRGFAIKFYTQEGVIDWVNINSPIFFIRNGVQFPYLVHTQKARDPKTNLKDPNIYWDFLLNNPESVHNIMFVFSDRGTPYSYRHMHGFSAHTYKWINKEGQFHYVQVHLLTDQGIKNLNNEEAHALEADDPDHAGRDLYESIERGGHPSWTIYVQTMTAEQAEQADFSVFDLTKTWPQKEYPLRRVAKLVLDRNPENYFAEVEQSAFSPANAVPGIEPSADPVLQARLFSYADTQRYRLGPNFSQVPINRPLQAYCPFQRDGPGRMDGNYGAVPNYPSSFEPLDYRADASNNEAHEKWVGEATFFHWGATEKDYEQPRIFWEVFKRTGQQDAFIHNIAENVKTTRPDVQERVLKLFSKVNPEISEHISQTLHKVTSK

SEQ ID NO: 3609 - protein, 758 aa, Saccharomyces cerevisiae
MQLDSGARIMYIPEVELVDRQSPDDNKFMNATDKKKRKRIFIPPKDNDVYEHDKFLFKNVELERAKNSQLFYSKFLNQMNVLSKILIPTVFDKNFLLLTAQIFFLVMRTWLSLFVAKLDGQIVKNIIAGRGRSFLWDLGCWFLIAVPASYTNSAIKLLQRKLSLNFRVNLTRYIHDMYLDKRLTFYKLIFDAKASNSVIKNIDNSITNDVAKFCDATCSVFANIAKPVIDLIFFSVYLRDNLGTVGVAGIFVNYFITGFILRKYTPPLGKLAGERSASDGDYYNYHLNMINNSEEIAFYQGTAVERTKVKELYDVLMEKMLLVDKVKFGYNMLEDYVLKYTWSGLGYVFASIPIVMSTLATGINSEEKNMKEFIVNKRLMLSLADAGSRLMHSIKDISQLTGYTNRIFTLLSVLHRVHSLNFNYGAVPSILSIRTEDASRNSNLLPTTDNSQDAIRGTIQRNFNGIRLENIDVIIPSVRASEGIKLINKLTFQIPLHIDPITSKSNSIQDLSKANDIKLPFLQGSGSSLLILGPNGCGKSSIQRIIAEIWPVYNKNGLLSIPSENNIFFIPQKPYFSRGGTLRDQIIYPMSSDEFFDRGFRDKELVQILVEVKLDYLLKRGVGLTYLDAIADWKDLLSGGEKQRVNFARIMFHKPLYVVLDEATNAISVDMEDYLFNLLKRYRFNFISISQRPTLIKYHEMLLEIGENRDGKWQLQAVGTDEAITSIDNEIEELERKLERVKGWEDERTKLREKLEII

SEQ ID NO: 3610 - protein, 1078 aa, Populus trichocarpa; identical to SEQ ID NO: 3568

SEQ ID NO: 3611 - protein, 415 aa, Culex quinquefasciatus
MALRALTGRIGSLRGILNGGNVTRAEFSWEDPLNLESQLKEDEIAIRDSFRVYCEDKLLSRVIHANRDEVFHKEIMKELGSFGVLGCTIKGYECAGVSNVAYGLLTREVERIDSGYRSAFSVQSSLCMGAIYDYGSEAQKQKYLPKMARGELIGCFGLTEPNHGSDPSSMETRAVHDPKTKTYVLSGSKTWITNSPVADVCIVWGKTEDGKVRGFIVDRSESSQGLSTPKIQGKFSLRASDTGMILMDEVRIPEDNILPNVSGMRGPFGCLNNARYGIAWGALGAAESCLKIARGYTLDRKQFKRPLAANQIMQKKMADMLTEISLGLAACLHVGRLKDQKIHTPEMISMLKRNNAGKALEIARVARDMLGGNGISDEYHIIRHVMNLEAVNTYEGTHDIHALILGRAITGIAAF

SEQ ID NO: 3612 - protein, 439 aa, Artificial Sequence
  Description of Artificial Sequence: Synthetic construct
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASKL

SEQ ID NO: 3613 - protein, 438 aa, Homo sapiens; identical to SEQ ID NO: 1362

SEQ ID NO: 3614 - protein, 436 aa, Arabidopsis thaliana; identical to SEQ ID NO: 354

SEQ ID NO: 3615 - protein, 413 aa, Caenorhabditis briggsae
MLTRGFRNVTTIGKVATRDAFQLSDQLTEDERSLMLSAREYCQERLLPRVTEAYRNEKKRTTQSSIEFDPSLIPEMGSMGLLGAPYQGYGCAGTSTVGYGLIAREVERVDSGYRSTMSVQTSLVIGPIYNYGTEEQKQKYIPDLASGKKIGCFGLTEPNHGSNPGGMETKAIWDETSKTYKLSGSKTWISNSPVADVMVVWARSSRHGNKIKGFILERGMKGLTTPKIEGKLSLRASITGQIAMDDVPVPEENLLPNVEGLQGPFGCLNNARLGIAWGSLGAAEECFHLARQYTLDRQQFGRPLAQNQLMQLKMADMLTEISLGLQGCLRVSRLKDEGKVEPEQISIIKRNSCGKSLEIARKARDMLGGNGIVDEYHIMRHMVNLETVNTYEGTHDVHALILGRAITGLNGFF

SEQ ID NO: 3616 - protein, 436 aa, Unknown; identical to SEQ ID NO: 354
  Description of Unknown: Coenzyme A polypeptide

SEQ ID NO: 3617 - protein, 436 aa, Unknown; identical to SEQ ID NO: 354
  Description of Unknown: Coenzyme A polypeptide

SEQ ID NO: 3618 - protein, 436 aa, Unknown; identical to SEQ ID NO: 354
  Description of Unknown: Coenzyme A polypeptide

SEQ ID NO: 3619 - protein, 624 aa, Homo sapiens; identical to SEQ ID NO: 434

SEQ ID NO: 3620 - protein, 624 aa, Homo sapiens; identical to SEQ ID NO: 434

SEQ ID NO: 3621 - protein, 624 aa, Homo sapiens; identical to SEQ ID NO: 434

SEQ ID NO: 3622 - protein, 610 aa, Uncinocarpus reesii
MAFSSAMFSAEAERILENAKERLTHMEGNLSKARKSIGLCLSATSTTANATKANCYPKATLEVGRRAHSSLAGTLLHRQFSDDFNNSNLRDVQESNNSSNYSGSPGRPPETEVKHYRPFSALASASGCTTETVRTGPSDWGDLNRDHERSHRFSTSLHHPHLSALTTKDCREPFSARSQPITLTSKARLADRGERLAFLEDFNNPYASNPPSRSQSQFEIRGLQDQMHGLRTKLSTLKDKTLEDQTRRHSLQNFAESGCYFATPGSPQEFSEQPTGGEVARCNAGTDHEQEDPALLHVSEKNKNCQPESAYDDALSPDEFQQVDPDDFAGTISPRSWVYTKKTEKVRELVPILPVVETLPHEDRVDAFDYERFILHSALGNYDGSKSCRQSYSSTESRETTKPHPHDSDYPDYETAKYYSSSNSSSPVSTMVTTLGTSTEGSDPDDSEQHRSDDISPPPYWKWENTDFKMIEEDMPPRTRLSSITCNRSPFPDLEKHSETDTRTEINSASADISKTNNPRSTAPAADGTFFLLKSLLEHTADRPNCEIQNMLFHEDAKLMRLVFHSLGRVGLQLGSASAASKAHCDEATASLLRNRLDTALRVLEGELDI

SEQ ID NO: 3623 - protein, 438 aa, Homo sapiens; identical to SEQ ID NO: 1362

SEQ ID NO: 3624 - protein, 438 aa, Homo sapiens; identical to SEQ ID NO: 1362

SEQ ID NO: 3625 - protein, 430 aa, Dictyostelium discoideum; identical to SEQ ID NO: 3605

SEQ ID NO: 3626 - protein, 425 aa, Penicillium chrysogenum; identical to SEQ ID NO: 3410

SEQ ID NO: 3627 - protein, 419 aa, Drosophila yakuba; identical to SEQ ID NO: 3575

SEQ ID NO: 3628 - protein, 511 aa, Lachancea thermotolerans; identical to SEQ ID NO: 3523

SEQ ID NO: 3629 - protein, 440 aa, Postia placenta
MSLSYVASSIRRTPVLSSRLVGRCPTKSLDRLVKRAASTSTKFVKFAWEDPLDLESLLTEEEVAIRPVRRTHAFDETAIANENLLPRVLEGQRTENYDHGILPEMGALGLLGPTIQGYGCAGVSSVAYGLIAREVERVDSGYRSTSSVQSSLVMHPIHEFGSDVQKEKYLPRLAKGELVGCFGLTEPNHGSDPAGMETTAEETDGGFVINGAKTWITNSPIADIFIIWARAKWDGKIHGFVLEKGMEGLSAPAIKHKLALRCSATGSIFMDNVKVGHDAILPHGSGMGAPFSCLNSARYGISWGAIGALEDSIARTRAYALERHQFKRPLASFQLVQKKLVDAHTEAALGLQASLQVGRLKDAGKLAPEMISMVKRNNCGKALEHSRRLLDILGGNACSDEYHVGRHAANLQIVNTYEGTYDIHTLILGKAITDIAAFAN

SEQ ID NO: 3630 - protein, 424 aa, Perkinsus marinus; identical to SEQ ID NO: 3588

SEQ ID NO: 3631 - protein, 424 aa, Perkinsus marinus; identical to SEQ ID NO: 3589

SEQ ID NO: 3632 - protein, 418 aa, Drosophila pseudoobscura; identical to SEQ ID NO: 3530

SEQ ID NO: 3633 - protein, 515 aa, Saccharomyces cerevisiae; identical to SEQ ID NO: 3544

SEQ ID NO: 3634 - protein, 440 aa, Postia placenta; identical to SEQ ID NO: 3629

SEQ ID NO: 3635 - protein, 419 aa, Drosophila sechellia; identical to SEQ ID NO: 3564

SEQ ID NO: 3636 - protein, 419 aa, Drosophila mojavensis; identical to SEQ ID NO: 3572

SEQ ID NO: 3637 - protein, 871 aa, Pelotomaculum thermopropionicum; identical to SEQ ID NO: 3528

SEQ ID NO: 3638 - protein, 409 aa, Caenorhabditis elegans; identical to SEQ ID NO: 2082

SEQ ID NO: 3639 - protein, 418 aa, Monosiga brevicollis
MAAALTARQLVLRATSRRALSSAAPLQARRMDWQDPFELDSQLTSEELMAKNTAREYCEASLQPRIIEAYRTETFDRSIMNEFGELGMLGSTIDGYGCPGMSYVAYGLLAREVERVDSAYRSAMSVQSSLVMYPIHAYGTEAHKEKYLPRLATGELVGAFGLTEPDHGSDPGSMATKAKAVDGGYLLNGSKTWITNAPIADVFIIWANLDGDIRGFVVERDGSEGLTTPKIEGKLSLRASITGQIMLDNVFVPEENLFPTVKGLKGPFGCLNNARYGIAWGALGAAESCFEVARQYTLDRQQFGRPLAANQLMQKKFADMLTEINIGLQACLRVGRLREEHGEFTPDLVSMIKRNSCGKALDIARMTRDMLGGNGISEDYHVLRHAINLETVNTYEGTHDIHALILGRAITGLQSFKP

SEQ ID NO: 3640 - protein, 472 aa, Trypanosoma cruzi
MRTGRRQRMALSLFFSLPFTPLTFRSRFCLFFFLFFSCGCSILFLFFSFRSMLCRFFCARRTAIAVRCHGGVLDCARRCGSFNYAEYNDGDPLLLQEQLTDSEVEIRRVVREFCKKTLLPRVTDAYRNEREDRKIFRELGALGVLGPTIEGYGCAGISSVAAGLISREIEAIDSGYRSAWSVQSSLVMHPIYAFGSDAQKQRFLPKLATGELIGCFGLTEPNAGSDPMSMTTRARKVAGGYSLSGCKTWITSAPLADIAVVWAKLHDTNKIAGFIVERDFKGFATERIEGKLSLRTSCTGMIVLDNCIVPEENVLPHATGLKAPFNCLSSARYGIAWGVVGAAETCFNIARDYSLERKQFGKSIASMQLVQAKLADAVTEITLAMQSCLRAGRLKDEGKLSHQVISMLKRNNTRKAIEIARAMRDILGGNGISDEYHVMRHVCNLETVLTYEGTYDIHGLILGRSITGMSAF

SEQ ID NO: 3641 - protein, 472 aa, Trypanosoma cruzi
MYKKKKCRKGQKKRGYESRLSSTNGAVAFFSLPFTPLTFRSRFCFLFSFRSMLCRFFCGRHTAIAARCHGAVLDCARRCGSFNYAEYNDGDPLLLQEQLTDSEVEIRRVVREFCKKTLLPRVTDAYRNEREDRKIFRELGALGVLGPTIEGYGCAGISSVAAGLISREIEAIDSGYRSAWSVQSSLVMHPIYAFGSDAQKQRFLPKLATGELIGCFGLTEPNAGSDPMSMTTRARKVAGGYSLSGCKTWITSAPLADIAVVWAKLHDTNKIAGFIVERDFKGFATERIEGKLSLRTSCTGMIVLDNCIVPEENVLPHATGLKAPFNCLSSARYGIAWGVVGAAETCFNIARDYSLERKQFGKSIASMQLVQAKLADAVTEITLAMQSCLRAGRLKDEGKLSHQVISMLKRNNTRKAIEIARAMRDILGGNGISDEYHVMRHVCNLETVLTYEGTYDIHGLILGRSITGMSAF

SEQ ID NO: 3642 - protein, 453 aa, Trypanosoma cruzi
MQGENSTMSASGVGILHFDDVRIAVSALLLPSRIVDGGVLITEDADTSTSLQALTLQMRLATAALYAGALKRFLTNVVFFIAQKDVVGPDGRRDYPFFGVQHVQTPLVKIIAKSYVYLADWRRILSVFSKSTERRPTYEDETRLAGTIHFLQETLLELHRFVDEFMGVHASLGSTGNSDAIVMAHLRQEGADQSSLIREVAFRSVTKNIGTSHWGWWLSSLLQPFAALDRFVKNPFYSPRIADLGRHLIFFSHKHYAAKKRLRHSREIERRKGGAEHQWYDWVMFRHQQVLHCGEAYMEMFSMEVMMAETQACTDPRARKIFRDIGWIYALARQQDRLDYILTQQMISPGKSNVLESHLDNLVTVLAPQCVNLVDAFQVPDAFRSPCAAKTLESYWTIPGTNTGIQRGDRVTLFHDKKSTGDAKEEQENMQESEEEWDLFHGLAELPSFAQKK

SEQ ID NO: 3643 - protein, 420 aa, Drosophila willistoni; identical to SEQ ID NO: 3570

SEQ ID NO: 3644 - protein, 419 aa, Drosophila simulans; identical to SEQ ID NO: 3569

SEQ ID NO: 3645 - protein, 419 aa, Drosophila virilis; identical to SEQ ID NO: 3571

SEQ ID NO: 3646 - protein, 420 aa, Drosophila grimshawi; identical to SEQ ID NO: 3573

SEQ ID NO: 3647 - protein, 419 aa, Drosophila erecta; identical to SEQ ID NO: 3498

SEQ ID NO: 3648 - protein, 419 aa, Drosophila ananassae; identical to SEQ ID NO: 3576

SEQ ID NO: 3649 - protein, 415 aa, Culex quinquefasciatus; identical to SEQ ID NO: 3611

SEQ ID NO: 3650 - protein, 520 aa, Aspergillus fumigatus; identical to SEQ ID NO: 3534

SEQ ID NO: 3651 - protein, 700 aa, Streptomyces albus
MPDTTSALGAPTERREGPAKVTGAAPYAAEHTPEGCAYAWPVPATVARGEITSVDDTAALAVPGVVGVLTHLNAPRLAEADDAILAVLQDARVPHRGWYVALVVADTLEAAREGAAAVTVTYSEEPHDVTLDAGSPAAYVPEDPDGNPDEHTRGDPDAALAAAPTQVDVTYEVPPLHNHPMEPHAATAHWQDGRLTAYDSSQGATAVRQTLASLFKLPEEQVTVVSEHVGGGFGAKGTPRPHVVLAAMAARETGRPVKLALPRRHLATVVGHRSPTVQRLRLGAEADGTLTSVIHEVTSYTSRIKEFVETGAAVSRVMYPSPHARTGHRVLPLDVPSPSWMRAPGEAPGMYALESAMDELAVALGMDPVELRLRNDTDKEPDSGKPFSSRHLAECLREGARRFGWAERDPRPRSRTEGPLLIGTGVAAATYPVLVSPSRASARAYPDGGYVVRVNATDIGTGARTVLAQVAADALGVPVDRVRTEVGSTDLPAAPLAGGSSGTASWGWAVHEACTRLAERLAGQREQRLPPEGVGASADTEGTSDTNYAESDYARHAFGAHFAEVGVDSVSGEVRVRRLLGVYAAGHILNARTARSQFIGGMTMGLGMALTEHSTMDEPFGDFAESDLASYHVPVHADVPAIEAHWIDEDDPHLNPMGSKGIGEIGIVGTAAAIGNAVHHATGVRVRELPVTPDKILTGS

SEQ ID NO: 3652 - protein, 418 aa, Monosiga brevicollis; identical to SEQ ID NO: 3639

SEQ ID NO: 3653 - protein, 409 aa, Unknown; identical to SEQ ID NO: 2082
  Description of Unknown: Coenzyme A polypeptide

SEQ ID NO: 3654 - protein, 438 aa, Homo sapiens; identical to SEQ ID NO: 1362

SEQ ID NO: 3655 - protein, 438 aa, Macaca fascicularis; identical to SEQ ID NO: 1920

SEQ ID NO: 3656 - protein, 447 aa, Rattus norvegicus; identical to SEQ ID NO: 2650

SEQ ID NO: 3657 - protein, 447 aa, Mus musculus
MVPAMLTGYMSLRGVSAQLLSRRSGLRFPRFPRTWSSAAAHTEKTQIRPAKSSRPVFDWKDPLILEEQLTADEKLIRDTFRNYCQERLMSRILLANRNEVFHRDIVYEMGELGVLGPTIKGYGCAGVSSVAYGLLTRELERVDSGYRSMMSVQSSLVMHPIYTYGSEEQRQKYLPGLAKGELLGCFGLTEPNHGSDPGGMETRARHNPSNQSYTLSGTKTWITNSPVADLFIVWARCEDNCIRGFILEKGMRGLSAPRIEGKFSLRASATGMIIMDSVEVPEENVLPNVSSLAGPFGCLNTARYGITWGVLGAAEFCLHTARQYALDRIQFGVPLARNQLVQKKLADMLTEITLGLHACLQLGRLKDQDKATPEMVSMLKRNNCGKALDIARQARDILGGNGISDEYHVIRHAMNLEAVNTYEGTHDIHALILGRAITGIQAFTVGK

SEQ ID NO: 3658 - protein, 454 aa, Mus musculus
DAQPFQVMVPAMLTGYMSLRGVSAQLLSRRSGLRFPRFPRTWSSAAAHTEKTQIRPAKSSRPVFDWKDPLILEEQLTADEKLIRDTFRNYCQERLMSRILLANRNEVFHRDIVYEMGELGVLGPTIKGYGCAGVSSVAYGLLTRELERVDSGYRSMMSVQSSLVMHPIYTYGSEEQRQKYLPGLAKGELLGCFGLTEPNHGSDPGGMETRARHNPSNQSYTLSGTKTWITNSPVADLFIVWARCEDNCIRGFILEKGMRGLSAPRIEGKFSLRASATGMIIMDSVEVPEENVLPNVSSLAGPFGCLNTARYGITWGVLGAAEFCLHTARQYALDRIQFGVPLARNQLVQKKLADMLTEITLGLHACLQLGRLKDQDKATPEMVSMLKRNNCGKALDIARQARDILGGNGISDEYHVIRHAMNLEAVNTYEGTHDIHALILGRAITGIQAFTVGK

SEQ ID NO: 3659 - protein, 430 aa, Macaca fascicularis
MALRGVSVQLLSRVPGLRVFRTWVSSAAQTEKGGRTQSQLAKSSRPEFDWRDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPRLAKGELLGCFGLTEPNSGSDPSSMETRARYNSSNKSYTLNGTKTWITNSPMADLFVVWARCEDGRIRGFLLEKGMRGLSAPRIQGKFSLRASATGMIIMDGVEVPEENMLPGASSLGGPFGCLNNARYGIAWGVLGASEFCLHTARQYALDRMQFGVPLARPIRAQNSEAPFWREAWLDRLKDQDKAAPEMVSLLKRNNCGKALDIARQARDMLGGNGISDEYHVIRHAMNLEAVNTYEGTHDIHALILGRAITGIQAFTASK

SEQ ID NO: 3660 - protein, 446 aa, Strongylocentrotus purpuratus
MSRLVVETIIQFLYGGAASLSDDVNLRDLLGAADMYGLEGLKEVTAFHLKRDWCHLFHKPLCAECSALVPHCYALSESFGLPDLSQMCLRWMSKNMDRFWVQKTFSNLPPEMHEKCSKDVMEILNGKNAIEVLFQLDKIKLGLPLGHSSWAEPAKEITSKTWKQVLQFAASYFHDIVDGSMFEDKYLKGMGWKKDVMEPLFRKVVAGLSLGNADLNFRAVWRLYKRERTDKEKEDGKTPEEEWNPDAYTAFGGFYDKIYNYVVSNASYIVNTEVFKQLPEDLQKQIRKDAVYVDTGMSKTLKKPVLSSSQRPKSAQVRRTLSHPLRASSPASSTSSASSVSSAPSSSRRGGGGTGSARGARGSSRGAAGSSRGAGGSSRGTNGPARGAESGSARATGRGGAAGRGADGLARGNGTGRSRGEEAGAAGVGGAQRPTRPRDGRHPPGR

SEQ ID NO: 3661 - protein, 446 aa, Strongylocentrotus purpuratus; identical to SEQ ID NO: 3660

SEQ ID NO: 3662 - protein, 472 aa, Trypanosoma cruzi; identical to SEQ ID NO: 3640

SEQ ID NO: 3663 - protein, 472 aa, Trypanosoma cruzi; identical to SEQ ID NO: 3641

SEQ ID NO: 3664 - protein, 453 aa, Trypanosoma cruzi; identical to SEQ ID NO: 3642

SEQ ID NO: 3665 - protein, 439 aa, Artificial Sequence; identical to SEQ ID NO: 3612
  Description of Artificial Sequence: Synthetic construct

SEQ ID NO: 3666 - protein, 439 aa, Artificial Sequence; identical to SEQ ID NO: 3612
  Description of Artificial Sequence: Synthetic construct

SEQ ID NO: 3667 - protein, 438 aa, Artificial Sequence; identical to SEQ ID NO: 1362
  Description of Artificial Sequence: Synthetic construct

SEQ ID NO: 3668 - protein, 438 aa, Artificial Sequence; identical to SEQ ID NO: 1362
  Description of Artificial Sequence: Synthetic construct

SEQ ID NO: 3669 - protein, 436 aa, Unknown; identical to SEQ ID NO: 354
  Description of Unknown: Coenzyme A polypeptide

SEQ ID NO: 3670 - protein, 667 aa, Unknown
  Description of Unknown: Acyl-CoA oxidase polypeptide
MDASAEVDHLAAERSAARFDVEAMKVAWAGSRHAVEVGDRMARLVASDPVFRKDNRTMLSRKDLFKDTLRKAAHAWKRIVELRLTEEEAGMLRLYVDQPGYVDLHWGMFVPAIKGQGTEEQQKKWLPMAYKFQIIGCYAQTELGHGSNVQGLETTATFDPKTDEFVIHSPTLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTREGKYVHSDVPKQLLYGTMVFVRQTIVADASKALSRAVCIAVRYSAIRKQFGSQDGGPETKVLDYKTQQSRLFPLLASAYAFRFVGDWLKWLYMDVTQKLEAKDYSTLQEAHACTAGLKAVTTSATADAIEECRKLCGGHGYLNSSGLPELFAVYVPACTYEGDNIVLLLQVARILMKTVSQLTSGKQPVGTMAYMGNVQYLMQCKCAVNTAEDWLNPVAIQEAFEARALRMAVNCAQNIGQAANQEEGFYERSPDLLEAAVAHIQLVIVTKFIAKVQQDIPGPGVKEQLQNLCNVYALYILHKHLGDFLATGCITPKQGALANEQLGKLYAQVRPNAVALVDAFNYTDHYLGSVLGRYDGNVYPALYEEAWKDPLNETVVPEGYHEYLRPLLKQQLKLSRL

SEQ ID NO: 3671 - protein, 451 aa, Unknown
  Description of Unknown: Acyl-CoA oxidase polypeptide
GPEFPGRPTRPIVFCQLHINGRNEGVHAFVAQIRDEDGTVLPNIHIADCGHKIGLNGVDNGRIWFQNIRVPRENLLNLVADVLPDGRYVSMIDNPDQRFAAFLSPLTLGRVNIAVNSVYISKVSLAIAVRYSLSRRAFSIAPDAPEMLLLDYPSHQRRLLPLLAKVCLMSSAGNFMKNMYVKRTPEMSKDIHIYSSALKATLTWQNMITIQECREACGGQGLKTENRIGIFKSEFDVQSTFEGDNNVLMQQVSKALYAEFLGAQKKQQPFKGLGLEHLNGSSPVIPDKLTSSILRSSKFQMDLFCLRERDLLKQFVEEVSLHLAQGESREKALMLSYQVAEDLARAFTERTILQIFLEDEMNVPSGSLKEVLGLLRSLYVMVNIDESTSFLRYGHLSRDNVALVRKEVLKLCSELRPHALAVVSSFGIPDAFLSPLAFDWIEANALSTGSH

SEQ ID NO: 3672 - protein, 502 aa, Unknown
  Description of Unknown: Acyl-CoA oxidase polypeptide
SARAQSLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTREGKYVHSDVPKQLLYGTMVFVRQTIVADASKALSRAVCIAVRYSAIRKQFGSQDGGPETKVLDYKTQQSRLFPLLASAYAFRFVGDWLKWLYMDVTQKLEAKDYSTLQEAHACTAGLKAVTTSATADAIEECRKLCGGHGYLNSSGLPELFAVYVPACTYEGDNIVLLLQVARILMKTVSQLTSGKQPVGTMAYMGNVQYLMQCKCAVNTAEDWLNPVAIQEAFEARALRMAVNCAQNIGQAANQEEGFYERSPDLLEAAVAHIQLVIVTKFIAKVQQDIPGPGVKEQLQNLCNVYALYILHKHLGDFLATGCITPKQGALANEQLGKLYAQVRPNAVALVDAFNYTDHYLGSVLGRYDGNVYPALYEEAWKDPLNETVVPEGYHEYLRPLLKQQLKLSRL

SEQ ID NO: 3673 - protein, 630 aa, Unknown
  Description of Unknown: Acyl-CoA oxidase polypeptide
MAEVDHLAAERATARFDVEEMKVAWAGSRHAVHVADRMARLVASDPVFRKDNRTMLSRKELFKDTLRKAAHAWKRIVELRLTEEEANLLRQYVDQPGYVDLHWGMFVPAIKGQGTEEQQHKWLPLAYKFQIIGCYAQTELGHGSNVQGLETTATFDPKTDEFVIHSPTLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTREGKYVHSNVPKQLLYGTMVYVRQSIVADASKALSRAVCIAVRYSAVRKQFGSQDGGPETQKLEAKDFSTLQEAHACTAGLKAVTTSVTADAIEECRKLCGGHGYLNSSGLPELFAVYVPACTYEGDNVVLLLQVARILMKTVSQLASGKQPVGTMAYMGKVQYLMQCKSAVSSAEDWLNPDAIQEAFEARALRMAVNCAQNISQAASQEEAAGFYERSPDLLEAAVAHIQLIIVTKFIEKVHQEIPGHGVKEQLQALCNVYALYILHKHLGDFLATGCITPRQGALANEQLSKLYAQVRPNAVALVDAFNYTDHYLGSVLGRYDGDVYPALYEEAWKDPLNETVVPEGYHEYLRPLIKQQQLKLSRL

SEQ ID NO: 3674 - DNA, 726 bp, Candida sp.
atgtccgacgaggaatcagatatcttatacgaggtcagagacagaaccgccatcatcaccttgaacatccccaagagattgaacgcattgaacggtgctcaatacttgaagttgggtaagttcttggagagagccaacaacgaagaggacaccgtcttgacattgatccaggccctgggcagattcttctccgccggtgccaatttcgccgacaacgatatggccaaggtcgaaatgtccaagttgttcagtcacgagtactggttggaaagattcgtcgccagaaacatctggttgaccaacttgttcaacgaccacaagaagatcttggctgctgctgtcaatggtccagttatcggtttgagcactggtttgttgttgttggtcgatttggtctacgtccacgacttgaacaagttctacctcttggccccatttgccaacttgggtttggttgccgaaggtgcttcctctgccactttgttcaacagattgggctggtcaaaggcttctgaggccttgttgttggccaagccaatcggcggccaagactgttacaacgccggtttcatcaacaagcactacgacggtaagttttcctccactgaagagttcaacgaacacgtctacaaggagttgacggaagcttttgaaaacttgcacgatgactccattttgcagaacaagcaattgttgaagttgtccagagaccaggccatcaactag

SEQ ID NO: 3675 - protein, 241 aa, Candida sp.
MSDEESDILYEVRDRTAIITLNIPKRLNALNGAQYLKLGKFLERANNEEDTVLTLIQASGRFFSAGANFADNDMAKVEMSKLFSHEYWLERFVARNIWLTNLFNDHKKILAAAVNGPVIGLSTGLLLLVDLVYVHDLNKFYLLAPFANLGLVAEGASSATLFNRLGWSKASEALLLAKPIGGQDCYNAGFINKHYDGKFSSTEEFNEHVYKELTEAFENLHDDSILQNKQLLKLSRDQAIN

SEQ ID NO: 3676 - DNA, 807 bp, Candida sp.
atgtccgacgaccttatcacctacgaagtcaaagaccgagctgccgtgatcaccttgaacaaccccaagaagctcaacgccttatcgatcccgcagtacgacaccatctgcaagctcttagaacgagccaacgccgaagaagacaccgtcatcaccttgctccagtccacgggccgggtgttctctgccggggccaacgccgactccatcgtggggcaggatgccgagctcgagacctggttgaacatgtcggtggccaagcagacgttcttggtgcagacgttcctcgcacacaagaagatccttgccgtcgccttgaacggccccgtgattggcttatcggcggcgttcgtggcgctctgcgacttggtctacgtgcacaacgccgcaaagacgttcttcttgaccccgttcgccaacatcgggatccttgccgagggcggcacctcagccacgttgcccatgcgcgtggggtggtccagggccgcggaagcgttgttgttgtcaaagaggatttcgggagatgacttgcagagagcggggttcttcaataaggactacaaggggcagttcaagtccgcggaggagtttaacgaggtcgtcttgaaggagttgcttgacgccacggaaaacttgcatgaggactcgatcatccagaacaaggagttgttgaaggctattttcaagccaaagatcagtgaggtcaactcgcaggaggtgtcaagaggtgtgtacaagtggacctctggggtgccaatggatagatttaaaaaattgcttaatggtgagttgaaacataaattatag

SEQ ID NO: 3677 - protein, 268 aa, Candida sp.
MSDDLITYEVKDRAAVITLNNPKKLNALSIPQYDTICKLLERANAEEDTVITLLQSTGRVFSAGANADSIVGQDAELETWLNMSVAKQTFLVQTFLAHKKILAVALNGPVIGLSAAFVALCDLVYVHNAAKTFFLTPFANIGILAEGGTSATLPMRVGWSRAAEALLLSKRISGDDLQRAGFFNKDYKGQFKSAEEFNEVVLKELLDATENLHEDSIIQNKELLKAIFKPKISEVNSQEVSRGVYKWTSGVPMDRFKKLLNGELKHKL

SEQ ID NO: 3678 - DNA, 1266 bp, Yarrowia lipolytica
atgttgtccattcgatccattacccgatctctccccattggcagccgaatctgccagcagagtgccatgaaggcctctactgtgcgacctctcgccttgagagcttactccacccgaccccctgtcactcacttctccgaggaggaggagatgtttcgtgacatggttagcaagtttgctgatgaggtgattgctcccaaggtccgtgagatggacgaggccgagcagatggacaagacaatcatccaggacatgttcgacaatggccttatgggcatcgagactcccgaggagttcggtggtgcaggtgccaacttcacctctgctatcatcgtcgttgaggagcttgccaaggtggacccctcagtgtctgtgatgaacgatgtccacaataccctcgtcaacacctgcatccgatcctggggatccgacgcactccgaaacaagtatctcccccagcttgctgcccagaaggtcggatctttcgctctttctgagccctcttccggatctgatgccttcgccatgaagtctcgagccacaaagactgacgatggatacattttgaacggttccaagatgtggatcaccaacgctgccgaggctgagcttttcattgtttttgctaatctcgatcccagcaagggctacaagggtattactgcctttgttgtcgagaaggacatgggagtgcagattgctaagaaggagcagaagctgggtatccgagcctcttctacctgcgttctcaacttcgaggacgttttcattcctaaggagaaccttcttggcgaggagggcaagggctacaagattgctatcgagtgcttgaacgagggccgaatcggaattgcggcccagatgcttggccttgctggtggagctttcaagaaggctaccggctatgctttcaacgacagaaagcagttcggccagtacatcggtgagttccagggtatgcagcaccagattggccaggccgctactgagatcgaggctgctcgactcctggtctacaacgctgcccgactcaaggaggctggcgttcctttcacaaaggaggctgctatggcaaagctctatgcttcccaggttgcaggaaacgtcgcatccaaggctgtcgaatggatgggtggtgtcggattcactcgagaggagactctggagaagttcttccgagattctaagatcggtgccatttacgagggaacttccaacatccagctgcagactattgccaagatcatccagaaggagtctgcctaa

SEQ ID NO: 3679 - protein, 421 aa, Yarrowia lipolytica
MLSIRSITRSLPIGSRICQQSAMKASTVRPLALRAYSTRPPVTHFSEEEEMFRDMVSKFADEVIAPKVREMDEAEQMDKTIIQDMFDNGLMGIETPEEFGGAGANFTSAIIVVEELAKVDPSVSVMNDVHNTLVNTCIRSWGSDALRNKYLPQLAAQKVGSFALSEPSSGSDAFAMKSRATKTDDGYILNGSKMWITNAAEAELFIVFANLDPSKGYKGITAFVVEKDMGVQIAKKEQKLGIRASSTCVLNFEDVFIPKENLLGEEGKGYKIAIECLNEGRIGIAAQMLGLAGGAFKKATGYAFNDRKQFGQYIGEFQGMQHQIGQAATEIEAARLLVYNAARLKEAGVPFTKEAAMAKLYASQVAGNVASKAVEWMGGVGFTREETLEKFFRDSKIGAIYEGTSNIQLQTIAKIIQKESA

SEQ ID NO: 3680 - DNA, 1593 bp, Yarrowia lipolytica
atgagcgagcagtacacccccgaacaagttgcggagcacaactctcccgaatctctgtggatcatcattgacggtaacgttttcgacctcactgaattccagaaagaacaccccggcggaaaaaagattctcaaacgagtcgcaggaaaagacgctaccaagtttttccacaaataccacgacgcccccaagattatgcgaaaggttggacacaagttcaagatcggaacccttaaagacgctgaagcaaaccccactcgagccatgattgcccctaacaagaccaccgccctcgagccctacggagaccttgtcccctacgccgaccccaactggtaccacggctaccacaacccctactacaaggagtcccacgccaagctgcgtgacgaggtccgacagtgggttgaggagaagattgagcccttcgttgaggaatgggatgaggagaaggaggttcccaaggagatcttccaggagatgggcaagcgaggttaccttgccggctctctcggcaccccctacaaggagctggccaagtacaccaacgtcaagcccgcctctgtgcccattgaggagtacgacatgttccacgagctcatcatcaccgacgagatcatgcgagctggctccggaggtctcacctggaacctgcttggtggctactgtattggtctgcctcccgtgatcaagttcgccaaggagccccttaaggagcgaatcctccccggcctgctcgacggttccaagcgaatctgtctgtgtatcactgagcccgacgctggctccgatgttgccaacatcaccactaccgccgagaagacccccgacggaaagttctacattgtcaacggtatcaagaagtggatcaccaacggtatctgggctgactacttcactgttgccgtccgaaccggtggccccggctctggcatgaacggtatctctgttctgctgctcgagcgaggcatggagggtcttgagacccgacgaatgaacactcagggtatgctgtcttccggctctacctgggtcaccatggaggatgtcaaggtccccgtggagaacctgctcggcaaggagaacaagggtttcaaggtcatcatgaccaacttcaaccacgagcgagttggtatcatcatccaggcaaaccgagcttctcgagtttgctacgaggaggcctgcaagtacgcccacaagcgaaagactttcggcaagcctctgattgagcaccccgtcatccgagccaagctcgccaacatggccattcgaatcgagtccacccacgcctggctcgagaacctggtcttccagtgccagatgttccccgaggaggaggccatgcttcgacttggtggtgccattgctggttgcaaggcccaggccacccagaccctcgagctgtgtgcccgagaggcttcccagatctttggtggtctttcctacacccgaggcggtctcggaggtaaggttgagcgactgtaccgagaggtccgagcctacgccatccccggtggatccgaggagattatgctggatctggccatgcgacaggccctcaaggtccacaaggctgttggcgccaagctttaa

SEQ ID NO: 3681 - protein, 530 aa, Yarrowia lipolytica
MSEQYTPEQVAEHNSPESLWIIIDGNVFDLTEFQKEHPGGKKILKRVAGKDATKFFHKYHDAPKIMRKVGHKFKIGTLKDAEANPTRAMIAPNKTTALEPYGDLVPYADPNWYHGYHNPYYKESHAKLRDEVRQWVEEKIEPFVEEWDEEKEVPKEIFQEMGKRGYLAGSLGTPYKELAKYTNVKPASVPIEEYDMFHELIITDEIMRAGSGGLTWNLLGGYCIGLPPVIKFAKEPLKERILPGLLDGSKRICLCITEPDAGSDVANITTTAEKTPDGKFYIVNGIKKWITNGIWADYFTVAVRTGGPGSGMNGISVLLLERGMEGLETRRMNTQGMLSSGSTWVTMEDVKVPVENLLGKENKGFKVIMTNFNHERVGIIIQANRASRVCYEEACKYAHKRKTFGKPLIEHPVIRAKLANMAIRIESTHAWLENLVFQCQMFPEEEAMLRLGGAIAGCKAQATQTLELCAREASQIFGGLSYTRGGLGGKVERLYREVRAYAIPGGSEEIMLDLAMRQALKVHKAVGAKL

SEQ ID NO: 3682 - DNA, 1254 bp, Yarrowia lipolytica
atgcttaccagaatctcccgtttggcacctgctgcccgaggctttgctacctcctccgtcaaccgatccacagccgccatggactggcaggatcccttccagctggactctcttctcaccgaggacgagattgccgtggctgaggctgctcgagacttctgccagacagagctctaccccaaggtacttgagggctaccgaaccgaggagttcccccgaagcatcatgaagcagatgggtgaggttggtctgctcggaacaaccgtcaagagccacggatgccccggcatgtcttctgtcgcttacggtctcgtggcccgagaggtcgagagggtcgactccggctaccgatctgccatgtctgtgcagtcgtcgctggtcatgcaccccattgaacagtttggatcccaggagcagaaggaccggttcctgcccaaattggcctccggcgagatgatcggctgcttcggtctcaccgagcctaaccacggttccgaccctggatccatggagaccgtcgccaagatgcaccctactaagaagggcgtcattgtgctcaatggagccaagaactggatcactaactctcctattgccgatctcatggttgtgtgggccaagttggacggtaagatccgaggcttccttgtcgagcgatctcaggtcgcctccggcctcgctactcccgccatcaagaacaagaccgctctgcgagcctccatcaccggtatgatccagatggacgacgttgagatccctgtggagaacatgttccccgaggtgaccggtctcaagggccccttcacctgcctcaactctgcccgatacggtatcgcctggggaaccatgggcgctctgtccgagtccatcaagctcgctcgagagtactctctggaccgaaagcagtttaagggccagcctctggccaagtaccagctcatccagaagaagctcgctgacgctctgaccgatgccacctacggacaggtcgctgccattcaggtcggccggctcaaggatgccggcaattgtcctcccgagctcatctccatgattaagagacagaactgtgaccgagccctcgctggcgctcgaaacctgatggagatctttggcggtaacgctgcctctgacgagtaccacattggccgaattgccgccaacctgtgggttgtccagacctatgagggccagtctgatatccatgctctcatcctgggaagagccatgaccggcgtccaggcttttgcttaa

SEQ ID NO: 3683 - protein, 417 aa, Yarrowia lipolytica
MLTRISRLAPAARGFATSSVNRSTAAMDWQDPFQLDSLLTEDEIAVAEAARDFCQTELYPKVLEGYRTEEFPRSIMKQMGEVGLLGTTVKSHGCPGMSSVAYGLVAREVERVDSGYRSAMSVQSSLVMHPIEQFGSQEQKDRFLPKLASGEMIGCFGLTEPNHGSDPGSMETVAKMHPTKKGVIVLNGAKNWITNSPIADLMVVWAKLDGKIRGFLVERSQVASGLATPAIKNKTALRASITGMIQMDDVEIPVENMFPEVTGLKGPFTCLNSARYGIAWGTMGALSESIKLAREYSLDRKQFKGQPLAKYQLIQKKLADALTDATYGQVAAIQVGRLKDAGNCPPELISMIKRQNCDRALAGARNLMEIFGGNAASDEYHIGRIAANLWVVQTYEGQSDIHALILGRAMTGVQAFA

SEQ ID NO: 3684 - DNA, 1323 bp, Candida tropicalis
atgtcagtcaaagaagatatcccagctgtttttctttcccaaatttctcctcgtggtcttgaagctatccagaaaaccaaagactttgtcaatgactactgtattccagccgatgaaatctacttcaaacaggtctctactgatcctgccaaaagatggaaaacaatcccacctattattgagacattgaaatccaaagccaaagaacttggtttatggaatatgtttttatccaaacattataaggaaggtccacaatataccaacttagaatatggtttgatggctagatatttgggtcgtgcacacactgctcctgaagctactaatactgctgctccagatactggtaacatggaattacttgctaaatacggtactccataccaaaaagaaaagtacttacaaccattgttagatggaaagatcagatctgctttcttgatgaccgaaaagggcacatcatcttccaatgcattaaatatctccactagtgccaaaaagaatgccagtggtaactatgttcttgatggtgtaaagtggtttgcttcaggtgctggtgatccaaggtgttctgtttggttggtcatgtgtaaaactgaagacaataagaagaacccatatgcaaaccacaccgtgttggttcttgatgccaagagagcattggctagcggcagggccaaattagtcagacctttgcatgttattggatatgatgatgctcctcatggtcattgtgaaatttcttttgaaaactacgaagttcctgctgacgaaatgccaaatgctgttttggccggtattggaagaggatttgagttgattcagtctagattaggacctggtagaattcatcattgtatgagagctattggtacaggtgaaattgcattgttgatcattgctcatagagctaaccacagaatgatttttggaaaaccaatgaaagacagagaaggatttttgtctaagttcggtcagagcagaattgatattaccagatgcttgttattggtattaaatgctgctcataaaattgatatttccaacgcaaaggctgctcagaaagagattgccatggctaagattgaaacaccaagaaccatctctgatatccttgactggggtatccaagtttttggcgcagaaggggtctcacaagacacagacttagctagaatgtatgctctcaacagaaccttgagaattgctgatggtcctgatgaagctcacttggcacaattggcaagaaatgaggccaaaaaattcccagaggtcgatatcttctttgaacatgttgctagtcaacgtaataaattatag

SEQ ID NO: 3685 - protein, 440 aa, Candida tropicalis
MSVKEDIPAVFLSQISPRGLEAIQKTKDFVNDYCIPADEIYFKQVSTDPAKRWKTIPPIIETLKSKAKELGLWNMFLSKHYKEGPQYTNLEYGLMARYLGRAHTAPEATNTAAPDTGNMELLAKYGTPYQKEKYLQPLLDGKIRSAFLMTEKGTSSSNALNISTSAKKNASGNYVLDGVKWFASGAGDPRCSVWLVMCKTEDNKKNPYANHTVLVLDAKRALASGRAKLVRPLHVIGYDDAPHGHCEISFENYEVPADEMPNAVLAGIGRGFELIQSRLGPGRIHHCMRAIGTGEIALLIIAHRANHRMIFGKPMKDREGFLSKFGQSRIDITRCLLLVLNAAHKIDISNAKAAQKEIAMAKIETPRTISDILDWGIQVFGAEGVSQDTDLARMYALNRTLRIADGPDEAHLAQLARNEAKKFPEVDIFFEHVASQRNKL

SEQ ID NO: 3686 - protein, 440 aa, Candida albicans
MSVKEDIPAVFLEKVSPRGLEAIQKTKDFVNDYCLPADQIYFEQLSDIPSERWKSVPPVIETLKKKAKELGLWNMFLSKHYKEGPQYTNLEYGLMARYLGRSYTAPEATNTAAPDTGNMELFAKYGTTYQKDRYLKPLLNGEIRSAFLMTEKGVSSSNALNISTSAVKNSNGNYVLNGVKWFASGAGDPRCSVWLVMCKTDNNKQNPYQNHTVLIIDAKKALATGKAKLIRPLQVIGFDDAPHGHCEIQFQDYEVPADEMPNVVMAGVGRGFELIQSRLGPGRIHHCMRAIGAGEFALLRIAHRANHRLIFGKPMNQREGFLSRYGQSKIDIERCLLLVLNAAHKIDISNAKEAQKEIAMAKIETPRTISDILDWGIQVYGAEGMSQDTELARMYAHNRTLRIADGPDEAHLAQLARNEAKKFAKVDDFFANMETQRSKL

SEQ ID NO: 3687 - DNA, 1323 bp, Candida albicans
atgtcagttaaagaagacattcctgctgttttccttgaaaaggtttctcctcgtggtctcgaagccatccagaaaaccaaagatttcgttaacgattattgtcttccagccgatcaaatttattttgaacaactttcagacatcccatcagaaagatggaagagtgttcctcctgtcattgagacattgaagaagaaagccaaggaacttggtttatggaacatgtttttgtcaaagcattataaggaaggtccacaatatacaaacttagagtatggattgatggccagatacttgggtcgttcatacacagcaccagaggctaccaacacagctgctccagataccggtaatatggaattgtttgccaaatatggaaccacttatcagaaagatagatacttgaaacccttgttaaatggggaaattagatcagcattcttgatgacagaaaaaggtgtttcatcatctaatgctctcaatatttctacaagtgctgtcaagaattcgaatggaaattacgtgctcaatggtgtcaaatggtttgcttcaggtgcaggagatccaagatgttccgtctggttggtgatgtgcaagacagacaacaacaagcaaaatccatatcaaaaccacacagttttgatcatcgatgccaaaaaggctttggctactggaaaagccaaattgatcagaccattgcaggtcattggttttgatgatgctcctcatggacattgtgagattcaatttcaagattacgaagttcctgccgatgaaatgcctaatgttgttatggctggtgttggtagaggatttgagttgattcaatccagattgggtccaggtagaatccaccattgtatgagagctattggtgctggtgaatttgcattattgagaattgctcacagagcaaatcacagattgatttttggtaaacctatgaaccagagggaaggattcttatccagatacggacaaagcaaaatcgacattgaaagatgtttattgttggtgttgaatgctgctcacaaaattgatatttccaatgccaaagaagcacaaaaggaaattgctatggctaagattgagaccccgagaactatctctgatattctcgattggggtattcaagtttatggtgctgagggtatgtcacaagataccgagttggccagaatgtatgctcataacagaacattgagaatagctgatggacctgatgaagctcatttggcccaattggctagaaatgaagctaaaaagtttgcaaaagttgacgactttttcgccaacatggaaactcaacgtagcaaattataa

SEQ ID NO: 3688 - DNA, 1326 bp, Candida tenuis
atgacagaccttgacattccagcagtattccttgataagatctcaccacgtggcctcgaggcgatccgcaagacctacgactttgtgcataactactgtattcctgcggatgctctctactttgaccaaatttcccaggatcccgaacaaaggtggaaaaccactcctgaagtcactgaaaaattgaaacaaaaggccaaacaattaggtttgtggaacatgttcctctctaagcactataccgatggacctggctacacaaacttggagtatggccttatggcgcaattcttgggccggtcgttcgtggcacccgaggccaccaatacaggtgcacccgatacaggtaacatggagattctcgccaagttcggctcggcctatcaccgggagcagtacctccttccattgctccgcggtgagatccgctcggcgttcttgatgacagaaaaaggcacttcttcatccaatgccttgaacatctcatgctcggcccagaagaattcacacggcaactacgttctcaatggagtcaagtggtttgcctctggtgcaggtgatcctcggtgtcgcgtgtggttggtgatgtgcaaaaccgagtctctggacaacatctaccgtaatcacagtgtgttggtgttggatgcgaaaaaggctttagcttcaggaaaagccaaattgatccgaccactcagcgtgtttggctatgacgatgctcctcatggacactgtgaggtggagttcaacgactttgaggtgccagccgaggatatggataattctatccttggtaaggtgggtatgggatttgagatcatccagtctcgtttaggccctgggcgtattcaccactgtatgcgtcttattggtgccggagaatatgccttaatgagggcggtgctgagggctgccggcagagacattttcggcaagcccatggtgaagagagaatcatttctcaatgcttatggagagcataagctttcacttcagaaatgccgtcttttggtgcttaatgcagctcatcaaatcgatatttcgaatgctaagactgccaaaagagatatagccatggccaaaatcgagactcccagagcagtattgaagattcttgactggtgtattcaggtttatggggctgaaggagtgtctcaagacacagagcttgcaaagatgtatgctcacgctcggactttgagaatcgcagatggaccagatgaagcacaccttggacagcttgcacgggacgagtcaaagaagtttgcggaggtggtgaagtactttgagggacacaaggcacgtcaagaccaagtcctgaagttgtga

SEQ ID NO: 3689 - protein, 441 aa, Candida tenuis
MTDLDIPAVFLDKISPRGLEAIRKTYDFVHNYCIPADALYFDQISQDPEQRWKTTPEVTEKLKQKAKQLGLWNMFLSKHYTDGPGYTNLEYGLMAQFLGRSFVAPEATNTGAPDTGNMEILAKFGSAYHREQYLLPLLRGEIRSAFLMTEKGTSSSNALNISCSAQKNSHGNYVLNGVKWFASGAGDPRCRVWLVMCKTESSDNIYRNHSVLVLDAKKALASGKAKLIRPLSVFGYDDAPHGHCEVEFNDFEVPAEDMDNSILGKVGMGFEIIQSRLGPGRIHHCMRLIGAGEYALMRAVSRAAGRDIFGKPMVKRESFLNAYGEHKLSLQKCRLLVLNAAHQIDISNAKTAKRDIAMAKIETPRAVLKILDWCIQVYGAEGVSQDTELAKMYAHARTLRIADGPDEAHLGQLARDESKKFAEVVKYFEGHKARQDQVSKL

SEQ ID NO: 3690 - DNA, 1398 bp, Kluyveromyces lactis
atgcctaatgtcagtgatagaccgcggacatataagaaacctgctttagaagatgttgatcccatcacaaactatatacctgccagtgttagggataaatttgatgagaggcagatggatcggttcaagaagttgcggaaatttgttgagtttgaatgtttgccattagatacggtgtatttgcaagagagtaccctatttgagcatgaaagcgatttagagacgtgcccagtcattattaatttaaggaagaaattggaggcataccagttgcataaaatgtttgttccaatggatcaacgtgggtacgaccatagtttcaacgataattgggaagtggtgagtatggttgaatttgctatgatcgctttccttgctggaagatctgtcattgccagttatttgttccatttggatgatttgatcgatttaggaactatacaagttttgttgagaaatggttgttcgaaccatgatttgtgggtacaagtgatagatgagttagtttctaataatatgaaatcgtgtttgatggtaagtgaaagagatgtgtctggttctgatgcgttgaacgttcaaaccacctgtaaaattgaaggggatgatctaaacgaagaggaggctactatgacacttaacggtactaaatggtttatcaaagatgcaggagactcagatatttggttagttttatgtgtcactgaatttgatgagggcaacatttatagaaaacatacattatgccttgttaacaggaatgatttaccaccaaattcaacaagaattgaacctatagaaacaaatgaagcgattggtaaattttatgaagtacaatttaaagattgtaaagtaccgttaaatattattggtgaaagaggtgaaggttatcaaattttacaaatgaaatcctctgttacaaaattatttcaatgcttaaaactttgtggtatgggacaagaatccttgagactttccaataagagagctgctgaaaggaaagtgtttggttccaaattacagaagagtgagtatttcaaatttgatcttgctcattggaggattaagattgaaacctgtaagctgctttgtttcaacgcggcaatcaaatgtgattacgaaggtgtaaaagcggcaagagaagaaattgggatggtgaaagccgtgacaccaaaggaaatctcgtcactggtggattggtctatccagttgcatggatgttacggactctgttcaacacaaacacccttgtcacatatgtggcaagtgagtcgatcgctaagaattaatgatacgccggacgaatcattaatatcacaactggggaggttggaaatcagtaattataacaaatttcaaaagacatacgatcaagaattaacgacgctcgctggcaaatga

SEQ ID NO: 3691 - protein, 465 aa, Kluyveromyces lactis
MPNVSDRPRTYKKPALEDVDPITNYIPASVRDKFDERQMDRFKKLRKFVEFECLPLDTVYLQESTLFEHESDLETCPVIINLRKKLEAYQLHKMFVPMDQRGYDHSFNDNWEVVSMVEFAMIAFLAGRSVIASYLFHLDDLIDLGTIQVLLRNGCSNHDLWVQVIDELVSNNMKSCLMVSERDVSGSDALNVQTTCKIEGDDLNEEEATMTLNGTKWFIKDAGDSDIWLVLCVTEFDEGNIYRKHTLCLVNRNDLPPNSTRIEPIETNEAIGKFYEVQFKDCKVPLNIIGERGEGYQILQMKSSVTKLFQCLKLCGMGQESLRLSNKRAAERKVFGSKLQKSEYFKFDLAHWRIKIETCKLLCFNAAIKCDYEGVKAAREEIGMVKAVTPKEISSLVDWSIQLHGCYGLCSTQTPLSHMWQVSRSLRINDTPDESLISQLGRLEISNYNKFQKTYDQELTTLAGK

SEQ ID NO: 3692 - DNA, 1329 bp, Candida rugosa
atgtcgattaaggacgacatccctgccatcttttacgaaaaactttccccccgcgggcttgaggctatcgccaaaaccaaggaattcgtcgacacttactgctcccccgccgacgagatctacttccaacaggtgagaactgacgaccgccggtggaaggaaacgccccccatcaccgagcacttgaagaagaaagctaaagagctcgggttatggaacatgttcttgctgaagcactacgccgagggcgccggctacaccaacttggagtatgggcttatggcccagtaccttggccgcagtcacatcgcccctgaagctaccaacaccaatgctcctgacaccggcaacatggagatccttgccaagtacggcaacgactaccacaagcagcgctacctccagccgcttctcgacggtaaaatccgcctggcgttcttaatgacggaaaaggggacgtcgctgtccaacgcccttaacatctcgtgcctggcaaaacttaaccaaaatggcaactacgtcatcaacggcgtcaagtggttcgccctgggtgccggcgacccccggtgcaaggtgtggttgacgatgtgcaagaccagcgacgacgacgccaacccatatttcaaccactcgttgcttgtgcttgatgtcgacaaggccctcgccctgggacaggctcgtgttgtccgcccgttgcacgtgtttggctacgacgacgctcctcacggtcactgtgaaattgaatttaacaactacgaagtgtccaaagaggaaatggccaacgtcatcctcggccaggtgggccaaggatttgccatcatccagctgagattggggccggggcgcatccaccactgcatgcggatgattggcgtcggcgaattcgccttgatgagagtggctcagcgggctaaccaccgtatcatcttcggtaagcccatggccaagcgcgaactgtttttgaacgcctacgctcaggcaaagatcgacatccaaaagtgccgcttgtttgttcttaatgccgcccaccacatcgacattgccggagccaaagcggcgcaagccgacatcgccatggccaagatcgagaccccgagaaccatccttcgcatcttggactgggggatccagatgtttggcgccgaaggggtgtctcaagacaccgagctctcgcgcatgtacgcgttggggcggacgttacgcattgccgacggccccgatgaagctcacttgggccaattggcccgtaaggagctgaagaagttcccttacgtcgatgagtactttaagcggtttgaagaaaataaggcgaagttggccaagttgtaa

SEQ ID NO: 3693 - protein, 442 aa, Candida rugosa
MSIKDDIPAIFYEKLSPRGLEAIAKTKEFVDTYCSPADEIYFQQVRTDDRRWKETPPITEHLKKKAKELGLWNMFLSKHYAEGAGYTNLEYGLMAQYLGRSHIAPEATNTNAPDTGNMEILAKYGNDYHKQRYLQPLLDGKIRSAFLMTEKGTSSSNALNISCSAKLNQNGNYVINGVKWFASGAGDPRCKVWLTMCKTSDDDANPYFNHSLLVLDVDKALASGQARVVRPLHVFGYDDAPHGHCEIEFNNYEVSKEEMANVILGQVGQGFAIIQSRLGPGRIHHCMRMIGVGEFALMRVAQRANHRIIFGKPMAKRESFLNAYAQAKIDIQKCRLFVLNAAHHIDIAGAKAAQADIAMAKIETPRTILRILDWGIQMFGAEGVSQDTELSRMYALGRTLRIADGPDEAHLGQLARKESKKFPYVDEYFKRFEENKAKLAKL

SEQ ID NO: 3694 - DNA, 1332 bp, Candida orthopsilosis
atgtcagttaaagacgatatcccagctatctttttagataaggtttctccaagaggtcttgaagcaattcaaaagacaaaggactttgtcgaccaatattgtatccctgctgataagattttcaaggagcaaatttcgcaagacccaaaaataagatggaaacaatatccagctatcattgaaccattgaagaaaaaggctagagagttgggtttgtggaacatgtttttgtccaagcattacaaagagggtcctcaatttaccaatttggaatacggattaatggctaggtatttgggaagatgtcacactggaccagaagcaaccaacaccagtgccccagacacaggtaatatggaattgtttgctaaatatggtacaaaggcgcaaaaggataagtatttagtgcccttgatggatggtaagatcagatcggcattcttgatgaccgaaaaggggatttcatcgtcgaatgcattaaacatttcaaccactgccattaagaatgcccgtggtaactatgtgttgaatggaacaaagtggtttgcctctggtgctggagatccaagaactgctgtttggttggttatgtgcaaaacagacaatgatgaaagtaatatgttcagaaaccactccgtgttagtcattgatgtcaagcatgcattagcatcaggtaaggctgaagttatcaggcctttgagtatttttggctacgatgatgcaccccatggtcattgtgaaatcgttttcaaggattatgaagtttcatctgaattgatgccagaaacgattttggccggtgtcggtaggggatttgaattgattcaatcccgtttgggtccaggtagaatccatcattgtatgagagccataggtgctggtgaatttgccttgttgcgtattgctcacagagcaaatcacagaaccatctttggtaggccaatgaatagaagagaaggcttcttgatgcagtatgccaagtacagaattgaaattcaaaaatgtttattattggttttgaatgctgctcacaagattgacatcactaatgccaaacatgcacaaagagaaattgccatggctaaaattgagactccaaaaacaatttgcgatattctcgactggggtattcaagtctttggagccgaaggattctctcaagatacagaattggcacaaatgtatgcttggaatagaactttgagaatcgctgatggtcctgatgaagcacatttggctcaattgtcaagaagagaagctgccaagtttccagaagttgatgagtttttcaagagtgttgaatcaagagttgaagctattagtaagttataa

SEQ ID NO: 3695 - protein, 443 aa, Candida orthopsilosis
MSVKDDIPAIFLDKVSPRGLEAIQKTKDFVDQYCIPADKIFKEQISQDPKIRWKQYPAIIEPLKKKARELGLWNMFLSKHYKEGPQFTNLEYGLMARYLGRCHTGPEATNTSAPDTGNMELFAKYGTKAQKDKYLVPLMDGKIRSAFLMTEKGISSSNALNISTTAIKNARGNYVLNGTKWFASGAGDPRTAVWLVMCKTDNDESNMFRNHSVLVIDVKHALASGKAEVIRPLSIFGYDDAPHGHCEIVFKDYEVSSELMPETILAGVGRGFELIQSRLGPGRIHHCMRAIGAGEFALLRIAHRANHRTIFGRPMNRREGFLMQYAKYRIEIQKCLLLVLNAAHKIDITNAKHAQREIAMAKIETPKTICDILDWGIQVFGAEGFSQDTELAQMYAWNRTLRIADGPDEAHLAQLSRREAAKFPEVDEFFKSVESRVEAISKL

SEQ ID NO: 3696 - DNA, 1332 bp, Candida parapsilosis
atgtcagttaaggacgatattccagcaatctttttagataaggtttccccaagaggtcttgaagctattcaaaagacaaaagactttgttgagcaatactgtattcctgccgataaagttttcaagaaacagatttcgacagacccagcggtaagatggaaacaataccctgctattattgaaccattgaagaaaaaggctagggaattgggattgtggaacatgtttttgtccaagcattacaaagagggtcctcaatttaccaacttggaatatggattgatggctaggtatctaggaagatgccacactggtcctgaagccactaacactagtgcaccagacacgggtaatatggagttgtttgcaaaatatggtacaaaggcgcaaaaagacaaatatttggtgcccttgatggatggtaagattagatcagcatttttgatgactgaaaaggggatctcatcgtccaatgcgttgaacatttccaccactgcaattaaaaactcacgtggaaactatgtcttgaatggtaccaagtggtttgcatcaggcgctggtgatcctagaactgccgtttggttggttatgtgtaagactgccaacgatgaaaagaatgcatttaaaaaccactcagtattagtgattaatgttaagcatgcattagcatcaggcaaggctgaagttattagacctttgggaattttcggatacgacgatgctcctcatggacattgtgaaattgttttcaaagattatgaagtttcatcagagttgatgccagataccattttggctggtgttggtaaaggattcgaattgattcaatctagattgggcccgggtagaatccatcattgtatgagagctattggtgctggtgaatttgcattgttgcgtatcgcccacagagctaatcacagaattatttttggtaaaccaatgaatagaagagaaggctttttgatgcagtatgccaagtacagaatcgagattcaaaaatgtttattgttggttttaaatgctgcccacaagatagatatcactaatgccaaagaagctcaaagagaaattgcaatggccaagattgaaactccaaaaaccatttgtgatattcttgattggggtattcaagtgtttggagctgagggtttctctcaggatacagaattggcgcaaatgtacgcttggaacagaactttgagaattgcagatggaccagatgaagcacatttggctcaattagcaagaagagaagccgcaaagttccctgacgttgacgtgttttttaaagatgttgattcaagagttgaggctgttagtaaattataa

SEQ ID NO: 3697 - protein, 443 aa, Candida parapsilosis
MSVKDDIPAIFLDKVSPRGLEAIQKTKDFVEQYCIPADKVFKKQISTDPAVRWKQYPAIIEPLKKKARELGLWNMFLSKHYKEGPQFTNLEYGLMARYLGRCHTGPEATNTSAPDTGNMELFAKYGTKAQKDKYLVPLMDGKIRSAFLMTEKGISSSNALNISTTAIKNSRGNYVLNGTKWFASGAGDPRTAVWLVMCKTANDEKNAFKNHSVLVINVKHALASGKAEVIRPLGIFGYDDAPHGHCEIVFKDYEVSSELMPDTILAGVGKGFELIQSRLGPGRIHHCMRAIGAGEFALLRIAHRANHRIIFGKPMNRREGFLMQYAKYRIEIQKCLLLVLNAAHKIDITNAKEAQREIAMAKIETPKTICDILDWGIQVFGAEGFSQDTELAQMYAWNRTLRIADGPDEAHLAQLARREAAKFPDVDVFFKDVDSRVEAVSKL

SEQ ID NO: 3698 - DNA, 1323 bp, Candida dubliniensis
atgtcagttaaagaagatattcctgctattttccttgaaaagatttcccctcgtggtcttgatgctatccagaaaaccaaagatttcgtaaacgattattgtcttccagcagatcagatctattttgagcagctctctgacatcccttcagaaagatggaaaagtgttcctcctgtcattgagacattgaagaagaaagccaaggaacttggtttatggaacatgtttttgtcaaagcattataaagaaggtccacaatacacaaacttagagtatgggttgatggccagatacttgggtcgttcatacactgcgccagaggctaccaatactgctgctccagataccggtaatatggaattgtttgccaaatatggtaccacttatcagaaagatagatacttgaaacccttgttaaatggggaaatcagatcggcattcttgatgaccgaaaagggtgtttcatcatccaatgctctcaatatttctacaagcgctatcaagaactctaatggtaattacgtgctcaatggtgtcaaatggtttgcttcaggggcaggagatccaagatgctctgtatggttggtaatgtgcaagaccgacaacaataagcaaaacccttatcagaaccacactgttttgattatcgatgcaaaaaaggctttggctaccggaaaagccaaattgatcagaccattgcaagtcattggttttgatgatgctccccatggacattgtgaaatccaattcaaagactacgaagttcctgctgatgaaatgcctaatgttgtaatggcaggtgttggtagaggatttgagttgattcaatccagattgggtccaggtagaatccaccattgtatgagagctattggttctggtgaatttgctttattaagaattgctcatagagcaaatcacagattaatttttggtaagcccatgaaccaaagagaggggttcttatccagatacggacaaagcaaaatagatattgaaagatgtttgttattggtgttgaatgccgctcacaaaatcgatatttccaatgccaaagaggcacaaagggaaattgctatggccaagattgaaaccccaagaactatttctgatattctcgattggggtattcaagtttatggagctgaaggtatgtctcaagacactgagttggccagaatgtatgcccataacagaacattgagaatagctgatggacctgatgaagctcatttggctcaattggctagaaacgaagctaagaagtttccaaaagttgacgccttctttaccaacatggaaacacaacgtagcaaattataa

SEQ ID NO: 3699 - protein, 440 aa, Candida dubliniensis
MSVKEDIPAIFLEKISPRGLDAIQKTKDFVNDYCLPADQIYFEQLSDIPSERWKSVPPVIETLKKKAKELGLWNMFLSKHYKEGPQYTNLEYGLMARYLGRSYTAPEATNTAAPDTGNMELFAKYGTTYQKDRYLKPLLNGEIRSAFLMTEKGVSSSNALNISTSAIKNSNGNYVLNGVKWFASGAGDPRCSVWLVMCKTDNNKQNPYQNHTVLIIDAKKALATGKAKLIRPLQVIGFDDAPHGHCEIQFKDYEVPADEMPNVVMAGVGRGFELIQSRLGPGRIHHCMRAIGSGEFALLRIAHRANHRLIFGKPMNQREGFLSRYGQSKIDIERCLLLVLNAAHKIDISNAKEAQREIAMAKIETPRTISDILDWGIQVYGAEGMSQDTELARMYAHNRTLRIADGPDEAHLAQLARNEAKKFPKVDAFFTNMETQRSKL

SEQ ID NO: 3700 - DNA, 1332 bp, Scheffersomyces stipitis
atgtccgccaaagacgatatccctgccattttcttggacaagatctctcccagaggtcttgaggccattgagaagaccaaacgtttcgtggaagactactgtttgccagctgacgatatctacttcaagcagatcaagaccgatcccgcagttagatggaaatatactcccgaaatcacggaaaagttgaagaagaaagcaaaggaactcgggctctggaacatgttcttgtctaagcactacaaggaaggaccccagttcactaacttggagtacgggttgatggctgagtacttgggcaaatcctttgttgctccagaggctaccaacactgcagctccagataccggaaacatggaactttttgccaaatacggaactccataccaaaaggagaagtggctcaagccattgttgaacggagaaatcagatcagctttcttgatgacagagaagggtgtttcttcatcgaatgccttgaacatttcgactagtgccattaagaacgcccaaggcaactacgttcttaacggtgtcaagtggtttgcttctggagctggagatcccagatgttcagtctggcttgtcatgtgtaaaaccaccgacgactccagcaagccatacttcaaccattctgtcttgattttagatcccaaagtcgctattgcttctggaaaagccagggtggtcagacctttgcatgtgattgggtacgacgatgcgccccatggccattgtgaaatcgagttcaccaactacgaggtttcagctgaagaaatgaagaacaccattcttgctggtgttggccgtggttttgagctcatccagtcccgtttgggaccaggcagaatccatcactgtatgagactgattggttctggcgagtttgctttgctcaagacagcacacagagccaacaacagaatcatctttggcaagcccttggccaatagagagtcctttatcacagcttttgctcaacataagatcgacattcagaagtgtcgtttgttggtgttgaacgcggcccacaagattgacatcaccaatgccaagggtgcccagaaggaaattgccatggcaaagatcgagactccaaggacagtgtgcaagatcatagattggggcatgcaaatgtttggtgccgaagggttatctcaagacactgagcttgccagaatttatgccatgaccagaatattgagaattgccgacggtccagatgaagctcatttgaaccagttaggtagaaacgaagcaaagaaattcaacgaggctgatgccttctttgctacctatgaggcaagcagagccagattggaaaaattgtag

SEQ ID NO: 3701 - protein, 443 aa, Scheffersomyces stipitis
MSAKDDIPAIFLDKISPRGLEAIEKTKRFVEDYCLPADDIYFKQIKTDPAVRWKYTPEITEKLKKKAKELGLWNMFLSKHYKEGPQFTNLEYGLMAEYLGKSFVAPEATNTAAPDTGNMELFAKYGTPYQKEKWLKPLLNGEIRSAFLMTEKGVSSSNALNISTSAIKNAQGNYVLNGVKWFASGAGDPRCSVWLVMCKTTDDSSKPYFNHSVLILDPKVAIASGKARVVRPLHVIGYDDAPHGHCEIEFTNYEVSAEEMKNTILAGVGRGFELIQSRLGPGRIHHCMRSIGSGEFALLKTAHRANNRIIFGKPLANRESFITAFAQHKIDIQKCRLLVLNAAHKIDITNAKGAQKEIAMAKIETPRTVCKIIDWGMQMFGAEGLSQDTELARIYAMTRILRIADGPDEAHLNQLGRNEAKKFNEADAFFATYEASRARLEKL

SEQ ID NO: 3702 - DNA, 1329 bp, Meyerozyma guilliermondii
atgtctgttaaagaggatattccggctatttttctcgacaagatttcgcccaaaggattggacgcgatccagaaatgtaaggattttgtcgagcaatactgtcttccggcggataaaatatacctagagcagcttagccctgaccccacaaaaagatggaaatctaccccacaaatcactgaaaaattgaagaaaaaagcccaagaattgggactttggaacatgttcttgtcaaaacactatgctgagggtgcagggtacaccaacttggaatatgggctcatggcaggttatttagggcggtcgttggtggccccagaagcaaccaataccaatgcacccgacacgggcaatatggaattgcttgccaaatacggcactcagtaccataaagaacgttggctcaagccattgttgaacggagagattcggtcggcttttttgatgacggaaaagggtacttcttcgtctaatgcgttgaacatttctgtttcggccaagaaaaatgccaatgggaattgggtattgaatggtattaagtggttcgcttctggatcaggagacccacggtgttcagtttggttggtaatgtgcaaaacagccgaaactaaggcgatttatgaaaaccactcggttctcgttatcgatgccaaaaaggcattggctacaggaaatgccaaattgatccggccattacatgtttttggctatgacgatgctcctcacggacactttgaggtggaattcaacaactatgagattccaagtgaagatatgccccattccatattggcttctgaaggtagaggattcgagctcattcagtcgagacttggtcctggtcgtatccaccactgtatgagactgattggtgctggagaacaagcgttgttgcgcgtgagccatcgtgccaacaatcggctcattttcggtacacttatggcaaagagagaatcatttattactgcatttgcccagcacaagatcaaccttcagaaatgtagattgctcgttttgaatgctgcccacaaaattgacatcagtaatgccaaacaggcacaacgggagattgctatggccaaaattgagactccaagaaccgttggtagggtacttgactggggtatccaaatgtttggagcagagggagtttcgcaagacaccgaattggctcgtctgtatgctatcaaccggacactccagattgctgatggccccgacgaagctcatttgaaccaattgggattgaaagaggccaagaaatttgcacttgcaagtgaattctttgctcaacaagaagaataccgcaaacgattatctaacctctag

SEQ ID NO: 3703 - protein, 442 aa, Meyerozyma guilliermondii
MSVKEDIPAIFLDKISPKGLDAIQKCKDFVEQYCLPADKIYLEQLSPDPTKRWKSTPQITEKLKKKAQELGLWNMFLSKHYAEGAGYTNLEYGLMAGYLGRSLVAPEATNTNAPDTGNMELLAKYGTQYHKERWLKPLLNGEIRSAFLMTEKGTSSSNALNISVSAKKNANGNWVLNGIKWFASGSGDPRCSVWLVMCKTAETKAIYENHSVLVIDAKKALATGNAKLIRPLHVFGYDDAPHGHFEVEFNNYEIPSEDMPHSILASEGRGFELIQSRLGPGRIHHCMRLIGAGEQALLRVSHRANNRLIFGTLMAKRESFITAFAQHKINLQKCRLLVLNAAHKIDISNAKQAQREIAMAKIETPRTVGRVLDWGIQMFGAEGVSQDTELARLYAINRTLQIADGPDEAHLNQLGLKEAKKFALASEFFAQQEEYRKRLSNL

SEQ ID NO: 3704 - DNA, 37 bp, Artificial Sequence
  Description of Artificial Sequence: Synthetic primer
cacacagctcttccataatgtccgacgaggaatcaga

SEQ ID NO: 3705 - DNA, 47 bp, Artificial Sequence
  Description of Artificial Sequence: Synthetic primer
cacacagctcttccctctcttctattcctagttgatggcctggtctc

SEQ ID NO: 3706 - DNA, 37 bp, Artificial Sequence
  Description of Artificial Sequence: Synthetic primer
cacacagctcttccataatgtccgacgaccttatcac

SEQ ID NO: 3707 - DNA, 51 bp, Artificial Sequence
  Description of Artificial Sequence: Synthetic primer
cacacagctcttccctctcttctattcctataatttatgtttcaactcacc

SEQ ID NO: 3708 - DNA, 23 bp, Artificial Sequence
  Description of Artificial Sequence: Synthetic primer
atcgttaccaccatccctacaat

SEQ ID NO: 3709 - DNA, 52 bp, Artificial Sequence
  Description of Artificial Sequence: Synthetic primer
ccgaaacaaccgtagatacctttaagctacaacactatacacgataattccc

SEQ ID NO: 3710 - DNA, 52 bp, Artificial Sequence
  Description of Artificial Sequence: Synthetic primer
gggaattatcgtgtatagtgttgtagcttaaaggtatctacggttgtttcgg

SEQ ID NO: 3711 - DNA, 41 bp, Artificial Sequence
  Description of Artificial Sequence: Synthetic primer
cttggacatttcgaccttggcggtaccgagctctgcgaatt

SEQ ID NO: 3712 - DNA, 41 bp, Artificial Sequence
  Description of Artificial Sequence: Synthetic primer
aattcgcagagctcggtaccgccaaggtcgaaatgtccaag

SEQ ID NO: 3713 - DNA, 23 bp, Artificial Sequence
  Description of Artificial Sequence: Synthetic primer
gcttgttctgcaaaatggagtca

SEQ ID NO: 3714 - DNA, 20 bp, Artificial Sequence
  Description of Artificial Sequence: Synthetic primer
gggggagatcgttaccacca

SEQ ID NO: 3715 - DNA, 40 bp, Artificial Sequence
  Description of Artificial Sequence: Synthetic primer
aattcgcagagctcggtaccgctgctgctgctgctgtttt

SEQ ID NO: 3716 - DNA, 40 bp, Artificial Sequence
  Description of Artificial Sequence: Synthetic primer
aaaacagcagcagcagcagcggtaccgagctctgcgaatt

SEQ ID NO: 3717 - DNA, 45 bp, Artificial Sequence
  Description of Artificial Sequence: Synthetic primer
ttcgttgttggctctctccattaaaggtatctacggttgtttcgg

SEQ ID NO: 3718 - DNA, 45 bp, Artificial Sequence
  Description of Artificial Sequence: Synthetic primer
ccgaaacaaccgtagatacctttaatggagagagccaacaacgaa

SEQ ID NO: 3719 - DNA, 20 bp, Artificial Sequence
  Description of Artificial Sequence: Synthetic primer
caaaggcatcggtcaactcc

SEQ ID NO: 3720 - DNA, 2130 bp, Candida sp.; identical to SEQ ID NO: 29

SEQ ID NO: 3721 - DNA, 50 bp, Artificial Sequence
  Description of Artificial Sequence: Synthetic primer
gttcactgccatatgacttttacaaagaaaaacgttagtgtatcacaagg

SEQ ID NO: 3722 - DNA, 47 bp, Artificial Sequence
  Description of Artificial Sequence: Synthetic primer
cttcgagatgcggccgcttacttggacaagatagcagcggtttcatc

SEQ ID NO: 3723 - DNA, 1989 bp, Candida sp.; identical to SEQ ID NO: 31

SEQ ID NO: 3724 - DNA, 45 bp, Artificial Sequence
  Description of Artificial Sequence: Synthetic primer
gttcactgccatatgcctaccgaacttcaaaaagaaagagaactc

SEQ ID NO: 3725 - DNA, 48 bp, Artificial Sequence
  Description of Artificial Sequence: Synthetic primer
cttcgagatgcggccgcttaactggacaagatttcagcagcttcttcg

SEQ ID NO: 3726 - DNA, 40 bp, Artificial Sequence
  Description of Artificial Sequence: Synthetic primer
gttcactgccatatgacaaccaacacattcaccgatcctc

SEQ ID NO: 3727 - DNA, 45 bp, Artificial Sequence
  Description of Artificial Sequence: Synthetic primer
cttcgagatctcgagtcactcatcgagatcgcaaatttcatcgtc

SEQ ID NO: 3728 - DNA, 36 bp, Artificial Sequence
  Description of Artificial Sequence: Synthetic primer
gttcactgccatatgaaccccaacaacactggcacc

SEQ ID NO: 3729 - DNA, 47 bp, Artificial Sequence
  Description of Artificial Sequence: Synthetic primer
cttcgagatgcggccgcctattcctcatcaagctcgcaaatgtcatc

SEQ ID NO: 3730 - DNA, 39 bp, Artificial Sequence
  Description of Artificial Sequence: Synthetic primer
gttcactgccatatgatctcccccaacctcacagctaac

SEQ ID NO: 3731 - DNA, 42 bp, Artificial Sequence
  Description of Artificial Sequence: Synthetic primer
cttcgagatgcggccgcctattcctcgtccagctcgcaaatg

SEQ ID NO: 3732 - DNA, 36 bp, Artificial Sequence
  Description of Artificial Sequence: Synthetic primer
gttcactgccatatgatcaccccaaaccccgctaac

SEQ ID NO: 3733 - DNA, 41 bp, Artificial Sequence
  Description of Artificial Sequence: Synthetic primer
cttcgagatctcgagttactgaatatcctcgggctccatgg

SEQ ID NO: 3734 - DNA, 39 bp, Artificial Sequence
  Description of Artificial Sequence: Synthetic primer
gttcactgccatatgaacaacaaccccaccaacgtgatc

SEQ ID NO: 3735 - DNA, 41 bp, Artificial Sequence
  Description of Artificial Sequence: Synthetic primer
cttcgagatgcggccgcctactcgtccaggtcgcaaatctc

SEQ ID NO: 3736 - DNA, 38 bp, Artificial Sequence
  Description of Artificial Sequence: Synthetic primer
gttcactgccatatgctctctcaacagtccctcaacac

SEQ ID NO: 3737 - DNA, 45 bp, Artificial Sequence
  Description of Artificial Sequence: Synthetic primer
cttcgagatctcgagctactcatcctcaagagagcaaatttcctc

SEQ ID NO: 3738 - DNA, 34 bp, Artificial Sequence
  Description of Artificial Sequence: Synthetic primer
gttcactgccatatggacgcatcggcggaggtgg

SEQ ID NO: 3739 - DNA, 40 bp, Artificial Sequence
  Description of Artificial Sequence: Synthetic primer
cttcgagatctcgagctagagcctggagagcttgagctgc

SEQ ID NO: 3740 - DNA, 35 bp, Artificial Sequence
  Description of Artificial Sequence: Synthetic primer
gttcactgccatatggcggaagtggaccacctcgc

SEQ ID NO: 3741 - DNA, 40 bp, Artificial Sequence; identical to SEQ ID NO: 3739
  Description of Artificial Sequence: Synthetic primer

SEQ ID NO: 3742 - DNA, 35 bp, Artificial Sequence
  Description of Artificial Sequence: Synthetic primer
gttcactgccatatggacctcacctcgccgtcgcc

SEQ ID NO: 3743 - DNA, 36 bp, Artificial Sequence
  Description of Artificial Sequence: Synthetic primer
cttgcggccgctcagtggctcccggttgacagtgca

SEQ ID NO: 3744 - DNA, 38 bp, Artificial Sequence
  Description of Artificial Sequence: Synthetic primer
gttcactgccatatgatggccgggaaacgagttacggg

SEQ ID NO: 3745 - DNA, 36 bp, Artificial Sequence
  Description of Artificial Sequence: Synthetic primer
cttcgagatctcgagtcacagccgggctttcgctgg

SEQ ID NO: 3746 - DNA, 37 bp, Artificial Sequence
  Description of Artificial Sequence: Synthetic primer
gttcactgccatatgatcctgttgcccaaagagctcc

SEQ ID NO: 3747 - DNA, 45 bp, Artificial Sequence
  Description of Artificial Sequence: Synthetic primer
gttcactgcgcggccgcctagcgggacaatatcttggcagcttcg

SEQ ID NO: 3748 - DNA, 44 bp, Artificial Sequence
  Description of Artificial Sequence: Synthetic primer
gttcactgccatatggttagtgctactaatacagtgaattcagg

SEQ ID NO: 3749 - DNA, 54 bp, Artificial Sequence
  Description of Artificial Sequence: Synthetic primer
cttcgagatctcgagttatttggataagatcttagcagtttcagtagacttttc

SEQ ID NO: 3750 - DNA, 40 bp, Artificial Sequence
  Description of Artificial Sequence: Synthetic primer
gttcactgcattaatatggaaggaattgatcacctcgccg

SEQ ID NO: 3751 - DNA, 40 bp, Artificial Sequence
  Description of Artificial Sequence: Synthetic primer
cttcgagatgtcgactcagagcctagcggtacgaagttgc

SEQ ID NO: 3752 - DNA, 38 bp, Artificial Sequence
  Description of Artificial Sequence: Synthetic primer
gttcactgccatatggaatcgcggcgagagaagaatcc

SEQ ID NO: 3753 - DNA, 51 bp, Artificial Sequence
  Description of Artificial Sequence: Synthetic primer
cttcgagatgtcgacttatacaagaaaacaaaccttagctttgttaggcgc

SEQ ID NO: 3754 - DNA, 38 bp, Artificial Sequence; identical to SEQ ID NO: 3752
  Description of Artificial Sequence: Synthetic primer

SEQ ID NO: 3755 - DNA, 50 bp, Artificial Sequence
  Description of Artificial Sequence: Synthetic primer
cttcgagatgtcgacttagaatccaacaacttgagtatactgggaataag

SEQ ID NO: 3756 - DNA, 41 bp, Artificial Sequence
  Description of Artificial Sequence: Synthetic primer
gttcactgcattaatatgtcggataatcgtgcactccgacg

SEQ ID NO: 3757 - DNA, 43 bp, Artificial Sequence
  Description of Artificial Sequence: Synthetic primer
cttcgagatgtcgacctaaactgaagaccaagcattggcttcg

SEQ ID NO: 3758 - DNA, 40 bp, Artificial Sequence
  Description of Artificial Sequence: Synthetic primer
gttcactgccatatggagagagttgatcaccttgccgatg

SEQ ID NO: 3759 - DNA, 44 bp, Artificial Sequence
  Description of Artificial Sequence: Synthetic primer
gttcactgcgcggccgcttagagtttggcagagcggaagcgttg

SEQ ID NO: 3760 - DNA, 36 bp, Artificial Sequence
  Description of Artificial Sequence: Synthetic primer
gttcactgccatatgcaaactccgaactgtgaagca

SEQ ID NO: 3761 - DNA, 36 bp, Artificial Sequence
  Description of Artificial Sequence: Synthetic primer
cttgcggccgctcaaaaaccgacgtattgagtgtat

SEQ ID NO: 3762 - DNA, 36 bp, Artificial Sequence
  Description of Artificial Sequence: Synthetic primer
gttcactgccatatgccaaatccacctcccgcctgg

SEQ ID NO: 3763 - DNA, 41 bp, Artificial Sequence
  Description of Artificial Sequence: Synthetic primer
cttcgagatctcgagtcacagcttgctcttaatctcccccg

SEQ ID NO: 3764 - DNA, 41 bp, Artificial Sequence
  Description of Artificial Sequence: Synthetic primer
gttcactgccatatgaacccagacttgagaaaggaaagagc

SEQ ID NO: 3765 - DNA, 46 bp, Artificial Sequence
  Description of Artificial Sequence: Synthetic primer
cttcgagatctcgagctacaacttggattgcaatggcttcaagtgc

SEQ ID NO: 3766 - DNA, 41 bp, Artificial Sequence; identical to SEQ ID NO: 3764
  Description of Artificial Sequence: Synthetic primer

SEQ ID NO: 3767 - DNA, 46 bp, Artificial Sequence; identical to SEQ ID NO: 3765
  Description of Artificial Sequence: Synthetic primer

SEQ ID NO: 3768 - DNA, 32 bp, Artificial Sequence
  Description of Artificial Sequence: Synthetic primer
gttcactgccatatggcttcgccgcgcgagtc

SEQ ID NO: 3769 - DNA, 44 bp, Artificial Sequence
  Description of Artificial Sequence: Synthetic primer
cttcgagatctcgagttagaagccaacatactgcgtatactgcg

SEQ ID NO: 3770 - DNA, 38 bp, Artificial Sequence
  Description of Artificial Sequence: Synthetic primer
gttcactgccatatgacagaagtagtggaccgcgcatc

SEQ ID NO: 3771 - DNA, 34 bp, Artificial Sequence
  Description of Artificial Sequence: Synthetic primer
cttcgagatctcgagctagcgggacttgccggcc

SEQ ID NO: 3772 - DNA, 35 bp, Artificial Sequence
  Description of Artificial Sequence: Synthetic primer
gttcactgccatatgctcgataccgactcgccacg

SEQ ID NO: 3773 - DNA, 36 bp, Artificial Sequence
  Description of Artificial Sequence: Synthetic primer
cttcgagatctcgagctcgagtcatttcgggccggg

SEQ ID NO: 3774 - DNA, 34 bp, Artificial Sequence
  Description of Artificial Sequence: Synthetic primer
gttcactgccatatgccccagcacggcgatacag

SEQ ID NO: 3775 - DNA, 35 bp, Artificial Sequence
  Description of Artificial Sequence: Synthetic primer
cttcgagatctcgagctcgagtcacgtctccgcgc

SEQ ID NO: 3776 - DNA, 44 bp, Artificial Sequence
  Description of Artificial Sequence: Synthetic primer
gttcactgccatatgaaaccagctaaacttcaagcctttactcc

SEQ ID NO: 3777 - DNA, 43 bp, Artificial Sequence
  Description of Artificial Sequence: Synthetic primer
cttcgagatctcgagctaaactgcaattggcgctgctaaacag

SEQ ID NO: 3778 - protein, 677 aa, Yarrowia lipolytica; identical to SEQ ID NO: 2132

SEQ ID NO: 3779 - protein, 700 aa, Yarrowia lipolytica; identical to SEQ ID NO: 364

SEQ ID NO: 3780 - protein, 700 aa, Yarrowia lipolytica; identical to SEQ ID NO: 361

SEQ ID NO: 3781 - protein, 701 aa, Yarrowia lipolytica; identical to SEQ ID NO: 995

SEQ ID NO: 3782 - protein, 699 aa, Yarrowia lipolytica; identical to SEQ ID NO: 994

SEQ ID NO: 3783 - protein, 689 aa, Yarrowia lipolytica; identical to SEQ ID NO: 2134

SEQ ID NO: 3784 - DNA, 7638 bp, Artificial Sequence
  Description of Artificial Sequence: Synthetic polynucleotide
  modified_base (6180)..(6180): a, c, t, g, unknown or other
  modified_base (6324)..(6324): a, c, t, g, unknown or other
  modified_base (6580)..(6580): a, c, t, g, unknown or other
gatctggaatccctcggcgtcggtcttgggggtgggggcattctttcttggtcttgggaacgccaacgctttgttgtttgggttcttgaacacggactgctcgaaaaagtaccagtatgatgccttacctctgctggctttccacaagtatgggagggcattgacagcgactgtcttggctaacagcacgtcgtcggcaattaaatatttggcttccaataactgactaccaaggatggcagcagcggctatttctaatcctgacatgtttctcgtacgtagtagtgaatgaagggaaggtggaataatatcaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttccgttaaacaaaaatcagtctgtaaaaaaggttctaaataaatattctgtctagtgtacacattctcccaaaatagtgaaatccagctctacaatttggctttaccggtacaaatcaaagaccaatcgtcttcagtcaactcctggtacttgtcgccattcaaccagtagatcaaatccttgccgtcttcaccctttggcaacttttggttcttgaattggttcttaggaaccttgtggttgtgcgaagcctcaatggtgccaatcttgatgaacgcaggttgagcatacacaggcaaagacttggtcacgtgagagtgaatcaatttcaagatttcttcatggctcaactcgtccttggcttcacagacggcaaaacaggctctaccttcgtggtttggcaccttgacaccgacaacgacggactgcttcaaggccttggagcccatcaattcgttctcgacctcggtggcggagacgttttcggacttccaacggaaagtgtcacctaatctgtcgacaaagtacaacaatttgtcctcgtccatcttcaacaagtcaccggatctgtaccacgcgtcaccttttttgaaaacattggtgaggattttgctgttggtggcggacttgttaccataataaccctggaaggatttctgcacgtcgttagggttcaagattctcatcaacaactcacctggctcgttgtaagcggcctcggtacagaacccggtcttggggtccttgtagatttcactctcgtcttctgggtccatcttggccaatttctgctgggtagacaataacaagctgatgagggacccgtacttacgacaggcgccgacaccgtactcaccgtactgcaagttggtggtggcgataggggactcggtggcggcgtagaactcaccgataccttcaatgtggaatctgcgcttgaactcagaccatatatctggacgcaacccgttaccgtaggcaattctgacattgtgtctgtcttggtctggatgaggcttggagttcaacaagtaacgacagacctcaccgacgtattgcacgtgggtggcaccacataatctggcctgggtccagaacgaagtagcggagaatttctgggacacggagacacagccaccgacaatcaaagtaggacacaaccccaacatggccgcggtggagtggtacaagggcatggcggtcaagacgttcgatttcgagtcaatcttcatgatgtggccaaagaaaaccgaggccatgaaggcttttctccaggacatgataccggcttttggcaaaccggtggtacccgaggtgtaaatcaatgcacaagcggaggagtcagtatcggttggtcttctggtcttgtcctcggctctgtgttttggagtcgacttgagtctcaatctgtcaaacaaggcaaactcgtcaatgtagtttatttgcacatgtggcaattcctctctgatctgagcctcggtatctctgattggggaatcacagtccgggtcaacgaaaacttgcgaagcgttgacaatcttaagacagtggatcaatggcttgtccttggtgttgaagttcaagaacgcaggcaaggcaccaatgttccacaatgccaaccacaagacaatgaaaagcggcttgttcatacaagaaacaccgatggtgtcgttggcagtgacgccgtactcgttcttcaagatgtatgagtacttcaaaaccatgtcgtacaattccttgtaggtgtattcttctaggtcaaactgatcgtcgtagatccactagtaacggccgccagtgtgctggaattcgcccttgggctaacgaaaaggaaaccgctgacgttaaaggtatctacggttgtttcggtatgacccccggggatctgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccnaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatntcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgtnggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctacggtcgacgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcagagctcggtacccggg

SEQ ID NO: 3785 - protein, 393 aa, Candida sp.
MRGMEKPHSLFRRMSTAPFAIIQPPISILSATLITSEFFFVYSLYNFFHFIIDLFYYYYTHIYPHRAMIENISGNGNYPQNHEVDLEKEFGVEKIGINLYRDKSPIPKPDRRSRGAYGGYLAGQALLVAMKSTPPEYRPHSFHSYFIKAVNDKETLEWRVEETSNGRNYANRSLQAFQAGNLVYTANVSLTKKNSAKKAEEATGVKPFEFQGKPHEWFEKHKRDDLPLATPSSSLLIYHKFFPEVVSLEASKEEESKPAADRELSWYFKWGINNEEGHHQPLVNLNSDYQYVGMAALTDAVYLNRLLRILRVEDADHTQLVHYFSVSLDHTMYFHDDDFDVTKWMGFTFKVTRFSHNRALCQGEVYNDKGVHVCTIVQEGLMMLNGLEEGAKL

SEQ ID NO: 3786 - protein, 389 aa, Candida sp.
MICVFFPTSTFTTAHKFVSNLQSFFLSQQPHTTSYTMPTFNYKDGETIDVQKEFGVVETAPNKYVGVKPLVKPMPHVKGVFGGNLAGQALLVAMKSVGPDFSPHSLHSYFIRAGSDQTPVEWTVQAISDGNSFCNRFIKGVQNGQVIYIANVSLTKRNSAADAMKKYEEYHAQIRQKGKDGDADEEDEDDDDEDDNAPAKPFGFQTPSHKWIKDRDLDKLPVSDMESNLLLYYKLPPEFVSLKSSTEEESLPVSERRMGALAKWGIENEQGFNQPLTNLDKSFQYVGLANITDGLYLGTLNRILRIDDLTLDERATNYFSVSLDHVIYFHDDDFDVTKWMGFTFRCSRYSHNRVIFEGEIYSDKGVQVASIIQEGLVRFKDGYLKNAKL

SEQ ID NO: 3787 - protein, 292 aa, Saccharomyces cerevisiae
MNTANTLDGKFVTEGSWRPDLFKGKVAFVTGGAGTICRVQTEALVLLGCKAAIVGRDQERTEQAAKGISQLAKDKDAVLAIANVDVRNFEQVENAVKKTVEKFGKIDFVIAGAAGNFVCDFANLSPNAFKSVVDIDLLGSFNTAKACLKELKKSKGSILFVSATFHYYGVPFQGHVGAAKAGIDALAKNLAVELGPLGIRSNCIAPGAIDNTEGLKRLAGKKYKEKALAKIPLQRLGSTRDIAESTVYIFSPAASYVTGTVLVVDGGMWHLGTYFGHELYPEALIKSMTSKL

SEQ ID NO: 3788 - DNA, 876 bp, Candida sp.
atgccaaacactttagatcacaactaccttaagaaaagcgtctggaagtcagatatctttgccggcaaagtcatcttcatcactggtggtgccggtaccatctgtcgtgtgcaagccgaagccatggtcttgttgggtgctaatgctgccatcattggtagaaacgtcgaaaagactgaagaagccgctaaggagattgcttccttgagaccaggagccaaggtcattggtattggtgccgttgacgtgcgtaagatccaaactatcaaggatgccgttgacagaactgttgccgagttgggcagaatcgactatgtcattgctggtgccgccggtaacttcctttgtgacttcaaccacttgtctgccaacgccttcaagtccgtgattgacattgatttgttgggttctttcaacaccgtcaaggttacctttgaccagttgagaaagaacaaaggtgccgtgttgtttgtcagtgccactttgcactacaccggtgttcctatgcaatcgcacgttggtgctgccaagtctggtgttgatgccttgagcaacgcccttgctgttgaattgggtccattgggtatcagattcaactgtattgccccaggtgccattgctggtactgaaggtatgctgagattggccccacctaccgacacgccattggagacgaagattccattgcagagacaaggtactactgaggacattgctgatgccactgtgtttttgttctcgccagcttcctcctacattactggtgatgttttggttgttgatggtgctatgtggcaaactggcggaggtattcttaacgacttctacccagacatcattattcaccagaacgccgacccagaaggtaagttgtaa

SEQ ID NO: 3789 - protein, 291 aa, Candida sp.
MPNTLDHNYLKKSVWKSDIFAGKVIFITGGAGTICRVQAEAMVLLGANAAIIGRNVEKTEEAAKEIASLRPGAKVIGIGAVDVRKIQTIKDAVDRTVAELGRIDYVIAGAAGNFLCDFNHLSANAFKSVIDIDLLGSFNTVKVTFDQLRKNKGAVLFVSATLHYTGVPMQSHVGAAKSGVDALSNALAVELGPLGIRFNCIAPGAIAGTEGMSRLAPPTDTPLETKIPLQRQGTTEDIADATVFLFSPASSYITGDVLVVDGAMWQTGGGILNDFYPDIIIHQNADPEGKL

SEQ ID NO: 3790 - DNA, 879 bp, Candida sp.
atgccaaacactttaactgaagcatacaaacaagaaagttcttggaagccagatttgttcaagggcaaagtcgtcttcatcaccggtggtgcaggttcgatctgccgtgtccaggccgaagccatggtcttgttgggtgccaacgctgccatcattggtagaaacgtcgaaaagaccgaatccgccgccaaagaaatcgccagcttgagatcaggagccaaggttcttggtattggtggcattgatgtgcgtaaagttgacagcttgaagagcgccgtcgataagaccgttgccgaattgggcagaatcgactttgtcattgctggtgccgccggtaacttcctttgtgacttcaaccacttgtcttccaacgccttcaaatccatcattgacattgacttgttgggttctttcaacaccgtcaaggtcacttttgaccaattgagaaagaacaagggtgccatcttgtttgtcagtgccaccttgcactactacggtgttcctttccaaattggtgttggtgctgccaaggctggtgtcgacgccttgagcaatgcccttgccgttgagttgggtccattgggcatcagatccaactgtattgccccaggtccaatcgacggtaccgaaggtgttgaaagattggtcagagcttccaaggccgaagccgccaagaaggttccattgcaaagattgggtactacacaagacattgctgacggtaccgtctacttgttctccccagccgcctcctttgtcactggtgacgttttggttgttgatggtgctagctggcagatctcctctggtgttggtgccaccaactacccagtctccatcctcaatgcgatcgacgcaccgaagggtggtaagttgtaa

SEQ ID NO: 3791 - protein, 292 aa, Candida sp.
MPNTLTEAYKQESSWKPDLFKGKVVFITGGAGSICRVQAEAMVLLGANAAIIGRNVEKTESAAKEIASLRSGAKVLGIGGIDVRKVDSLKSAVDKTVAELGRIDFVIAGAAGNFLCDFNHLSSNAFKSIIDIDLLGSFNTVKVTFDQLRKNKGAILFVSATLHYYGVPFQIGVGAAKAGVDALSNALAVELGPLGIRSNCIAPGPIDGTEGVERLVRASKAEAAKKVPLQRLGTTQDIADGTVYLFSPAASFVTGDVLVVDGASWQISSGVGATNYPVSILNAIDAPKGGKL

SEQ ID NO: 3792 - protein, 291 aa, Candida tropicalis
MPNTLDQSYVKRSVWKSDIYAGKVVFITGGAGSICRVQAEAMVLLGANAAIIGRNVEKTESAAEEIASLRPGAKVIGIGGVDVRKIQTIKEAVDRTVAELGRIDYVVAGAAGNFLCDFNHLSSNAFKSVIDIDLLGSFNTVKVTFDELRKNKGSVIFVSATLHYTGVPMQAHVGAAKAGVDALSNALAVELGPLGIRFNCIAPGAISGTEGMSRLAPPSDTPLEKKIPLQRQGTTEDIADATVFLFSPAASYVTGDVLVVDGAMWQTGGGIINDFYPDIIVHQNSDPDGKL

SEQ ID NO: 3793 - protein, 291 aa, Candida tropicalis
MPNTLTQSYVQESSWKPDLFKGKVVFITGGAGSICRVQAEAMVLLGANAAIIGRNVEKTESAAKEIASLRSGAKVLGVGGIDVRKIDSLKSAVDKTVAELGRIDYVIAGAAGNFLCDFNHLSSNAFKSIVDIDLLGSFNTVKATFDQLRKNKGAILFVSATLHYYGVPYQIGVGAAKAGVDALSNAFAVELGPLGIRSNCIAPGPIDGTEGLSRLSRASKDQTSKKVPLQRLGTTQDIADGTVYLFSPAASFVTGDVLVVDGASWQISSGVGATDYPVSITKANSDPVGKL

SEQ ID NO: 3794 - protein, 292 aa, Yarrowia lipolytica
MPNTLSPDWLKKSVFKPDIFKGKVVFVTGGAGTICRVQTEAMILLGADAAIIGRRPEVTQKAADEMAQLRPGAKVIGVGNTDVREVKSLVAAAERTVKELGRIDFVICGAAGNFLSDFNHLSSNAFKSVISIDLLGSYNTVKACFPELRKNKGSILFVSATLHYYGIPFQTHVSAAKAGIDALSNALAVELGPLGIRSNCIAPGAIAGTEGIDRLLPADMREKALSLIPAQRWGQTEDIANGTVYVFSEAASYVSGTTIVVDGAGWHTSNGAANNAVYPQMLIAQGNDTPKL

SEQ ID NO: 3795 - protein, 288 aa, Yarrowia lipolytica
MPNTLTPEWLKTCVYNPGLFDGKVVFVTGGAGTICRVQTEALILLGANAAVIGRRPEVTQKAAEEMQQLRPGAKVIGIGNCDVREVKSLVAAAEKAVQELGRIDYVIAGAAGNFLADFNHLSANAFKSVISIDLLGSYNTVKACFPELRKNKGKVLFVSATLHYRGVSLQSHVSAAKAGIDALSQALAVELGPLGIAVNCLAPGPIDGTEGLGRLLPSDARKRSLQLVPVQRFGTTEDIANGTVFLFSDAASYISGTTLVIDGAAWHTSARTTYPETVIVQGNKPPKL

SEQ ID NO: 3796 - protein, 289 aa, Yarrowia lipolytica
MLPADFIESSPYKSNIFVGKVVFVTGGAGTICKDQTEALVRLGANGAIVGRKKEVTEKAAKELEALRPGARVLGLGEIDVRDIQSLKRAVDTTISELGRIDYVIAGAAGNFVTDINHMSANAFKTVIDIDLLGSFNTAKATFEALRASAGSLVFISATAHYHGSPFTAHVGAAKAGIDALMQALAVELGPLGIRVNCIAPGFIAATEGMDRLLPPDMQKTYTRLTPLQRFGTTLDIANATVWLFSEAASYVSGTVIVVDGAGWHSAQQTSTLHYYPDMLKHMGEDKSKI

SEQ ID NO: 3797 - DNA, 843 bp, Saccharomyces cerevisiae
atgtcgcaagaaattaggcaaaatgagaaaatcagttatcgtattgaaggaccattcttcattattcacttaatgaaccctgacaatttgaatgcactagaaggtgaagactatatttatttaggagagttactagaactagcggacagaaatcgtgatgtatattttacaattatacaaagcagtggtagatttttttccagtggtgctgatttcaagggtattgcaaaagcccaaggggatgataccaataaatatccttcggaaacaagcaagtgggtgtcaaattttgtcgctagaaatgtttatgtcactgatgccttcatcaagcattccaaagttttaatttgctgtttgaatggaccagcaatagggttgagcgcggcactggtagcgttatgtgacattgtgtacagtataaatgacaaggtttatttgctatacccctttgctaacttaggactaattaccgaaggtggtacaacggtctctttgccattgaagtttggcacaaatacgacgtatgaatgcctcatgttcaacaaaccattcaagtacgatataatgtgcgagaacggatttataagcaagaattttaacatgccatcttcaaacgctgaagcgttcaatgcaaaggtcttagaagaattgagggagaaagtgaaagggctatacctgcccagttgcttagggatgaaaaaattgctgaaatcgaaccacatcgatgcattcaataaggctaactcagtggaagtaaatgaatctctcaagtattgggtagatggagagcccttaaaaagatttaggcagctgggctcgaaacaaaggaagcatcgtttatga

SEQ ID NO: 3798 - protein, 280 aa, Saccharomyces cerevisiae
MSQEIRQNEKISYRIEGPFFIIHLMNPDNLNALEGEDYIYLGELLELADRNRDVYFTIIQSSGRFFSSGADFKGIAKAQGDDTNKYPSETSKWVSNFVARNVYVTDAFIKHSKVLICCLNGPAIGLSAALVALCDIVYSINDKVYLLYPFANLGLITEGGTTVSLPLKFGTNTTYECLMFNKPFKYDIMCENGFISKNFNMPSSNAEAFNAKVLEELREKVKGLYLPSCLGMKKLLKSNHIDAFNKANSVEVNESLKYWVDGEPLKRFRQLGSKQRKHRL

SEQ ID NO: 3799 - DNA, 831 bp, Candida sp.
atgtccgacgaggaatcagatatcttatacgaagtcagagacagaaccgccatcatcaccttgaacatccccaagagattgaacgcattgaacggcgctcaatacttgaagttgggcaagttcttggagagagccaacaacgaagaggacaccgtcttgaccttgatccaggccctgggcagattcttctccgccggtgccaatttcgccgacaacgacatggccaaggtcgaaatgtccaagttgttcagtcacgagtactggttggatagattcgtcgccagaaacatctggttgaccaacttgttcaatgaccacaagaagatcttggccgctgctgtcaacggtccagttatcggtttgagtactggtttgttgttgttggtcgacttggtctacgtccacgacttgaacaagttctatctcttggccccatttgccaacttgggtttggttgccgaaggtgcttcctcggccactttgttcaacagattgggctggtcaaaggcttctgaagctttgttgttggccaagccaatcagcggccaggactgttacaacgctggtttcatcaacaagcactacgacggtaagttttcctccactgaggagttcaacgaacacgtctacaaggagttgaccgatgcctttgaaaacttgcacgaagattccatcttgcagaacaagcaattgttgaagttgtcgagagaccaggctatcaatgttgccaactcgcaagaggtcatgagaggtttgggcaagtggttggaaggtgttccacaaaccagatttgctcaattggcccagaaggaggtcaagcacaaactttag

SEQ ID NO: 3800 - protein, 276 aa, Candida sp.
MSDEESDILYEVRDRTAIITLNIPKRLNALNGAQYLKLGKFLERANNEEDTVLTLIQASGRFFSAGANFADNDMAKVEMSKLFSHEYWLDRFVARNIWLTNLFNDHKKILAAAVNGPVIGLSTGLLLLVDLVYVHDLNKFYLLAPFANLGLVAEGASSATLFNRLGWSKASEALLLAKPISGQDCYNAGFINKHYDGKFSSTEEFNEHVYKELTDAFENLHEDSILQNKQLLKLSRDQAINVANSQEVMRGLGKWLEGVPQTRFAQLAQKEVKHKL

SEQ ID NO: 3801 - DNA, 807 bp, Candida sp.; identical to SEQ ID NO: 3676

SEQ ID NO: 3802 - protein, 268 aa, Candida sp.; identical to SEQ ID NO: 3677

SEQ ID NO: 3803 - protein, 276 aa, Candida tropicalis
MSEEETDILYEVKDRTAIITLNIPDKLNALNGAQYLKLGKFLERANNEEDTVLTLIQASGRFFSAGANFADNDMTKVEVEKLFSHEYWLERFVARNVWLTNLFNDHKKILAAAVNGPVIGLSTGLLMLVDLIYVHDLNKFYLLAPFANLGLVAEGASSATLFARLGWSKASEALLLAKPISGADCYNAGLINKHYDGKFSSTEQFNDQVYKELNDAFENLHEDSILQNKQLLKLSRDQFINHANSQEVMRGLGKWLEGVPQTRFVQLAQKEVKHKL

SEQ ID NO: 3804 - protein, 346 aa, Yarrowia lipolytica
MRSLYINVPGLFPSTSLARETVHHRTEMLRTIRSSSRLGVRAMSTAATRRAAQIGFHTRVPTVVTKAPTLRMQTTPFSSSAPAQTFGDKKYEHILTSTPVPKVALVTLNRPKALNALCTPLIKELNEALQAADADPTIGAIVLTGSEKSFAAGADIKEMKDKTVTSVLNENFIEEWGNMANIKKPIIAAVNGFALGGGCELAMMADIIYAGAKAKFGQPEIKLGVIPGAGGTQRLTRAIGLYRANHYILTGEMFTAQQAADWGLAAKVYEPAQLVDESVKAAAQIASYGQLAVQAAKASVHQSAEVGLRAGLEFERVRFHGLFGTHDQKEGMAAFAEKREPNFKNE

SEQ ID NO: 3805 - protein, 268 aa, Candida tropicalis
MSDELITYEVKDRAVLITLNNPKKLNSLTIHQYDTICKYLERANNEEDTIITLIQSTGRVFSAGANADSIVGQDAELETWMNLSIAKQTFLVQTFLAHKKILAVALNGPVIGLSASFVTLCDLIYVNDLSKTFLLTPFANIGILAEGGTSATLPMRLGWSKASEALLLSKRISGDDLQNAGLINKHYNGKFKTAEEFNVTVLNELLDATETLHQDSILQNKQLLQAMFKPRISEVNSQEVSRGVYKWTSGEPMSRFKKLLTGELKHKL

SEQ ID NO: 3806 - protein, 346 aa, Yarrowia lipolytica; identical to SEQ ID NO: 3804

SEQ ID NO: 3807 - DNA, 4302 bp, Artificial Sequence
  Description of Artificial Sequence: Synthetic polynucleotide
ggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcgagttcggcatggcagatcatcatgcctgcaggaagatgaagcgtatgagtattatgagtactgtcggacgttggaaggtggcagagttaagcccgagaaagcaaggaaggagtgggagatgatgagtgatgcggccaaagaggatgtgaaggctgcgtatctgtttttgatagctggtggtagccgaatagaggaaggcaagcttgttcatattggatgatgatggtagatggtggctgccaaagtggttgtaaatagaaaaaagtgggtttgggtctgttgatagttagtggtggcggctgtctgtgattacgtcagcaagtagcacctcggcagttaaaacagcagcaacagaaaaaaaatgtgtgaaagtttgattcccccacagtctaccacacccagagttccatttatccataatatcacaagcaatagaaaaataaaaaattatcaacaaatcacaacgaaaagattctgcaaaattattttcacttcttcttttgacttcctcttcttcttgttaggttctttccatattttccccttaaacccatacacaacgcagccagaagagcccgggtctagatgtgtgctcttccgctccaggcttgttatgactctagagagaagtgtgtgtgtgtgtgtgcgtttgttttactatacattcaacatgttctttttcttttttgatatttattccaactataattatacacagattcgtatatactttactttaccctctttcgtagttttttaatttgatgatttttgagtttcatatccaaggtcaaaacccgaccgaattcatatgcgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatactagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaag

SEQ ID NO: 3808 - DNA, 5570 bp, Artificial Sequence
  Description of Artificial Sequence: Synthetic polynucleotide
ggccgcgagcactaggttttgataatttggttcttacagtttatgtattttgattcttccttttttagatacttttttttatattttattattccttattgatgtaacgacagtcccactataattaacttaaactttgctgtaaatcagatgacaagtgtttccctgtttgcaggggagctctactagtttccttaattcatcttggttatgttgttcttgcaccgcaaggataagctgggcccgaatccaggccacgcataccaactatcgctgcccggaaaaaatacaaactagtaaactgcaaaaaaccatatataaacaataagaattttctctgtatcattcttcgaaaaacctcaccttctctctctctctctctctcacccttcctttcccctatcacatcttcatcttcacatcaccaactcaaaacccctaagcagccaaagtaaagaacagagaatgattccacaacatcacactatgttcttcgccgttaattaagaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttttaattaaagataatcacaggggtagagaccttggttatgggctgattggaggaagaaatggggtgatttggcacttgacagcgcgagagtggttaacacctggtttccctcatttgggttctgacatttgataagttgaaagaacaatgcagaattcacatggctaatttggcctcggttccacaacgcactcagcattaaaaaaaaaatacgcaatggcagctcggtcgacgcagcagaagcgccgacgtaccgtcgcgttgccccgcccatgcctcgccgacccctccaccgccatcgtttgcccattgtttgtggtagtgcgccgtgacacaaaaacttgtcctgtcacatgctgaagttacaccaacataactactatgggattacgtaatcaaaaatttcacagttttaacaaaaaaaaaatcatacaatcaacattgggacatcttgccctcccccacaaaacttgcttctgcatcaatcatatataaacatcatgaaataagcctaaactcacttctttttttttcatccttcctacttcttctttcatagtaactactttttttttattaccacacttattcattcataccacgctatcggccggccgcatgcggatccgagctcgcggccgccagtgtgatggatatctgcagcggccgctaaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctcgacgggtacaacgagaattgtattgaattgatcaagaacatgatcttggtgttacagaacatcaagttcttggaccagactgagaatgcacagatatacaaggcgtcatgtgataaaatggatgagatttatccacaattgaagaaagagtttatggaaagtggtcaaccagaagctaaacaggaagaagcaaacgaagaggtgaaacaagaagaagaaggtaaataagtattttgtattatataacaaacaaagtaaggaatacagatttatacaataaattgccatacaagtcacgtgagatatctcatccattccccaactcccaagaaaaaaaaaaagtgaaaaaaaaaatcaaacccaaagatcaacctccccatcatcatcgtcatcaaacccccagctcaattcgcaatggttagcacaaaaacatacacagaaagggcatcagcacacccctccaaggttgcccaacgtttattccgcttaatggagtccaaaaagaccaacctctgcgcctcgatcgacgtgaccacaaccgccgagttcctttcgctcatcgacaagctcggtccccacatctgtctcgtgaagacgcacatcgatatcatctcagacttcagctacgagggcacgattgagccgttgcttgtgcttgcagagcgccacgggttcttgatattcgaggacaggaagtttgctgatatcggaaacaccgtgatgttgcagtacacctcgggggtataccggatcgcggcgtggagtgacatcacgaacgcgcacggagtgactgggaagggcgtcgttgaagggttgaaacgcggtgcggagggggtagaaaaggaaaggggcgtgttgatgttggcggagttgtcgagtaaaggctcgttggcgcatggtgaatatacccgtgagacgatcgagattgcgaagagtgatcgggagttcgtgattgggttcatcgcgcagcgggacatggggggtagagaagaagggtttgattggatcatcatgacgcctggtgtggggttggatgataaaggcgatgcgttgggccagcagtataggactgttgatgaggtggttctgactggtaccgatgtgattattgtcgggagagggttgtttggaaaaggaagagaccctgaggtggagggaaagagatacagggatgctggatggaaggcatacttgaagagaactggtcagttagaataaatattgtaataaataggtctatatacatacactaagcttctaggacgtcattgtagtcttcgaagttgtctgctagtttagttctcatgatttcgaaaaccaataacgcaatggatgtagcagggatggtggttagtgcgttcctgacaaacccagagtacgccgcctcaaaccacgtcacattcgccctttgcttcatccgcatcacttgcttgaaggtatccacgtacgagttgtaatacaccttgaagaacggcttcgtctgc

SEQ ID NO: 3809 - protein, 327 aa, Rattus norvegicus
MATAMTVSSKLLGLLMQQLRGTRQLYFNVSLRSLSSSAQEASKRIPEEVSDHNYESIQVTSAQKHVLHVQLNRPEKRNAMNRAFWRELVECFQKISKDSDCRAVVVSGAGKMFTSGIDLMDMASDILQPPGDDVARIAWYLRDLISRYQKTFTVIEKCPKPVITAIHGGCIGGGVDLISACDIRYCTQDAFFQVKEVDVGLAADVGTLQRLPKVIGNRSLVNELTFTARKMMADEALDSGLVSRVFPDKDVMLNAAFALAADISSKSPVAVQGSKINLIYSRDHSVDESLDYMATWNMSMLQTQDIIKSVQAAMEKKDSKSITFSKL

SEQ ID NO: 3810 - protein, 327 aa, Mus musculus
MATAMTVSSKLRGLLMQQLRGTSQLYFNISLRSLSSSAQEASKRAPEEVSDHNYESIQVTSAQKHVLHVQLNRPEKRNAMNRAFWRELVECFQKISKDSDCRAVVVSGAGKMFTSGIDLMDMASELMQPSGDDAARIAWYLRDLISKYQKTFTVIEKCPKPVIAAIHGGCIGGGVDLVSACDIRYCTQDAFFQIKEVDMGLAADVGTLQRLPKVIGNQSLVNELTFSARKMMADEALDSGLVSRVFQDKDAMLNAAFALAADISSKSPVAVQGSKINLIYSRDHSVDESLDYMATWNMSMLQTQDIIKSVQAAMEKRDTKSITFSKL

SEQ ID NO: 3811 - protein, 265 aa, Candida tropicalis
MTFNPESYKYEFYTVTQIEDGFAHVQYTNPKTLNAFTEQNWKDYGEIFRRLDKEEDIQLILFSSGVEKSFSSGLNLKTAANLFKSETNSTEEAIKELHEHITGFQYDIGTPARISTPTIGILNGLNLGLALDIAAAFTIRIAVEGAQFSIAEVNIGITADIGSLQRLPAIINNKSLLFQHALMGDKWGTDEAMKLGFVSTVVPTIEEGIEYAKTLGEKICSVPAWAIKGTKKHIQDIINGTTVEQGLKDVANWNAKNITLSRGKL

SEQ ID NO: 3812 - protein, 265 aa, Candida sp.
MTFDPSTYKYEFFTVSEIQEGFAHVQYTNPKTLNAFSEQNWKDYGSIFARLDAEEDIQVILFSSGVPRSFSSGLNLKTAANLFSSEQQSTAEAIKDLHVHIRDFQSDIGTPARISTPTIAILNGLNLGLALDMAAAYTIRIAVEGAQFSIAEVNIGITADIGSLQRLPALINNKSLLFQHALLGDKWGPEEAEKLGFVSTVVPSVEAGIEYAKALGAKICEAPAWAIKGTKKHIQDVINGTSVDQGLADVANWNARNITLSKGKL

SEQ ID NO: 3813 - protein, 271 aa, Saccharomyces cerevisiae
MSSRVCYHINGPFFIIKLIDPKHLNSLTFEDFVYIALLLHKANDIDSVLFTVLQSSGKYFSSGGKFSAVNKLNDGDVTSEVEKVSKLVSAISSPNIFVANAFAIHKKVLVCCLNGPAIGLSASLVALCDIVYSQNDSVFLLFPFSNLGFVAEVGTSVTLTQKLGINSANEHMIFSTPVLFKELIGTIITKNYQLTNTETFNEKVLQDIKQNLEGLYPKSVLGMKELLHSEMKQKLIKAQAMETNGTLPFWASGEPFKRFKQLQEGNRRHKL

SEQ ID NO: 3814 - protein, 9 aa, Artificial Sequence
  Description of Artificial Sequence: Synthetic peptide
DYKDDDDKG

SEQ ID NO: 3815 - protein, 14 aa, Artificial Sequence
  Description of Artificial Sequence: Synthetic peptide
GKPIPNPLLGLDST

SEQ ID NO: 3816 - protein, 10 aa, Artificial Sequence
  Description of Artificial Sequence: Synthetic peptide
EQKLISEEDL

SEQ ID NO: 3817 - protein, 11 aa, Herpes simplex virus
QPELAPEDPED

SEQ ID NO: 3818 - protein, 9 aa, Influenza A virus
YPYDVPDYA

SEQ ID NO: 3819 - protein, 11 aa, Vesicular stomatitis virus
YTDIEMNRLGK

SEQ ID NO: 3820 - protein, 6 aa, Artificial Sequence
  Description of Artificial Sequence: Synthetic 6xHis tag
HHHHHH

SEQ ID NO: 3821 - protein, 7 aa, Artificial Sequence
  Description of Artificial Sequence: Synthetic peptide
  MOD_RES (3)..(5): Any amino acid and this region may encompass 1-3 residues, wherein some positions may be absent
CCXXXCC

SEQ ID NO: 3822 - protein, 6 aa, Artificial Sequence
  Description of Artificial Sequence: Synthetic peptide
CCPGCC

SEQ ID NO: 3823 - protein, 6 aa, Artificial Sequence
  Description of Artificial Sequence: Synthetic peptide
LVPRGS

SEQ ID NO: 3824 - protein, 5 aa, Artificial Sequence
  Description of Artificial Sequence: Synthetic peptide
DDDDK

SEQ ID NO: 3825 - protein, 7 aa, Artificial Sequence
  Description of Artificial Sequence: Synthetic peptide
ENLYFQG

SEQ ID NO: 3826 - protein, 8 aa, Artificial Sequence
  Description of Artificial Sequence: Synthetic peptide
LEVLFQGP

SEQ ID NO: 3827 - DNA, 25 bp, Artificial Sequence
  Description of Artificial Sequence: Synthetic primer
aacgacaagattagattggttgaga

SEQ ID NO: 3828 - DNA, 25 bp, Artificial Sequence
  Description of Artificial Sequence: Synthetic primer
gtcgagtttgaagtgtgtgtctaag

SEQ ID NO: 3829 - DNA, 51 bp, Artificial Sequence
  Description of Artificial Sequence: Synthetic primer
agatctcatatggctccatttttgcccgaccaggtcgactacaaacacgtc

SEQ ID NO: 3830 - DNA, 59 bp, Artificial Sequence
  Description of Artificial Sequence: Synthetic primer
atctggatcctcattactacaacttggctttggtcttcaaggagtctgccaaacctaac

SEQ ID NO: 3831 - DNA, 38 bp, Artificial Sequence
  Description of Artificial Sequence: Synthetic primer
acatctggatcctcattactacaacttggccttggtct

SEQ ID NO: 3832 - DNA, 47 bp, Artificial Sequence
  Description of Artificial Sequence: Synthetic primer
cacacagctcttctagaatggctccatttttgcccgaccaggtcgac

SEQ ID NO: 3833 - DNA, 50 bp, Artificial Sequence
  Description of Artificial Sequence: Synthetic primer
cacacagctcttcctttctacaacttggctttggtcttcaaggagtctgc

SEQ ID NO: 3834 - DNA, 21 bp, Artificial Sequence
  Description of Artificial Sequence: Synthetic primer
gtctactgattcccctttgtc

SEQ ID NO: 3835 - DNA, 20 bp, Artificial Sequence
  Description of Artificial Sequence: Synthetic primer
ttctcgttgtacccgtcgca

SEQ ID NO: 3836 - DNA, 32 bp, Artificial Sequence
  Description of Artificial Sequence: Synthetic primer
cacacacatatgcgacgggtacaacgagaatt

SEQ ID NO: 3837 - DNA, 32 bp, Artificial Sequence
  Description of Artificial Sequence: Synthetic primer
cacacaacgcgtagacgaagccgttcttcaag

SEQ ID NO: 3838 - DNA, 21 bp, Artificial Sequence
  Description of Artificial Sequence: Synthetic primer
atgatctgccatgccgaactc

SEQ ID NO: 3839 - DNA, 28 bp, Artificial Sequence
  Description of Artificial Sequence: Synthetic primer
agcgagttcggcatggcagatcatcatg

SEQ ID NO: 3840 - DNA, 32 bp, Artificial Sequence
  Description of Artificial Sequence: Synthetic primer
cacacactgcagttgtccaatgtaataatttt

SEQ ID NO: 3841 - DNA, 56 bp, Artificial Sequence
  Description of Artificial Sequence: Synthetic primer
cacacatctagacccgggctcttcttctgaataggcaattgataaacttacttatc

SEQ ID NO: 3842 - DNA, 48 bp, Artificial Sequence
  Description of Artificial Sequence: Synthetic primer
gagcccgggtctagatgtgtgctcttccaaagtacggtgttgttgaca

SEQ ID NO: 3843 - DNA, 37 bp, Artificial Sequence
  Description of Artificial Sequence: Synthetic primer
cacacacatatgaattctgtactggtagagctaaatt

SEQ ID NO: 3844 - DNA, 24 bp, Artificial Sequence
  Description of Artificial Sequence: Synthetic primer
gagctccaattgtaatatttcggg

SEQ ID NO: 3845 - DNA, 25 bp, Artificial Sequence
  Description of Artificial Sequence: Synthetic primer
gtcgacctaaattcgcaactatcaa

SEQ ID NO: 3846 - DNA, 53 bp, Artificial Sequence
  Description of Artificial Sequence: Synthetic primer
gaattcacatggctaatttggcctcggttccacaacgcactcagcattaaaaa

SEQ ID NO: 3847 - DNA, 40 bp, Artificial Sequence
  Description of Artificial Sequence: Synthetic primer
gagctcccctgcaaacagggaaacacttgtcatctgattt

SEQ ID NO: 3848 - DNA, 41 bp, Artificial Sequence
  Description of Artificial Sequence: Synthetic primer
cacctcgctcttccagctgtcatgtctattcaatgcttcga

SEQ ID NO: 3849 - DNA, 38 bp, Artificial Sequence
  Description of Artificial Sequence: Synthetic primer
cacacagcatgctaatgtttatatcgttgacggtgaaa

SEQ ID NO: 3850 - DNA, 45 bp, Artificial Sequence
  Description of Artificial Sequence: Synthetic primer
cacaaagcggaagagcaaattttgtattctcagtaggatttcatc

SEQ ID NO: 3851 - DNA, 38 bp, Artificial Sequence
  Description of Artificial Sequence: Synthetic primer
cacacagcatgcaaacttaagggtgttgtagatatccc

SEQ ID NO: 3852 - DNA, 44 bp, Artificial Sequence
  Description of Artificial Sequence: Synthetic primer
cacacacccgggatcgacagtcgattacgtaatccatattattt

SEQ ID NO: 3853 - DNA, 38 bp, Artificial Sequence; identical to SEQ ID NO: 3851
  Description of Artificial Sequence: Synthetic primer

SEQ ID NO: 3854 - DNA, 33 bp, Artificial Sequence
  Description of Artificial Sequence: Synthetic primer
cacacagagctcacagtcgattacgtaatccat

SEQ ID NO: 3855 - DNA, 34 bp, Artificial Sequence
  Description of Artificial Sequence: Synthetic primer
cacatctagagcatgcaaacttaagggtgttgta

SEQ ID NO: 3856 - DNA, 20 bp, Artificial Sequence
  Description of Artificial Sequence: Synthetic primer
ttaatgccttctcaagacaa

SEQ ID NO: 3857 - DNA, 20 bp, Artificial Sequence
  Description of Artificial Sequence: Synthetic primer
ggttttcccagtcacgacgt

SEQ ID NO: 3858 - DNA, 25 bp, Artificial Sequence
  Description of Artificial Sequence: Synthetic primer
ccttgctaattttcttctgtatagc

SEQ ID NO: 3859 - DNA, 20 bp, Artificial Sequence
  Description of Artificial Sequence: Synthetic primer
ttctcgttgtacccgtcgca

SEQ ID NO: 3860 - DNA, 20 bp, Artificial Sequence
  Description of Artificial Sequence: Synthetic primer
cacacaacttcagagttgcc

SEQ ID NO: 3861 - DNA, 20 bp, Artificial Sequence
  Description of Artificial Sequence: Synthetic primer
tcgccacctctgacttgagc

SEQ ID NO: 3862 - DNA, 20 bp, Artificial Sequence
  Description of Artificial Sequence: Synthetic probe
aattgaacatcagaagagga

SEQ ID NO: 3863 - DNA, 25 bp, Artificial Sequence
  Description of Artificial Sequence: Synthetic probe
cctgaaatttccaaatggtgtctaa

SEQ ID NO: 3864 - DNA, 20 bp, Artificial Sequence
  Description of Artificial Sequence: Synthetic probe
ttttttgtgcgcaagtacac

SEQ ID NO: 3865 - DNA, 20 bp, Artificial Sequence
  Description of Artificial Sequence: Synthetic probe
caacttgacgtgagaaacct

SEQ ID NO: 3866 - DNA, 20 bp, Artificial Sequence
  Description of Artificial Sequence: Synthetic probe
agatgctcgttttacaccct

SEQ ID NO: 3867 - DNA, 20 bp, Artificial Sequence
  Description of Artificial Sequence: Synthetic probe
acacagctttgatgttctct

SEQ ID NO: 3868 - DNA, 37 bp, Artificial Sequence
  Description of Artificial Sequence: Synthetic primer
cacacacccgggatgatcagaaccgtccgttatcaat

SEQ ID NO: 3869 - DNA, 62 bp, Artificial Sequence
  Description of Artificial Sequence: Synthetic primer
cacacatctagactctcttctattcttaattgccgcttccactaaacggcaaagtctccacg

SEQ ID NO: 3870 - DNA, 25 bp, Artificial Sequence
  Description of Artificial Sequence: Synthetic primer
gatattattccaccttcccttcatt

SEQ ID NO: 3871 - DNA, 26 bp, Artificial Sequence
  Description of Artificial Sequence: Synthetic primer
ccgttaaacaaaaatcagtctgtaaa

SEQ ID NO: 3872 - DNA, 32 bp, Artificial Sequence
  Description of Artificial Sequence: Synthetic primer
atgtccgacgacgagatagcaggaatagtcat

SEQ ID NO: 3873 - DNA, 33 bp, Artificial Sequence
  Description of Artificial Sequence: Synthetic primer
tcagaagagtaaatacaacgcactaaccaagct

SEQ ID NO: 3874 - DNA, 30 bp, Artificial Sequence
  Description of Artificial Sequence: Synthetic primer
atgctgaagagaaagagacaactcgacaag

SEQ ID NO: 3875 - DNA, 30 bp, Artificial Sequence
  Description of Artificial Sequence: Synthetic primer
gtggttatcggactctacataatgtcaacg

SEQ ID NO: 3876 - DNA, 45 bp, Artificial Sequence
  Description of Artificial Sequence: Synthetic primer
atgactcaggactataaagacgatagtcctacgtccactgagttg

SEQ ID NO: 3877 - DNA, 42 bp, Artificial Sequence
  Description of Artificial Sequence: Synthetic primer
ctattctacaatgtttaattcaacatcaccgtagccaaacct

SEQ ID NO: 3878 - DNA, 26 bp, Artificial Sequence
  Description of Artificial Sequence: Synthetic primer
atgtcgtctttaaagaacagaaaatc

SEQ ID NO: 3879 - DNA, 28 bp, Artificial Sequence
  Description of Artificial Sequence: Synthetic primer
ttataaatttatggcctctactatttct

SEQ ID NO: 3880 - DNA, 30 bp, Artificial Sequence
  Description of Artificial Sequence: Synthetic primer
cctacttccacagctttaatctactatcat

SEQ ID NO: 3881 - DNA, 27 bp, Artificial Sequence
  Description of Artificial Sequence: Synthetic primer
tttaagaaaacaactaagagaagccac

SEQ ID NO: 3882 - protein, 6 aa, Candida sp.
IDTFNK

SEQ ID NO: 3883 - protein, 6 aa, Candida sp.
PDQQAQ

SEQ ID NO: 3884 - protein, 6 aa, Candida sp.
ISDPEE

SEQ ID NO: 3885 - protein, 4 aa, Candida sp.
RGHP

SEQ ID NO: 3886 - protein, 4 aa, Candida sp.
ANFV

SEQ ID NO: 3887 - protein, 4 aa, Candida sp.
PQVG

SEQ ID NO: 3888 - protein, 4 aa, Candida sp.
PQVF

SEQ ID NO: 3889 - protein, 32 aa, Candida sp.
IYDQVRSGKLVGGMVSYLNDLPSQRIQPQQVA

SEQ ID NO: 3890 - protein, 33 aa, Candida sp.
QVISIEDAGKTVRGSTAFLNQLKDYTGSNSSKV

SEQ ID NO: 3891 - protein, 11 aa, Candida sp.
DLLKEPEQKGL

SEQ ID NO: 3892 - protein, 6 aa, Candida sp.
VWPTMV

SEQ ID NO: 3893 - protein, 6 aa, Candida sp.
VLNTVA

SEQ ID NO: 3894 - protein, 6 aa, Candida sp.
VLSSVA

SEQ ID NO: 3895 - DNA, 45 bp, Artificial Sequence; identical to SEQ ID NO: 3724
  Description of Artificial Sequence: Synthetic primer

SEQ ID NO: 3896 - DNA, 46 bp, Artificial Sequence
  Description of Artificial Sequence: Synthetic primer
gatcgacaatctctgggcctgagcagctgggtactcgtgctcaaag

SEQ ID NO: 3897 - DNA, 46 bp, Artificial Sequence
  Description of Artificial Sequence: Synthetic primer
ctttgagcacgagtacccagctgctcaggcccagagattgtcgatc

SEQ ID NO: 3898 - DNA, 48 bp, Artificial Sequence; identical to SEQ ID NO: 3725
  Description of Artificial Sequence: Synthetic primer

SEQ ID NO: 3899 - DNA, 45 bp, Artificial Sequence; identical to SEQ ID NO: 3724
  Description of Artificial Sequence: Synthetic primer

SEQ ID NO: 3900 - DNA, 53 bp, Artificial Sequence
  Description of Artificial Sequence: Synthetic primer
gtgggtcaaagacaccgaggatagccaaagcctgggcctgttggtctgggtac

SEQ ID NO: 3901 - DNA, 53 bp, Artificial Sequence
  Description of Artificial Sequence: Synthetic primer
gtacccagaccaacaggcccaggctttggctatcctcggtgtctttgacccac

SEQ ID NO: 3902 - DNA, 48 bp, Artificial Sequence; identical to SEQ ID NO: 3725
  Description of Artificial Sequence: Synthetic primer

SEQ ID NO: 3903 - DNA, 45 bp, Artificial Sequence; identical to SEQ ID NO: 3724
  Description of Artificial Sequence: Synthetic primer

SEQ ID NO: 3904 - DNA, 47 bp, Artificial Sequence
  Description of Artificial Sequence: Synthetic primer
gattctggtgaagacttgtggagcagcgacaccgaggatcgacaatc

SEQ ID NO: 3905 - DNA, 47 bp, Artificial Sequence
  Description of Artificial Sequence: Synthetic primer
gattgtcgatcctcggtgtcgctgctccacaagtcttcaccagaatc

SEQ ID NO: 3906 - DNA, 48 bp, Artificial Sequence; identical to SEQ ID NO: 3725
  Description of Artificial Sequence: Synthetic primer

SEQ ID NO: 3907 - DNA, 45 bp, Artificial Sequence; identical to SEQ ID NO: 3724
  Description of Artificial Sequence: Synthetic primer

SEQ ID NO: 3908 - DNA, 48 bp, Artificial Sequence
  Description of Artificial Sequence: Synthetic primer
gaatctactggtcattctgtaagcagccatcatcatggtgactctacc

SEQ ID NO: 3909 - DNA, 48 bp, Artificial Sequence
  Description of Artificial Sequence: Synthetic primer
ggtagagtcaccatgatgatggctgcttacagaatgaccagtagattc

SEQ ID NO: 3910 - DNA, 48 bp, Artificial Sequence; identical to SEQ ID NO: 3725
  Description of Artificial Sequence: Synthetic primer

SEQ ID NO: 3911 - DNA, 45 bp, Artificial Sequence; identical to SEQ ID NO: 3724
  Description of Artificial Sequence: Synthetic primer

SEQ ID NO: 3912 - DNA, 45 bp, Artificial Sequence
  Description of Artificial Sequence: Synthetic primer
caccgattctggtgaagacagcagcgtcaaagacaccgaggatcg

SEQ ID NO: 3913 - DNA, 45 bp, Artificial Sequence
  Description of Artificial Sequence: Synthetic primer
cgatcctcggtgtctttgacgctgctgtcttcaccagaatcggtg

SEQ ID NO: 3914 - DNA, 48 bp, Artificial Sequence; identical to SEQ ID NO: 3725
  Description of Artificial Sequence: Synthetic primer

SEQ ID NO: 3915 - DNA, 45 bp, Artificial Sequence; identical to SEQ ID NO: 3724
  Description of Artificial Sequence: Synthetic primer

SEQ ID NO: 3916 - DNA, 43 bp, Artificial Sequence
  Description of Artificial Sequence: Synthetic primer
ggtgatgaatctactggtcgcggcgtaggagtccatcatcatg

SEQ ID NO: 3917 - DNA, 43 bp, Artificial Sequence
  Description of Artificial Sequence: Synthetic primer
catgatgatggactcctacgccgcgaccagtagattcatcacc

SEQ ID NO: 3918 - DNA, 48 bp, Artificial Sequence; identical to SEQ ID NO: 3725
  Description of Artificial Sequence: Synthetic primer

SEQ ID NO: 3919 - DNA, 45 bp, Artificial Sequence; identical to SEQ ID NO: 3724
  Description of Artificial Sequence: Synthetic primer

SEQ ID NO: 3920 - DNA, 33 bp, Artificial Sequence
  Description of Artificial Sequence: Synthetic primer
gagtccatcatcatggcgactctaccaccaatc

SEQ ID NO: 3921 - DNA, 33 bp, Artificial Sequence
  Description of Artificial Sequence: Synthetic primer
gattggtggtagagtcgccatgatgatggactc

SEQ ID NO: 3922 - DNA, 48 bp, Artificial Sequence; identical to SEQ ID NO: 3725
  Description of Artificial Sequence: Synthetic primer

SEQ ID NO: 3923 - DNA, 45 bp, Artificial Sequence; identical to SEQ ID NO: 3724
  Description of Artificial Sequence: Synthetic primer

SEQ ID NO: 3924 - DNA, 41 bp, Artificial Sequence
  Description of Artificial Sequence: Synthetic primer
ctggtcattctgtaggaggctgccatcatggtgactctacc

SEQ ID NO: 3925 - DNA, 41 bp, Artificial Sequence
  Description of Artificial Sequence: Synthetic primer
ggtagagtcaccatgatggcagcctcctacagaatgaccag

SEQ ID NO: 3926 - DNA, 48 bp, Artificial Sequence; identical to SEQ ID NO: 3725
  Description of Artificial Sequence: Synthetic primer

SEQ ID NO: 3927 - DNA, 45 bp, Artificial Sequence; identical to SEQ ID NO: 3724
  Description of Artificial Sequence: Synthetic primer

SEQ ID NO: 3928 - DNA, 37 bp, Artificial Sequence
  Description of Artificial Sequence: Synthetic primer
catcatcatggtgactctttcaccaatcaaagccgag

SEQ ID NO: 3929 - DNA, 37 bp, Artificial Sequence
  Description of Artificial Sequence: Synthetic primer
ctcggctttgattggtgaaagagtcaccatgatgatg

SEQ ID NO: 3930 - DNA, 28 bp, Artificial Sequence
  Description of Artificial Sequence: Synthetic primer
gttgttgtcacctccccaggtacattgg

SEQ ID NO: 3931 - DNA, 28 bp, Artificial Sequence
  Description of Artificial Sequence: Synthetic primer
ccaatgtacctggggaggtgacaacaac

SEQ ID NO: 3932 - DNA, 48 bp, Artificial Sequence; identical to SEQ ID NO: 3725
  Description of Artificial Sequence: Synthetic primer

SEQ ID NO: 3933 - DNA, 45 bp, Artificial Sequence; identical to SEQ ID NO: 3724
  Description of Artificial Sequence: Synthetic primer

SEQ ID NO: 3934 - DNA, 33 bp, Artificial Sequence
  Description of Artificial Sequence: Synthetic primer
ggtcattctgtaggagcccatcatcatggtgac

SEQ ID NO: 3935 - DNA, 33 bp, Artificial Sequence
  Description of Artificial Sequence: Synthetic primer
gtcaccatgatgatgggctcctacagaatgacc

SEQ ID NO: 3936 - DNA, 48 bp, Artificial Sequence; identical to SEQ ID NO: 3725
  Description of Artificial Sequence: Synthetic primer

SEQ ID NO: 3937 - DNA, 45 bp, Artificial Sequence; identical to SEQ ID NO: 3724
  Description of Artificial Sequence: Synthetic primer

SEQ ID NO: 3938 - DNA, 33 bp, Artificial Sequence
  Description of Artificial Sequence: Synthetic primer
ctggtcattctgtaggcgtccatcatcatggtg

SEQ ID NO: 3939 - DNA, 33 bp, Artificial Sequence
  Description of Artificial Sequence: Synthetic primer
caccatgatgatggacgcctacagaatgaccag

SEQ ID NO: 3940 - DNA, 48 bp, Artificial Sequence; identical to SEQ ID NO: 3725
  Description of Artificial Sequence: Synthetic primer

SEQ ID NO: 3941 - DNA, 45 bp, Artificial Sequence; identical to SEQ ID NO: 3724
  Description of Artificial Sequence: Synthetic primer

SEQ ID NO: 3942 - DNA, 36 bp, Artificial Sequence
  Description of Artificial Sequence: Synthetic primer
gtgaagacttgtgggtctgcgacaccgaggatcgac

SEQ ID NO: 3943 - DNA, 36 bp, Artificial Sequence
  Description of Artificial Sequence: Synthetic primer
gtcgatcctcggtgtcgcagacccacaagtcttcac

SEQ ID NO: 3944 - DNA, 48 bp, Artificial Sequence; identical to SEQ ID NO: 3725
  Description of Artificial Sequence: Synthetic primer

SEQ ID NO: 3945 - DNA, 45 bp, Artificial Sequence; identical to SEQ ID NO: 3724
  Description of Artificial Sequence: Synthetic primer

SEQ ID NO: 3946 - DNA, 34 bp, Artificial Sequence
  Description of Artificial Sequence: Synthetic primer
ggtgaagacttgtgggccaaagacaccgaggatc

SEQ ID NO: 3947 - DNA, 34 bp, Artificial Sequence
  Description of Artificial Sequence: Synthetic primer
gatcctcggtgtctttggcccacaagtcttcacc

SEQ ID NO: 3948 - DNA, 48 bp, Artificial Sequence; identical to SEQ ID NO: 3725
  Description of Artificial Sequence: Synthetic primer

SEQ ID NO: 3949 - DNA, 28 bp, Artificial Sequence
  Description of Artificial Sequence: Synthetic primer
cacacaaggggaattgtgagcggataac

SEQ ID NO: 3950 - DNA, 24 bp, Artificial Sequence
  Description of Artificial Sequence: Synthetic primer
aacccaagttgacgtcgattctgg

SEQ ID NO: 3951 - DNA, 24 bp, Artificial Sequence
  Description of Artificial Sequence: Synthetic primer
ccagaatcgacgtcaacttgggtt

SEQ ID NO: 3952 - DNA, 27 bp, Artificial Sequence
  Description of Artificial Sequence: Synthetic primer
cacacaaactggatccaaccgttatcg

SEQ ID NO: 3953 - DNA, 45 bp, Artificial Sequence; identical to SEQ ID NO: 3724
  Description of Artificial Sequence: Synthetic primer

SEQ ID NO: 3954 - DNA, 47 bp, Artificial Sequence
  Description of Artificial Sequence: Synthetic primer
caaagacaccgaggatcgacaaagcctgggcctgttggtctgggtac

SEQ ID NO: 3955 - DNA, 47 bp, Artificial Sequence
  Description of Artificial Sequence: Synthetic primer
gtacccagaccaacaggcccaggctttgtcgatcctcggtgtctttg

SEQ ID NO: 3956 - DNA, 48 bp, Artificial Sequence; identical to SEQ ID NO: 3725
  Description of Artificial Sequence: Synthetic primer

SEQ ID NO: 3957 - DNA, 45 bp, Artificial Sequence; identical to SEQ ID NO: 3724
  Description of Artificial Sequence: Synthetic primer

SEQ ID NO: 3958 - DNA, 37 bp, Artificial Sequence
  Description of Artificial Sequence: Synthetic primer
caaagacaccgaggatcgccaatctctgggcctgttg

SEQ ID NO: 3959 - DNA, 37 bp, Artificial Sequence
  Description of Artificial Sequence: Synthetic primer
caacaggcccagagattggcgatcctcggtgtctttg

SEQ ID NO: 3960 - DNA, 48 bp, Artificial Sequence; identical to SEQ ID NO: 3725
  Description of Artificial Sequence: Synthetic primer

SEQ ID NO: 3961 - DNA, 45 bp, Artificial Sequence; identical to SEQ ID NO: 3724
  Description of Artificial Sequence: Synthetic primer

SEQ ID NO: 3962 - DNA, 39 bp, Artificial Sequence
  Description of Artificial Sequence: Synthetic primer
gttgacaccgattctggttccgacttgtgggtcaaagac

SEQ ID NO: 3963 - DNA, 39 bp, Artificial Sequence
  Description of Artificial Sequence: Synthetic primer
gtctttgacccacaagtcggaaccagaatcggtgtcaac

SEQ ID NO: 3964 - DNA, 48 bp, Artificial Sequence; identical to SEQ ID NO: 3725
  Description of Artificial Sequence: Synthetic primer

SEQ ID NO: 3965 - DNA, 45 bp, Artificial Sequence; identical to SEQ ID NO: 3724
  Description of Artificial Sequence: Synthetic primer

SEQ ID NO: 3966 - DNA, 59 bp, Artificial Sequence
  Description of Artificial Sequence: Synthetic primer
caaagacaccgaggatcgacaatctagccgcagcttggtctgggtactcgtgctcaaag

SEQ ID NO: 3967 - DNA, 59 bp, Artificial Sequence
  Description of Artificial Sequence: Synthetic primer
ctttgagcacgagtacccagaccaagctgccgctagattgtcgatcctcggtgtctttg

SEQ ID NO: 3968 - DNA, 48 bp, Artificial Sequence; identical to SEQ ID NO: 3725
  Description of Artificial Sequence: Synthetic primer

SEQ ID NO: 3969 - DNA, 45 bp, Artificial Sequence; identical to SEQ ID NO: 3724
  Description of Artificial Sequence: Synthetic primer

SEQ ID NO: 3970 - DNA, 45 bp, Artificial Sequence
  Description of Artificial Sequence: Synthetic primer
cggcatcttcaatgctgataacttgctctaaccattggcttggca

SEQ ID NO: 3971 - DNA, 44 bp, Artificial Sequence
  Description of Artificial Sequence: Synthetic primer
tgccaagccaatggttagagcaagttatcagcattgaagatgcc

SEQ ID NO: 3972 - DNA, 46 bp, Artificial Sequence
  Description of Artificial Sequence: Synthetic primer
tcggcaacgctggagagaacaaccttggagctgttggaaccagtgt

SEQ ID NO: 3973 - DNA, 46 bp, Artificial Sequence
  Description of Artificial Sequence: Synthetic primer
acactggttccaacagctccaaggttgttctctccagcgttgccga

SEQ ID NO: 3974 - DNA, 48 bp, Artificial Sequence; identical to SEQ ID NO: 3725
  Description of Artificial Sequence: Synthetic primer

SEQ ID NO: 3975 - DNA, 42 bp, Artificial Sequence
  Description of Artificial Sequence: Synthetic primer
gttcactgccatatgacttttacaaagaaaaacgttagtgta

SEQ ID NO: 3976 - DNA, 59 bp, Artificial Sequence
  Description of Artificial Sequence: Synthetic primer
caaagataccaatcaaggacaatctagcagcagcagtgtcgatggattcttgttctctg

SEQ ID NO: 3977 - DNA, 59 bp, Artificial Sequence
  Description of Artificial Sequence: Synthetic primer
cagagaacaagaatccatcgacactgctgctgctagattgtccttgattggtatctttg

SEQ ID NO: 3978 - DNA, 53 bp, Artificial Sequence
  Description of Artificial Sequence: Synthetic primer
cttcgagatgcggccgcttattacttggacaagatagcagcggtttcatcaga

SEQ ID NO: 3979 - DNA, 42 bp, Artificial Sequence; identical to SEQ ID NO: 3975
  Description of Artificial Sequence: Synthetic primer

SEQ ID NO: 3980 - DNA, 50 bp, Artificial Sequence
  Description of Artificial Sequence: Synthetic primer
gtgggtcaaagataccaatcaaagcagctctcttgttgaaagtgtcgatg

SEQ ID NO: 3981 - DNA, 50 bp, Artificial Sequence
  Description of Artificial Sequence: Synthetic primer
catcgacactttcaacaagagagctgctttgattggtatctttgacccac

SEQ ID NO: 3982 - DNA, 53 bp, Artificial Sequence; identical to SEQ ID NO: 3978
  Description of Artificial Sequence: Synthetic primer

SEQ ID NO: 3983 - DNA, 42 bp, Artificial Sequence; identical to SEQ ID NO: 3975
  Description of Artificial Sequence: Synthetic primer

SEQ ID NO: 3984 - DNA, 43 bp, Artificial Sequence
  Description of Artificial Sequence: Synthetic primer
ggacaatctcttgttgaaagtagcgatggattcttgttctctg

SEQ ID NO: 3985 - DNA, 43 bp, Artificial Sequence
  Description of Artificial Sequence: Synthetic primer
cagagaacaagaatccatcgctactttcaacaagagattgtcc

SEQ ID NO: 3986 - DNA, 53 bp, Artificial Sequence; identical to SEQ ID NO: 3978
  Description of Artificial Sequence: Synthetic primer

SEQ ID NO: 3987 - DNA, 42 bp, Artificial Sequence; identical to SEQ ID NO: 3975
  Description of Artificial Sequence: Synthetic primer

SEQ ID NO: 3988 - DNA, 42 bp, Artificial Sequence
  Description of Artificial Sequence: Synthetic primer
gtgtcgatggattcttgttcagcgtatctggcgattctgttg

SEQ ID NO: 3989 - DNA, 42 bp, Artificial Sequence
  Description of Artificial Sequence: Synthetic primer
caacagaatcgccagatacgctgaacaagaatccatcgacac

SEQ ID NO: 3990 - DNA, 53 bp, Artificial Sequence; identical to SEQ ID NO: 3978
  Description of Artificial Sequence: Synthetic primer

SEQ ID NO: 3991 - DNA, 42 bp, Artificial Sequence; identical to SEQ ID NO: 3975
  Description of Artificial Sequence: Synthetic primer

SEQ ID NO: 3992 - DNA, 45 bp, Artificial Sequence
  Description of Artificial Sequence: Synthetic primer
gatggattcttgttctctgtaagcggcgattctgttgatcttgac

SEQ ID NO: 3993 - DNA, 45 bp, Artificial Sequence
  Description of Artificial Sequence: Synthetic primer
gtcaagatcaacagaatcgccgcttacagagaacaagaatccatc

SEQ ID NO: 3994 - DNA, 53 bp, Artificial Sequence; identical to SEQ ID NO: 3978
  Description of Artificial Sequence: Synthetic primer

SEQ ID NO: 3995 - DNA, 42 bp, Artificial Sequence; identical to SEQ ID NO: 3975
  Description of Artificial Sequence: Synthetic primer

SEQ ID NO: 3996 - DNA, 33 bp, Artificial Sequence
  Description of Artificial Sequence: Synthetic primer
gagtccaaaaccatcgcgactctaccacccaac

SEQ ID NO: 3997 - DNA, 33 bp, Artificial Sequence
  Description of Artificial Sequence: Synthetic primer
gttgggtggtagagtcgcgatggttttggactc

SEQ ID NO: 3998 - DNA, 53 bp, Artificial Sequence; identical to SEQ ID NO: 3978
  Description of Artificial Sequence: Synthetic primer

SEQ ID NO: 3999 - DNA, 42 bp, Artificial Sequence; identical to SEQ ID NO: 3975
  Description of Artificial Sequence: Synthetic primer

SEQ ID NO: 4000 - DNA, 42 bp, Artificial Sequence
  Description of Artificial Sequence: Synthetic primer
gtggacattctagccaacgcggcgtaggagtccaaaaccatc

SEQ ID NO: 4001 - DNA, 42 bp, Artificial Sequence
  Description of Artificial Sequence: Synthetic primer
gatggttttggactcctacgccgcgttggctagaatgtccac

SEQ ID NO: 4002 - DNA, 53 bp, Artificial Sequence; identical to SEQ ID NO: 3978
  Description of Artificial Sequence: Synthetic primer

SEQ ID NO: 4003 - DNA, 42 bp, Artificial Sequence; identical to SEQ ID NO: 3975
  Description of Artificial Sequence: Synthetic primer

SEQ ID NO: 4004 - DNA, 39 bp, Artificial Sequence
  Description of Artificial Sequence: Synthetic primer
caaggacaatctcttgttggcagtgtcgatggattcttg

SEQ ID NO: 4005 - DNA, 39 bp, Artificial Sequence
  Description of Artificial Sequence: Synthetic primer
caagaatccatcgacactgccaacaagagattgtccttg

SEQ ID NO: 4006 - DNA, 53 bp, Artificial Sequence; identical to SEQ ID NO: 3978
  Description of Artificial Sequence: Synthetic primer

SEQ ID NO: 4007 - DNA, 42 bp, Artificial Sequence; identical to SEQ ID NO: 3975
  Description of Artificial Sequence: Synthetic primer

SEQ ID NO: 4008 - DNA, 40 bp, Artificial Sequence
  Description of Artificial Sequence: Synthetic primer
caatcaaggacaatctcttcgcgaaagtgtcgatggattc

SEQ ID NO: 4009 - DNA, 40 bp, Artificial Sequence
  Description of Artificial Sequence: Synthetic primer
gaatccatcgacactttcgcgaagagattgtccttgattg

SEQ ID NO: 4010 - DNA, 53 bp, Artificial Sequence; identical to SEQ ID NO: 3978
  Description of Artificial Sequence: Synthetic primer

SEQ ID NO: 4011 - DNA, 42 bp, Artificial Sequence; identical to SEQ ID NO: 3975
  Description of Artificial Sequence: Synthetic primer

SEQ ID NO: 4012 - DNA, 35 bp, Artificial Sequence
  Description of Artificial Sequence: Synthetic primer
caatcaaggacaatctcgcgttgaaagtgtcgatg

SEQ ID NO: 4013 - DNA, 35 bp, Artificial Sequence
  Description of Artificial Sequence: Synthetic primer
catcgacactttcaacgcgagattgtccttgattg

SEQ ID NO: 4014 - DNA, 53 bp, Artificial Sequence; identical to SEQ ID NO: 3978
  Description of Artificial Sequence: Synthetic primer

SEQ ID NO: 4015 - DNA, 42 bp, Artificial Sequence; identical to SEQ ID NO: 3975
  Description of Artificial Sequence: Synthetic primer

SEQ ID NO: 4016 - DNA, 41 bp, Artificial Sequence
  Description of Artificial Sequence: Synthetic primer
caaagataccaatcaaggaggctctcttgttgaaagtgtcg

SEQ ID NO: 4017 - DNA, 41 bp, Artificial Sequence
  Description of Artificial Sequence: Synthetic primer
cgacactttcaacaagagagcctccttgattggtatctttg

SEQ ID NO: 4018 - DNA, 53 bp, Artificial Sequence; identical to SEQ ID NO: 3978
  Description of Artificial Sequence: Synthetic primer

SEQ ID NO: 4019 - DNA, 42 bp, Artificial Sequence; identical to SEQ ID NO: 3975
  Description of Artificial Sequence: Synthetic primer

SEQ ID NO: 4020 - DNA, 40 bp, Artificial Sequence
  Description of Artificial Sequence: Synthetic primer
gtcaaagataccaatcaaggccaatctcttgttgaaagtg

SEQ ID NO: 4021 - DNA, 40 bp, Artificial Sequence
  Description of Artificial Sequence: Synthetic primer
cactttcaacaagagattggccttgattggtatctttgac

SEQ ID NO: 4022 - DNA, 53 bp, Artificial Sequence; identical to SEQ ID NO: 3978
  Description of Artificial Sequence: Synthetic primer

SEQ ID NO: 4023 - DNA, 42 bp, Artificial Sequence; identical to SEQ ID NO: 3975
  Description of Artificial Sequence: Synthetic primer

SEQ ID NO: 4024 - DNA, 53 bp, Artificial Sequence
  Description of Artificial Sequence: Synthetic primer
caatcccttttgttctggctccttcaacaagtccttgacaattggcttaccaa

SEQ ID NO: 4025 - DNA, 53 bp, Artificial Sequence
  Description of Artificial Sequence: Synthetic primer
gacttgttgaaggagccagaacaaaagggattggttttgaacactgttgctga

SEQ ID NO: 4026 - DNA, 53 bp, Artificial Sequence; identical to SEQ ID NO: 3978
  Description of Artificial Sequence: Synthetic primer

SEQ ID NO: 4027 - DNA, 23 bp, Artificial Sequence
  Description of Artificial Sequence: Synthetic primer
atcgttaccaccatccctacaat

SEQ ID NO: 4028 - DNA, 52 bp, Artificial Sequence; identical to SEQ ID NO: 3709
  Description of Artificial Sequence: Synthetic primer

SEQ ID NO: 4029 - DNA, 52 bp, Artificial Sequence; identical to SEQ ID NO: 3710
  Description of Artificial Sequence: Synthetic primer

SEQ ID NO: 4030 - DNA, 41 bp, Artificial Sequence; identical to SEQ ID NO: 3711
  Description of Artificial Sequence: Synthetic primer

SEQ ID NO: 4031 - DNA, 41 bp, Artificial Sequence; identical to SEQ ID NO: 3712
  Description of Artificial Sequence: Synthetic primer

SEQ ID NO: 4032 - DNA, 23 bp, Artificial Sequence
  Description of Artificial Sequence: Synthetic primer
gcttgttctgcaaaatggagtca

SEQ ID NO: 4033 - DNA, 24 bp, Artificial Sequence
  Description of Artificial Sequence: Synthetic primer
aggaaagacgaccatcttgtacaa

SEQ ID NO: 4034 - DNA, 24 bp, Artificial Sequence
  Description of Artificial Sequence: Synthetic primer
tggtctctggacaacttcaacaat

SEQ ID NO: 4035 - DNA, 20 bp, Artificial Sequence
  Description of Artificial Sequence: Synthetic primer
gggggagatcgttaccacca

SEQ ID NO: 4036 - DNA, 40 bp, Artificial Sequence; identical to SEQ ID NO: 3715
  Description of Artificial Sequence: Synthetic primer

SEQ ID NO: 4037 - DNA, 40 bp, Artificial Sequence; identical to SEQ ID NO: 3716
  Description of Artificial Sequence: Synthetic primer

SEQ ID NO: 4038 - DNA, 45 bp, Artificial Sequence; identical to SEQ ID NO: 3717
  Description of Artificial Sequence: Synthetic primer

SEQ ID NO: 4039 - DNA, 45 bp, Artificial Sequence; identical to SEQ ID NO: 3718
  Description of Artificial Sequence: Synthetic primer

SEQ ID NO: 4040 - DNA, 20 bp, Artificial Sequence
  Description of Artificial Sequence: Synthetic primer
caaaggcatcggtcaactcc

SEQ ID NO: 4041 - DNA, 40 bp, Artificial Sequence
  Description of Artificial Sequence: Synthetic primer
aagcttttaattaaagataatcacaggggtagagaccttg

SEQ ID NO: 4042 - DNA, 48 bp, Artificial Sequence
  Description of Artificial Sequence: Synthetic primer
ggatccgcatgcggccggccgatagcgtggtatgaatgaataagtgtg

SEQ ID NO: 4043 - DNA, 51 bp, Artificial Sequence
  Description of Artificial Sequence: Synthetic primer
ggatccgagctcgcggccgcgagcactaggttttgataatttggttcttac

SEQ ID NO: 4044 - DNA, 36 bp, Artificial Sequence
  Description of Artificial Sequence: Synthetic primer
gaattcttaattaacggcgaagaacatagtgtgatg

SEQ ID NO: 4045 - DNA, 43 bp, Artificial Sequence
  Description of Artificial Sequence: Synthetic primer
cacacagctcttccataatgcctaccgaacttcaaaaagaaag

SEQ ID NO: 4046 - DNA, 51 bp, Artificial Sequence
  Description of Artificial Sequence: Synthetic primer
cacacagctcttccctctcttctattcttaactggacaagatttcagcagc

SEQ ID NO: 4047 - DNA, 50 bp, Artificial Sequence
  Description of Artificial Sequence: Synthetic primer
cacacagctcttcagccatgcctaccgaacttcaaaaagaaagagaactc

SEQ ID NO: 4048 - DNA, 57 bp, Artificial Sequence
  Description of Artificial Sequence: Synthetic primer
cacacagctcttcgagcttacaatttagaactggacaagatttcagcagcttcttcg

SEQ ID NO: 4049 - DNA, 55 bp, Artificial Sequence
  Description of Artificial Sequence: Synthetic primer
cacacagctcttcagccatgacttttacaaagaaaaacgttagtgtatcacaagg

SEQ ID NO: 4050 - DNA, 37 bp, Artificial Sequence
  Description of Artificial Sequence: Synthetic primer
cacacagctcttcgagcttacttggacaagatagcag

SEQ ID NO: 4051 - DNA, 63 bp, Artificial Sequence
  Description of Artificial Sequence: Synthetic primer
gagcccgggtctagatgtgtgctcttccgctccaggcttgttatgactctagagagaagtgtg

SEQ ID NO: 4052 - DNA, 62 bp, Artificial Sequence
  Description of Artificial Sequence: Synthetic primer
cacacacatatgaattcggtcgggttttgaccttggatatgaaactcaaaaatcatcaaatt

SEQ ID NO: 4053 - DNA, 45 bp, Artificial Sequence
  Description of Artificial Sequence: Synthetic primer
cacacatctagacccgggctcttctggctgcgttgtgtatgggtt

SEQ ID NO: 4054 - DNA, 32 bp, Artificial Sequence
  Description of Artificial Sequence: Synthetic primer
cacacactgcaggaggatgaagaagacgaaga

SEQ ID NO: 4055 - DNA, 24 bp, Artificial Sequence
  Description of Artificial Sequence: Synthetic primer
agaagctttgttcagaccagccga

SEQ ID NO: 4056 - DNA, 24 bp, Artificial Sequence
  Description of Artificial Sequence: Synthetic primer
accaccggacatgacaatgttacc

SEQ ID NO: 4057 - DNA, 24 bp, Artificial Sequence
  Description of Artificial Sequence: Synthetic primer
gcagagttaagcccgagaaagcaa

SEQ ID NO: 4058 - DNA, 24 bp, Artificial Sequence
  Description of Artificial Sequence: Synthetic primer
ttgccttcctctattcggctacca

SEQ ID NO: 4059 - protein, 6 aa, Candida sp.
DQQAQR

SEQ ID NO: 4060 - protein, 4 aa, Candida sp.
FDPQ

SEQ ID NO: 4061 - protein, 11 aa, Candida sp.
DLLKEPEQKGL

SEQ ID NO: 4062 - protein, 6 aa, Yarrowia lipolytica
DDIKKR

SEQ ID NO: 4063 - protein, 4 aa, Yarrowia lipolytica
ADMG

SEQ ID NO: 4064 - protein, 8 aa, Yarrowia lipolytica
SAVALRKG

SEQ ID NO: 4065 - protein, 6 aa, Yarrowia lipolytica
KEALLR

SEQ ID NO: 4066 - protein, 4 aa, Yarrowia lipolytica
VDMG

SEQ ID NO: 4067 - protein, 8 aa, Yarrowia lipolytica
SCLGHRKG

SEQ ID NO: 4068 - protein, 6 aa, Yarrowia lipolytica
KEAILR

SEQ ID NO: 4069 - protein, 4 aa, Yarrowia lipolytica
VDMG

SEQ ID NO: 4070 - protein, 8 aa, Yarrowia lipolytica
SCIAMRKK

SEQ ID NO: 4071 - protein, 32 aa, Candida sp.
VISIEDAGKTVRGSTAFLNQLKDYTGSNSSKV

SEQ ID NO: 4072 - protein, 30 aa, Yarrowia lipolytica
AVALRKGEPVGNAVSYLKRYKDLANAKLNG

SEQ ID NO: 4073 - protein, 29 aa, Yarrowia lipolytica
CLGHRKGKPLGSSVGYLANKGLEQATLSG

SEQ ID NO: 4074 - protein, 31 aa, Yarrowia lipolytica
CIAMRKKKGHVGKSVEYLQRRDELQNARVDN

SEQ ID NO: 4075 - protein, 180 aa, Rattus norvegicus
MNPDLRKERASATFNPELITHILDGSPENTRRRREIENLILNDPDFQHEDYNFLTRSQRYEVAVKKSATMVKKMREYGISDPEEIMWFKNSVHRGHPEPLDLHLGMFLPTLLHQATAEQQERFFMPAWNLEITGTYAQTEMGHGTHLRGLETTATYDPKTQEFILNSPTVTSIKWWPGGL

SEQ ID NO: 4076 - protein, 180 aa, Rattus norvegicus
MNPDLRKERASATFNPELITHILDGSPENTRRRREIENLILNDPDFQHEDYNFLTRSQRYEVAVKKSATMVKKMREYGISDPEEIMWFKKLYLANFVEPVGLNYSMFIPTLLNQGTTAQQEKWMRPSQELQIIGTYAQTEMGHGTHLRGLETTATYDPKTQEFILNSPTVTSIKWWPGGL

SEQ ID NO: 4077 - protein, 662 aa, Candida sp.
MPTELQKERELTKFNPKELNYFLEGSQERSEIISNMVEQMQKDPILKVDASYYNLTKDQQREVTAKKIARLSRYFEHEYPDQQAQRLSILGVFDPQVFTRIGVNLGLFVSCVRGNGTNSQFFYWTINKGIDKLRGIYGCFGMTELAHGSNVQGIETTATFDEDTDEFVINTPHIGATKWWIGGAAHSATHCSVYARLKVKGKDYGVKTFVVPLRDSNHDLEPGVTVGDIGAKMGRDGIDNGWIQFSNVRIPRFFMLQKYCKVSRLGEVTMPPSEQLSYSALIGGRVTMMMDSYRMTSRFITIALRYAIHRRQFKKKDTDTIETKLIDYPLHQKRLFPFLAAAYLFSQGALYLEQTMNATNDKLDEAVSAGEKEAIDAAIVESKKLFVASGCLKSTCTWLTAEAIDEARQACGGHGYSSYNGFGKAYSDWVVQCTWEGDNNILAMNVAKPMVRDLLKEPEQKGLVLSSVADLDDPAKLVKAFDHALSGLARDIGAVAEDKGFDITGPSLVLVSKLNAHRFLIDGFFKRITPEWSEVLRPLGFLYADWILTNFGATFLQYGIITPDVSRKISSEHFPALCAKVRPNVVGLTDGFNLTDMMTNAAIGRYDGNVYEHYFETVKALNPPENTKAPYSKALEDMLNRPDLEVRERGEKSEEAAEILSS

SEQ ID NO: 4078 - protein, 709 aa, Candida sp.; identical to SEQ ID NO: 30

SEQ ID NO: 4079 - protein, 661 aa, Rattus norvegicus; identical to SEQ ID NO: 493

SEQ ID NO: 4080 - protein, 700 aa, Yarrowia lipolytica; identical to SEQ ID NO: 364

SEQ ID NO: 4081 - protein, 700 aa, Yarrowia lipolytica; identical to SEQ ID NO: 361

SEQ ID NO: 4082 - protein, 699 aa, Yarrowia lipolytica; identical to SEQ ID NO: 994

We claim:

1. A genetically modified yeast comprising (i) an acyl-CoA oxidase polypeptide, wherein the acyl-CoA oxidase polypeptide comprises a genetic modification that alters the enzyme activity of native acyl-CoA oxidase polypeptide; or an acyl-CoA dehydrogenase polypeptide, wherein the acyl-CoA dehydrogenase polypeptide comprises a genetic modification that alters the enzyme activity of native acyl-CoA dehydrogenase polypeptide; and (ii) an enoyl CoA isomerase polypeptide, wherein the enoyl CoA isomerase polypeptide comprises a genetic modification that alters the enzyme activity of native enoyl CoA isomerase polypeptide, wherein the yeast is capable of producing a diacid from a feedstock comprising one or more components from a vegetable oil; and wherein the genetic modification is performed by:
(i) adding a heterologous polynucleotide that encodes said polypeptide;
(ii) adding a regulatory sequence that regulates the expression of said polypeptide;
(iii) disrupting the polynucleotide that encodes said polypeptide;
(iv) deleting the regulatory sequence that regulates the expression of said polypeptide;
(v) deleting the coding sequence that encodes said polypeptide; or
(vi) any combination thereof.

2. The genetically modified yeast of claim 1, comprising a genetic modification that alters the enzyme activity of native dieneoyl CoA reductase (DCR).

3. The genetically modified yeast of claim 1, wherein the yeast is a genetically modified *Yarrowia lipoytica* yeast or *Candida* spp. yeast comprising at least one genetic modification.

4. The genetically modified yeast of claim 3, wherein the *Candida* spp. yeast is a genetically modified ATCC20336 yeast comprising at least one genetic modification.

5. The genetically modified yeast of claim 1, wherein the acyl-CoA oxidase polypeptide is selected from the group consisting of: a POX1 polypeptide, POX2 polypeptide, POX3 polypeptide, POX4 polypeptide, POX5 polypeptide, and POX6 polypeptide.

6. The genetically modified yeast of claim 1, wherein the acyl-CoA dehydrogenase polypeptide is selected from the group consisting of: ACAD, VLCAD, LCAD, MCAD and SCAD polypeptides.

7. The genetically modified yeast of claim 1, comprising a genetic modification that reduces the enzyme activity of native enoyl CoA isomerase polypeptide, and wherein the genetic modification is performed by (i) disrupting a polynucleotide that encodes the enoyl CoA isomerase polypeptide; or (ii) deleting the regulatory sequence that regulates the expression of said enoyl CoA isomerase polypeptide, wherein the regulatory sequence is a promoter operably linked to the polynucleotide that encodes said enoyl CoA isomerase polypeptide.

8. The genetically modified yeast of claim 1, comprising a genetic modification that increases the enzyme activity of native enoyl CoA isomerase polypeptide, and wherein the genetic modification is performed by (i) adding a heterologous polynucleotide that encodes said enoyl CoA isomerase polypeptide or (ii) adding a regulatory sequence that regulates the expression of said enoyl CoA isomerase peptide, wherein the regulatory sequence is a promoter inserted and operably linked to the polynucleotide that encodes said enoyl CoA isomerase polypeptide.

9. The genetically modified yeast of claim 1, comprising a genetic modification that reduces the cytoplasmic or peroxisomal activity of an acyl-CoA synthetase (ACS) polypeptide; wherein the genetic modification is performed by: (i) disrupting the polynucleotide that encodes said ACS polypeptide; (ii) deleting the regulatory sequence that regulates the expression of said ACS polypeptide; or (iii) deleting the coding sequence that encodes said ACS polypeptide.

10. The genetically modified yeast of claim 9, wherein the genetic modification is performed by disrupting the polynucleotide that encodes said acyl-CoA synthetase (ACS) polypeptide, and wherein said ACS polynucleotide is a FAT1 polypeptide.

11. The genetically modified yeast of claim 1, comprising a genetic modification that reduces the enzyme activity of PXA polypeptide, wherein the genetic modification is performed by (i) disrupting a polynucleotide that encodes the PXA polypeptide; (ii) deleting the regulatory sequence that regulates the expression of the PXA polypeptide; or (iii) deleting the coding sequence that encodes the PXA polypeptide, and wherein the PXA polypeptide is a PXA1 polypeptide a PXA2 polypeptide, or a combination thereof.

12. The genetically modified yeast of claim 1, wherein the diacid is a C4 to C24 diacid.

13. The genetically modified yeast of claim 12, wherein the diacid is dodecanedioic acid or sebacic acid.

14. A method for producing a diacid, comprising:
   a) contacting a genetically modified yeast with a feedstock comprising a vegetable oil, wherein the genetically modified yeast comprises:
      (i) an acyl-CoA oxidase polypeptide, wherein the acyl-CoA oxidase polypeptide comprises a genetic modification that alters the enzyme activity of native acyl-CoA oxidase polypeptide; or an acyl-CoA dehydrogenase polypeptide, wherein the acyl-CoA dehydrogenase polypeptide comprises a genetic modification that alters the enzyme activity of native acyl-CoA dehydrogenase polypeptide; and
      (ii) an enoyl CoA isomerase polypeptide, wherein the enoyl CoA isomerase polypeptide comprises a genetic modification that alters the enzyme activity of native enoyl CoA isomerase polypeptide, wherein the yeast is capable of producing a diacid from a feedstock comprising one or more components from a vegetable oil; and wherein the genetic modification is performed by:
         (i) adding a heterologous polynucleotide that encodes said polypeptide;
         (ii) adding a regulatory sequence that regulates the expression of said polypeptide;
         (iii) disrupting the polynucleotide that encodes said polypeptide;
         (iv) deleting the regulatory sequence that regulates the expression of said polypeptide;
         (v) deleting the coding sequence that encodes said polypeptide; or
         (vi) any combination thereof; and
   b) culturing the yeast under conditions in which diacid is produced from the feedstock.

15. The method of claim 14, wherein said diacid is dodecanedioic acid or sebacic acid.

* * * * *